United States Patent 9,551,006 (ISOLATED POLYNUCLEOTIDES AND POLYPEPTIDES, AND METHODS OF USING SAME FOR IMPROVING PLANT PROPERTIES) - sequence listing, part 3

SEQ ID NO: 3188 - DNA, 1396 bp, Cajanus cajan
gacttattgacacaggaggagcgcgccattaagaagaaagtcagagaatgtatggaaaaagaaattgctccaataatgaccgagtactgggagaaggccaagttcccattcatgttattccaaagcttggtgcattgcgcattgctggtggcacaatcaagggttatggttgtcctggcctttctatcactggaagtgctataactatggcagaagttgcaagagttgatgcaagctgttcaacttttattttggtccattcatccttggcaatgctcactattgcattgtgtggatcagaagcccagaagcaaaagtatctgccttctttggcacagttgcaaactatagcatgctggggtttgactgaacctgactatggaagtgatgcaagtgctttgaagaccactgctacaaaggtggacggaggttggattctggagggacaaaagcggtggataggaaacagtacatttgctgatgtattggttatctttgctaggaatgcaacaacgaatcagataaatgggtttattattaaaaaggatgcacctggtttaacagtcacaaaaatagagaataaaattggacttcggatcgtacaaaatggagacattgttatgagaaaagtttttgtccctgatgaggacagaattgcaggtgtaaactcttttcaggacacaagcaaggtacttgctgtttcacgtgtaatggttgcttggcaacccattggtatatcgatgggcatctatgatatgtgtcataggtacctaaaggagaggaaacaatttggagcaccattggcagctttccaaatcagccaactgaaacttgtccagatgcttggtaatattcaagctatgattcttgttggttggcgcctctgcaaattgtatgagagtggtaaaatgactccagggcatgctagtttggggaagtcatggattaccttgagagcaagagaaacagctgctctggggcgagaattgcttggtggcaatggaattttggccgattttcttgtggcgaaggcattctgtgatttagaacccatctatacctacgaaggcacgtatgacatcaacaccctgattacaggcagggaagttactgattttgccagctttaagccagttgctcagagaagtcgattgtaaaagtgaaattcatgttccttttatagactccatttggccacttcaatgtatggcatgtgactgacaatgttttgtatttgagaaacgagatactttaataattatacaaatgctcgtgtagataacaacataattagcaaaaaatttggaattctgaaacccagatatttttcacatctagatctattctttgttgtgggggcatcgtactggagagtaggctgccgataattggtaga

SEQ ID NO: 3189 - DNA, 1710 bp, Glycine max
agttatcaccttattttgcgtgcctttccgtcgtgctttttattaaaataccctccttccttcctaccataccatactgcccagtttcttctccatctaccacttggctttcacgtttaccttcgcagcgctctttctctctgaaccctaatttacacacactccctttattcgatccctctctccaaccatggcgatcaactcttccaagaatccagatggttctgtccaaaatgcaatgccttcgtatttttattctccaccactagatgtttctgctgcatttccacaagcaacaccagcatcaacgtttcctccttgtgcttcagattattttcaattggacaacttattgacaacagaggagcaagccattaggaagaaagtaagagagtgtatggaaaaagaaattgctccaataatgactgagtactgggagaaggccaagtttccatttcatgttattccaaagcttggtgcgttgcgcattgctggtggcacaatcaaggattatggttgtcctggtctttctatcactggaagtgctatagctgtggcagaagttgcaagagttgatgcaagttgttcaacttttattttggtccattcatccttggcaatgctcactattgcattatgtggatcagaagctcagaagcaaaagtatttgccttctttggcacaattgcaaactgtagcatgttgggctttgaccgaacctgactatggaagtgatgctagtgctttgaagaccactgccacaaaggtggagggaggttggatcctggagggtcaaaagcggtggataggaaacagtacatttgctgatgttttggttgtctttgctaggaatgcatcaactaatcagataaatggatttattattaaaaaggatgctcctggtttaacagtcacaaaaatagagaataaaattggactcaggattgtacaaaatggagacattgttatgaggaaagtttttgtccctgacgaggacagaattgcaggagtaaactcttttcaggacacaaacaaggtacttgctgtttcacgcgtaatggttgcttggcaacccattggtatatcgatgggcatctacgatatgtgtcacaggtacctaaaggagaggaaacaatttggagcaccattagcagctttccaaatcagccagcagaaacttgttcagatgcttggtaatattcaagctatgatacttgttggttggcgcctctgcaaattgtatgagagtggtaaaatgactccaggtcaagctagcttgggaaagtcatggatcactttgagagcacgagaaacagctgccttggggcgagagttgctaggtggcaatggaattttggccgatttccttgtggcgaaggcattctgtgatttagaacccatctatacctacgaaggcacgtatgacattaataccttggttacaggtagagaagttactggttttgccagctttaagccagttgctcaaagaagtcgattgtaaaagtgaaacacattacatgctccttttgtagactccattaggcaacttcaatgtatggcatgtgactgtgactgtgtattggttaatgttttgtattttgagaattgagaagcatttaatttaataattatacaaatgctcgtgttgatggcaacagaatgagaaaaaaattagagttcttgaatccagatattttttcacattta

SEQ ID NO: 3190 - DNA, 1636 bp, Glycine max
atactgcccagtttcttctccatctaccacttggctttcacgtttaccttcgcagcgctctttctctctgaaccctaatttacacacactccctttattcgatccctctctccaaccatggcgatcaactcttccaagaatccagatggttctgtccaaaatgcaatgccttcgtatttttattctccaccactagatgtttctgctgcatttccacaagcaacaccagcatcaacgtttcctccttgtgcttcagattattttcaattggacaacttattgacaacagaggagcaagccattaggaagaaagtaagagagtgtatggaaaaagaaattgctccaataatgactgagtactgggagaaggccaagtttccatttcatgttattccaaagcttggtgcgttgcgcattgctggtggcacaatcaaggattatggttgtcctggtctttctatcactggaagtgctatagctgtggcagaagttgcaagagttgatgcaagttgttcaacttttattttggtccattcatccttggcaatgctcactattgcattatgtggatcagaagctcagaagcaaaagtatttgccttctttggcacaattgcaaactgtagcatgttgggctttgaccgaacctgactatggaagtgatgctagtgctttgaagaccactgccacaaaggtggagggaggttggatcctggagggtcaaaagcggtggataggaaacagtacatttgctgatgttttggttgtctttgctaggaatgcatcaactaatcagataaatggatttattattaaaaaggatgctcctggtttaacagtcacaaaaatagagaataaaattggactcaggattgtacaaaatggagacattgttatgaggaaagtttttgtccctgacgaggacagaattgcaggagtaaactcttttcaggacacaaacaaggtacttgctgtttcacgcgtaatggttgcttggcaacccattggtatatcgatgggcatctacgatatgtgtcacaggtacctaaaggagaggaaacaatttggagcaccattagcagctttccaaatcagccagcagaaacttgttcagatgcttggtaatattcaagctatgatacttgttggttggcgcctctgcaaattgtatgagagtggtaaaatgactccaggtcaagctagcttgggaaagtcatggatcactttgagagcacgagaaacagctgccttggggcgagagttgctaggtggcaatggaattttggccgatttccttgtggcgaaggcattctgtgatttagaacccatctatacctacgaaggcacgtatgacattaataccttggttacaggtagagaagttactggttttgccagctttaagccagttgctcaaagaagtcgattgtaaaagtgaaatacattactgctccttttgtagactccattaggcaacttcaatgtatgcaatgtgactgtgactgtgtattggttaatgttttgtaatttgagaaatgagaaacatttaatttaataattatacaaatgctcgtgttgatggcaacagaatgagaaaaaaattagagttcttgaatccagatattttttcacattta

SEQ ID NO: 3191 - DNA, 1437 bp, Glycine max
accgaaccaacaaccactttcagttttgactgtttcgcttccatggtgtctcgccccaatctagataatgcgaatatgaagatgccgtcatattttaattttccagcacttgatgtttctgttgcatttccacaggccactccagcctctacttttcctccttgtgcttcagattattttcatttcaatgacttgttgaaaccggaggagcaggccgtgaggaacagagtgagagagtgtatggaaaaagaaattgctcctataatgactgaggcatgtttaaatccaaaatcttacttaagggaacgaaaggagtactacttggaccaacgacttgttggtttatattcatcctgtttaaaatactgggagaaggctgaattcccatttcatgttatcccaaagtttgctgccctgcgtattgctggtggcacaattaagggttatggttgtcctgatctttccatagctggaagtgctgttgctgcagcagaagttgctagagttgatgcaagctgctcaactttctttttggtccattcttccttggcaatgctcactattgcattgtgtgggtctgaagctcagaagcaaaagtatctaccttctttggctcaaatgaaaactatagcatgttgggctttgactgaacctgactatggaagtgatgccagtgctttgaagaccacagcaacaaaggtggaaggtggttggatccttgatggccaaaagagatggataggaaacagtacatttgctgatttgttggttatctttgctaggaatatgacaactaatcaaataaatggatatattgtcaaaaaggatgcgccaggtttaacagtaacaaaaatggagaacaaaattggacttaggatcgtacaaaatggagacatagttatggggaaagtttttgtccctgatgatgacagactagaaggagtcaattcttttcaggatacaaacaaggtacttgctgtttcccgtgtaatggttgcttggcaacctattggtttatcaatgggcatctatgatatgtgtcataggtacctaaaggagaggaaacagtttggagcaccattagcagctttccaaatcagtcaacagaaacttgttcaaatgctaggtaacattcaagcaatgattcttgttggttggcgcctgtgcaagttgtatgagagtggtaaaatgacaccaggtcatgctagcttggggaagtcgtggattaccctgagggcaagagaaacagctgccttgggaagagaattgcttggtggcaatggaattttggctgattttctagtggcaaaggcattctgtgatatagaacctatctatacatttgaaggcacgtatgacataaacaccttggttacaggcagggaaattactggttttgccagctttaagccggttgctcaaaaaagtagactgtga

SEQ ID NO: 3192 - DNA, 1365 bp, Glycine max
accgaaccaacaaccactttcagttttgactgtttcgcttccatggtgtctcgccccaatctagataatgcgaatatgaagatgccttcatattttgatttgccaccacttgatgtttctcttgcatttccacaagcaactccagcatctacttttcctccttgtgcttcagattattttcaattcgatgacttgttgaaaccggaggagcaggccattaggatgaaagtgagagagtgtatggaaaaaaatattgctcccataatgacccagtactgggagaaggctgaattcccatttcatgttatcccaaagtttgctgccctgcgtattgctggtggcacaattaagggttatggttgtcctgatctttccatagctggaagtgctgttgctgcagcagaagttgctagagttgatgcaagctgctcaactttctttttggtccattcttccttggcaatgctcactattgcattgtgtgggtctgaagctcagaagcaaaagtatctaccttctttggctcaaatgaaaactatagcatgttgggctttgactgaacctgactatggaagtgatgccagtgctttgaagaccacagcaacaaaggtggaaggtggttggatccttgatggccaaaagagatggataggaaacagtacatttgctgatttgttggttatctttgctaggaatatgacaactaatcaaataaatggatatattgtcaaaaaggatgcgccaggtttaacagtaacaaaaatggagaacaaaattggacttaggatcgtacaaaatggagacatagttatggggaaagtttttgtccctgatgatgacagactagaaggagtcaattcttttcaggatacaaacaaggtacttgctgtttcccgtgtaatggttgcttggcaacctattggtttatcaatgggcatctatgatatgtgtcataggtacctaaaggagaggaaacagtttggagcaccattagcagctttccaaatcagtcaacagaaacttgttcaaatgctaggtaacattcaagcaatgattcttgttggttggcgcctgtgcaagttgtatgagagtggtaaaatgacaccaggtcatgctagcttggggaagtcgtggattaccctgagggcaagagaaacagctgccttgggaagagaattgcttggtggcaatggaattttggctgattttctagtggcaaaggcattctgtgatatagaacctatctatacatttgaaggcacgtatgacataaacaccttggttacaggcagggaaattactggttttgccagctttaagccggttgctcaaaaaagtagactgtgaaagtgtaagaatgtgttc

SEQ ID NO: 3193 - DNA, 1303 bp, Cucurbita pepo
tgagacagtgcatggaaaagaaattgctccaattatgacaaagtattgggagaaggcagagtttccatttcacgttatcccaaagcttggtaacttgtgcattgctggtggtacgatcaagggttatgagtgtcctggtatgactattactggaagtgctattgctactgctgaagtagcgagagttgatgcaagttgttccactttcatcctggtgcattcatccctggcaatgctcactatagctctatgtggatcggaggagcaaaagcagaaatatttaccttccttggcaaagttggacactatcgcttgttgggctttgactgagcctgaaaatggaagtgatgccagtggtttaagaacaacagcaacaaaggttgaaggaggttggttaatagaggggaaaaacgctggataggaaacagtacgtttgctgatttattggttatttttgccaggaatacaattacgaatgaaataaatggatttataatcaagaaaaattcccctggtctgatggttacaaagatagaaaataaaattggtttgcggatcgttcaaaatggagacattgtgatgaataaagtttttgtgcccgatgaagataggttacctggtgtaaattcattcaaggatacaaataaggttttagcggtttcacgtgtaatggttgcctggcagcccattggcatagcaatgggcgtttatgacatgtgccatagatatttgaaggagagggaacaatttggagcaccattagcagcttttcaagttaaccaacagaaacttgtcctcatgctgggaaatgttcaagcaatgttcctcatgggttggcgactttgtaaattatatgaaaagggcacgatgactccaggtcaagctagcttggggaaggcatggatcactctgagggctagggaaaccgttgctctaggacgtgagttgcttggaggcaatgggattttatctgactttctagttgcaaaggcattctgcgatttggaaccaatctatacgtacgaaggaacctacgacatcaacacgttggtaaccggcagagaaatcacaggtgttgccagtttcaagcctgcttctctcgccaaaagaagccgtctctaatatgttttctgcctaccaacagttgcaagattttctgatgcgaaattttgcacactggctggtgaggtaaccaaatgatattatctatgaataaaatgtgtatttatttagtttcttatggattctgtctacgggatacttcatcacaatgtgtgaataaactatttaaattaataaaaca

SEQ ID NO: 3194 - DNA, 1895 bp, Euphorbia peplus
cagaaaaataaaacgctttgtctatatctttatcctcttatcgttttcttctcttctctttcaatccaatccctacttcagatcaaatcatggcgattcatcctcctaaaacttcagatgatattgatgaaagttcgaggagttcctattttaattcacccccattggatgtttctgtagcgttccctcaagcaactccagcatccacatttcctccatctgcttccgactactttcaacttgatgacctattgactcctgaggagcaggctttaagaatcaaagtaagacaatgcatggaaaagaaagttgctcctataatggcagagtactgggagaaggcaaaatttccattccatgttgttcctgatcttggtgccctctgtattgctggtggaacaatcaagggttatgggtgtcctggtctctccctcactggaagtgctacagctgtagcagaagtttgtagagttgatgctagttgtggtactttcattatagtgcattcatctcttgcaatgcttacgatagcattttgtgggtcagaggcacaaaagcagaagtacttaccatctttggcccagttaagaaccattgcttgttggggcctgactgagcctgactacgggagtgatgcaagttcattaaaaactactgcaagaaaggtacaaggaggttggatcattgatggccaaaaacgctggataggaaacagtacttttgcagatgttttggtcatatttgctagaaatacttcaacgaatcagatcaatgggtatatagtaaagaaggattctccaggattaacatgtacaaaaatagaaaataaaattggattacgaatggtacagaatggagatattgtgctgaaacaagtttttgtccccgatgaagacaggctacctggtgttaattcctttcaagatacaagtaaggttcttgctgtttcacgtgtgatggtcgcctggcaacccatcggcatatcaatggggatctacgacatgtgtcacaggtatctgaaagagaggaaacaatttggagcaccattggctgcttttcaaataaaccagcagaaacttgttcacatgcttagtaatgttcaagctatgacactagtcggttggcgcctttgcaagctgtatgagagcgggaagatgactcctggtcatgccagtatggcaaagtcatggataaccttacgagcaagagaaacagctgctattgggcgggaattacttggtggcaatggaattttggcggactttctagttgccaaggcattttgcgacttggaacccattcacacatatgaaggcacttatgaaataaatgccttggttacgggtagggaaattactggtgttgccagtttcaaggcagctgctaaaagcaaacatagccgcctatagtgtaacatctcattctctttaccgttgacgtatttctttttcacaataatgtgcccttcaggttaaattataccattaaaaaacagtaattcaatgatctttacaaagctcatttgtaggataacattgggtgtataaacctttatatttggaaatgtaagtgttgtattagaacgttttatcctatttactgtcaattttaatacccaattggggcgtgggacattagctaaacaacctttcacatgtgttactagttggccttcgatattgctaagcaacaagtacaaacttagaaaggaaaatttagactgtaatctgatgtcggcttgtattgtgaaagtagaaaatgatggtcagagatgacgaattgctccttaccgctattaatatatagtcctcaaatcaacgtgcatgactaatttgatccatcggtggaatttgtttcacaagaaacttgccacctccctggttttacaaaatatc

SEQ ID NO: 3195 - DNA, 915 bp, Zostera marina
aaccagataaatgcgtttattgtgaaaaaaggttcacctggactggaagtttctaaaatagaaaataaaattggattgaggatggtccagaatggagatattctcttgaagaaagtttttgtcccagatgaggataggttatccggtattaattcttttaaggatataaataaggttcttgcggtttcacgtgttatggttgcatggcaaccaattggtataacaatgggtgcatatgacatgtgtcaccggtatttgagagagaggaaacaatttggagctccactagcagcatttcaaattaatcaagagaaacttgtccgcatgcttggtaatattcaagctatggttctagttggttggcgcatttgtaatatttatgaatctgggaaaatgacacccggtcaagctagcatggcaaaagcatggatttctttaagagcaagggaaacagtttctcttgcacgagagatgcttggaggcaatggaatattgagtgattttttggttgcaaaggcattttgcgatctagagccaatttactcatatgagggcacttatgatatcaactgcatggtcactgcaagagaaatcacagggctttccagtatcaaaccaaccattccagggaaaagaagccgactttgattcgccgatcatcatgaagccgactttgataaccgcagtgcgcaatcaaaagttggttatttcgtgataaatttgaactcaatatcctcagctctttatatcgtgcttgctccatccatagttcccttactttgctgtgaataattgaataaacaaataaatgtcgaatcttagaatggttgtgggtcttatagttaagtttgaattatgtccttctgtatgttacttatgagaattggcaatgacaatcaaaatgatatttacatg

SEQ ID NO: 3196 - DNA, 1544 bp, Artemisia annua
atccatcaaaagcaaacacaacaacgtaagaaaaaaaaaaaaacaaggaacttggaatcaatcactatgactagctttcaatcatctaaacctcaagatgaacagaataaggactcaaagagttcgtattttgattctccagcactggatgtttccttggcatttccacaagcaacgccagcttcagtctttcctccttgcacctcggactactatcagtttgcggacctattgacccctgaggaacaagctctaagactgaaagtaagagcgtgtgtcgagaaagaaattgctccaataatgaccaagtactgggagaaggcagaatttccatttgagattgttccaaagctaggcgctctgaacattgctggtggaactattaagggttacgggtgtcctggtctatccgtgactgcaaatgcgttagttactgcagaaatagccagagttgatgcaagttgctctacgtttattttagtgcattcgtctttggcaatgctcaccatatctttgtgcggttcagaaatacaaaaacaaaagtatctgccatcattggccaaactggacacaatagcttgttggggtttgaccgaacctgactatggaagtgatgcaagtggccttagaacaacagccacaaaggtggatggaggttgggtcattgaaggccaaaagagatggattggaaacagtacctttgcagatattttggtcatttttgctaaaaataaagacacaaaccagataaatggattcatcttaaagaagaatgcgcctgggttacaagctaccaaaatagaaaataaaattgggctgcgaatggttcaaaatggagatattctcatgcagaaagttttcgtccctgatgaggacaggttacctggtgtcaactctttccaagatacaagcaaagtgcttgctgtttctcgtgttatggtagcatggcaacctattgggatcacgatgggtgtctacgacatgtgccataggtacttacaagagagaaagcagtttggagcccctttggcagctttccaaataaaccagcagaagctagttcaaatgttgtccaatatacaagcaatgtttctaattggttggcgtctttgcaagctgtatgagagcggtaaaatgactcctggtcaagccagcttgggaaagtcatggatcacgctgagggcaagggagacagttgcattaggtcgtgagttacttggtggaaatggaataatatctgactttttagttgcaaaggcttttggagatttggagccaatctacacatacgaaggaacatatgacattaacaccttggtcacgggtagggagattacaggcatcgctagtttcaagcccgttgtaaagccaactagaagccgcatgtaattcatgtttcatgttaaggaaactgcttgttgattagtttgttactatttgtaaaacttgtgaaacttggaataagctaagaataaagtaagaaaaaattcggaagtaacttttatcttttgctcattcgcgtaattataagctttgaattgagc

SEQ ID NO: 3197 - DNA, 1563 bp, Castanea mollissima
ttttggggtttcagaaacctaatcttatcgcagctctccacgatgacagttttctcttccacaaagcaagatgatcgtgaccaaaatccaaggacctcttattttaattcaccaccgttggatatctctgttgcgttcccacaagcaactccagcttccattttccctccttgcaagtcagactattatcaacttgatgatctattgagtcctgaggagcagactgtgaggaagaaagtaagagagtgtatggaaaaagaaatagccccaataatgacacagtattgggagaaggccaagtttccctttcatgttattccaaaacttggtgccttgcgtattactggtggcacaatcaagggttatgggtgtcctggtcactccattactggaagcgctgttgctacagcagaagttgctagagttgatgcaagctgctctactttcatactggtgcattcatctctggcaatgctcactattgcattgtgtggatcggaggcacagaaacaaaaatatctaccttctttggcagagttaaaaactgtagcgtgttgggctttgaccgagcctgaatatggaagtgatgctagtgcattgaaaacgatagcaacaaaggtggaaggaggttggatacttgagggccaaaagcgctggattggaaacagtacctttgcggatttgttggttatttttgcaaggaacaccacaacaaatcagataaatggatttatagtaaagaaggatgcgcctggattaacagtatcaaagatagaaaacaaaattggcctacggattgttcaaaatggagatattctcttaaagaaagtttttattcctgacgaggacaggatacctggtgtcgattcttttcaggatacaaacaagattcttgcagtttcacgtgttatggttgcctggcaaccaattggcatatcaatgggcatctatgatatgtgtcacagatatctgaaggagaggaaacagtttggagcaccactagcagctttccaaatcaatcaactgaaacttgttcagatgctcggtaatgttcaagcaatgattcttgttggttggcgactttgcaagttgtatgagaatggtaaaatgactccaggtcaagcaagcttgggaaagtcatggatcaccttgaaggcaagagaaactgctgcaattgggcgggagttacttggtggtaatggaattttggctgattttctagttgcaaaggcattctgcgatttggagccgatctacacgtatgaaggcacctatgacatcaacagcttggtaacaggtagggaagtcactggcattgctagcttcaagccagctgtatcgagccgaagaagccgtctctagaaatgtatactttcttcctcaaccctctggttggaaacttattgtcccttctcttattgtgttagctgtgctgcttgaggcaatgtttccaatgagaaaaagtcttgatgcccataataattgaataacgtatacaaatggtgtatagaatatgttgatggaaatgaaataaaatgcaaaattttcttttggctttaaaaa

SEQ ID NO: 3198 - DNA, 1730 bp, Populus trichocarpa
atgaaggacgtgtcgtatcctgctatcattattacaagaacattatctacaatatcctcatcagataatgccactgaatcgtccttgtttcggagattaaaagctttgcgtgtcaatgccactctctccgcccataagatcataagttttaaaaaattaaatcccccaaccgtctttctcctctattttccagccatggcaatccctaaaaatcaagatgaggttgagcaaaatgcaaggagttcttattttaatttaccgccgttggatgtttccgtcgccttccctcaagcaactcccgcttccacatttcctcctagcgtgtcggattactttcaaattagtgatttattaaccgcggaggatcaggccatcaggatgagagtgaggcagtgtatggaaaaggaaatcgctccgataatggctgagtactgggagaaggcgaagtttccgtttcatgttattccgaagcttggtgccttgggtatagctggaggaacgataaagggttatgggtgtcctggtctctcgatcactacaagtgctgtcgccattgcagaagttgctagagttgatgcaagctgctcgacttttattttggtgcattcatctctggcaatgctcaccatagctctttgtggttcggaggaacagaagcagaaatatttaccttcattggcaaagtttagcactgtagcttgttgggctttgactgagcctgactatggaagtgatgcaagttctctgcaaacaacagcaaccaaggttgaaggtggttggatacttgagggccaaaaacgctggataggaaacagtacttttgctgatttacttgttatatttgctcggaataccacaactgatcagattaatggatatatagtgaagaaggatgctcctggattaacagttacaaaaattgaaaataaaattggcctccgtatagtacaaaatggagatatagtcatgaaaagagtttttgttcctgatgaggacaggttgcctggagtcaactcgtttcaagatacaaataaggttcttgctgtttcacgtgtaatggttgcctggcaacctattggcatatcaatgggggtctatgacatgtgtcacaggtatctaaaggaaaggaaacaatttggagccccattggcagccttccaaatcaatcaacagaaacttgtccacatgcttggtaatgtccaagcaatggtactagttggttggcgcctttgcaagttgtatgaaaagggaacaatgaccccaggtcatgccagcttggcaaagtcatggatcagtttgaaggcaagggaaactgctgctattgggagggagttacttggtggcaatggaattttgtctgactttctagttgccaaggcaatgggtgatttagaacccatctacacatatgaaggcacatatgacatcaacagcttggtaacaggcagagaaatcactggtcttgccagttttaagcctgcaatgttgagcaagcgaagtcgcctgtaacagtataaactttcccatgacatccacgtgtgtgctctttcttttctgcaagttgggaaattacttgacaatctcataagggaagattacaaaataaattcgggacacaatggcttgagagttgtgaaataaaaggttacttctcgacttcaacagtcttctctttatgcttgtacgttttaggcattactaattaggtggcccttgcgcggttttgaaaa

SEQ ID NO: 3199 - DNA, 1589 bp, Raphanus sativus
  misc_feature (107)..(107): n is a, c, g, or t
  misc_feature (140)..(140): n is a, c, g, or t
  misc_feature (543)..(543): n is a, c, g, or t
  misc_feature (856)..(856): n is a, c, g, or t
  misc_feature (888)..(888): n is a, c, g, or t
  misc_feature (984)..(984): n is a, c, g, or t
gcatttcattcaatctcatagcatcggttttcgttcctatcacgaagccagagaagctttccatcaacgatcatcgccatgactgtgctctcatctgcagatcgagntaatggtgagaagaaggtgaagagttcgtattntgatttgccgtctatggaaatatcagtagcgtttcctcaagcaaccccagcctctaagttcccaccctgcacttcagactattatcatttcgatgatctattgactccggaggaacaggctgttcggaagagggtgagagagttcatggagaaagaagttgctcccattatgactcagtactgggagaaggcagagtttcctttccatatcattccaaagtttggagctttgggtgttgctggtggctccatcaagggttatggctgtcctggcctctccatcacagcgaacgctattgcaactgcagaaatatctagagttgatgcaagctgtgggacttttaatttggtgcatacctctttgggcatgctcactattgcactttgtggatcagaagcacanaagcagaaatatttgcctgatttggctcagatgaaaactgtgacttgttgggccttgacagaacctgacaatggaagcgatgcaagtgctctaaaaacaactgccacaaaggttgaaggaggttgggtacttgagggacaaaagcgttggattggaaacagcacctttgcagatcttttggtcatccttgctaggaatacgacaacaaaccaagtcaacggattcttagtccagaaagatgcgcctggcctaacggttactaagatcccgaataaaataggtttacgtattgttcagaatggagacattctantacagaatgtctttgttccggatgaggagcgnttacctggggtaaattcatttcaggacacaagcaaggtcctggctgtctcacgtgtaatggtggcctggcaaccaattggtatatcaatgggagtntacgatatgtgtcacaggtatctaaaggagaggaaacagtttggagcaccgttggctgctttccagataaaccaacagaagcttgtgaagatgctgggcaatgttcaagcgatgtttatgatgggttggcgcctctgcaagctatatgagacgggtcagatgactccaggtcaagccagtttaggaaaggcatggattacatccaaggcaagggaaactgcttcgctaggtcgggaattactcggtgggaatggagttttaggggattttctggtggcaaaggctttcggtgaccttgaacccattttcacatacgaagggacgtacgacataaacaccttagtgacggggagggaagttaccgggattgcgagtttcaaaccgccagcttcacggggccgtagccgtctttaaggttgtgcagtgtttgttgctgttggctgctaattatatttacctggagtacaaagtgcgccagataatattggcataaagggacatattgcaataatgggcccgtgctctgtaaggcatgtagggtgggaatattcctttcgtaaacatttaatgaattcaagtatgaaatgataaattacttttcgtta

SEQ ID NO: 3200 - DNA, 1747 bp, Ceratodon purpureus
gtttgcgaattttgcacgcttgcggagcttcacagacgctccgtttcctgcccaattgcgggaccattagattattgtcgaagctgccgagatcggccttgttgacgagtacagaaagtatggagcgatcggtgggaagtgaggtcatggagcaaaaaagccagcgaaggttggcacgcattcacggccatttggagcctgcagaaactgatttctcttctcaattggaaagcgtaccaactcttgcaattgggcttcctcctttggatgttcgatctgcatttccacaggcgactccggcatcagagtttccaccgtctgtgtcggacttttttcagcttgatgacttgttgtcatctgaggatgttgcacttcgtgagcgcatacggagtgtcatggagaagcatgttgcacccgttatgaccaagtattgggagaaggccgaatttccattcgaatgtctgccccatatttccagcctgatggttgctggtggcacgactaaggggtatggttgcccagggttgtccgtcttgagtagtgcgttggccatgtcagaaatagcacgagtggatgcaagctgctctacttttgtgcttgtgcactccagcttgggcatggctactattgctatgttgggaagtgaggcacagaaacacaagtacttgcctggccttgcacgcttcgaccttgtcggctgttgggcattgacagagcctggatatggaagtgatgcgagctcactgaacactactgccaagaaggtagaaggtggttggcttttgaatgggcagaagcggtggatcggaaatgcaacatttgcagatattgccgttgtgtttgcgcggaacacacagaccaaccaaataaatgggtttatcgtgaagaaaggttcacctgggtacagagctacaaagattgagaacaagatcgggttgaggatggtgcaaaatggtgacataaccatgaatgatgtgtttgtacctgacgaggaccgtctgcctggaattaactcgttcaaagataccagcaaggttctggctgtatctcggatcatggttgcatggcagccaattggcatcgccatgggcgtatacgacatgtgccataggtatctactagagaggaagcagttcggagctcccttggctgcccttcagatcaatcaagaaaaacttgtgcgaatgttgggtaacattcaggcgatgtttctactgggttggcgtctttgcaaaatctacgaagctggcaagatgactcctggccaagccagtctctgcaagtcttggaacacaaagcgagctcgggagacggtggcattagggagggagcttctaggcggcaacggaatacttgcagacttccttgttgccaaggctttctgtgatctggagccaatctacacctacgaaggcacatacgaaatcaacgctctagtaacaggccgtgaaattacaggaatagccagcatcaagccaagcggaggaaagcccaaaactctttccacctcggaaggagttgtccgcaacaccacgaaaaactgagtcacctgcatcatccaacaccaacaaatccaactaaaccaacaatagctgcactcaattcattccatagcctagacttagacatcttttctgaaacacctcatagctgcaaatcactacacactttgtagatcaacttgtagctccacaataagtactcatgtattcacccatctcatactgaaaaatccattttcaccatc

SEQ ID NO: 3201 - DNA, 1646 bp, Centaurea maculosa
  misc_feature (23)..(23): n is a, c, g, or t
  misc_feature (280)..(280): n is a, c, g, or t
  misc_feature (1087)..(1087): n is a, c, g, or t
  misc_feature (1162)..(1162): n is a, c, g, or t
  misc_feature (1243)..(1243): n is a, c, g, or t
  misc_feature (1318)..(1318): n is a, c, g, or t
  misc_feature (1479)..(1479): n is a, c, g, or t
  misc_feature (1509)..(1509): n is a, c, g, or t
  misc_feature (1528)..(1529): n is a, c, g, or t
gggatatgatatgatatagatanaaaaccaatattttgggttctctctctctatctctctcgaaaatattcattcggatccaagctctgaagtcaatcccagaatcaccatgacaattcactcatcaaaacctcaagatgatcagaacaaggattcaaagagctcgtattttaaccttccagcactggatgtctcgattgcatttcctcaagcaacaccagcttcgatctttccaccttgcacctcagactactatcacttcaatgacctactgaccccngcggagcaagctctaagactgcgagtaagagagtgcgtcgagaaagacgttgctccaataatgaccaagtactgggagaaggctgaatttccatttgaaattgttccaaagctaggtgctctgaatatagctggtggaaccatcaagggttatgggtgtccaggtctgtccgtcactgcaaatgcgatagttacggcagaaatagccagagttgatgcaagctgctctactttcattttagtccattcttctttggcaatgctcactatatctctatgcgggtcagaactacaaaaacagaagtatctgccatcactggccaaactagataccatagcttgttggggtttgactgaacctgactatggaagtgatgcaagcagcgttagaacaacagcaacaaaagtggatggaggatgggtccttgaaggccaaaaacgatggattggaaacagtacttttgcagatattttggttatttttgctaaaaacaaagagacaaaccagataaatggattcattgtaaagaagaatgcacctgggttgcaagctaccaagatagaaaataaaattgggctcagaatggttcagaatggagatattctgctacagaaagtttttgttcctgatgaagacaggttacctggggtgaactctttccaagatacaagcaaagtgcttgcggtttctcgtgtgatggttgcctggcaacctattggcatcacaatgggtgtctacgatatgtgtcacagatacttactagagagaaagcagtttggagccccattggcagctttccaaatcaancagcagaggctagtgcaaatgttgagcaacatccaagcaatgtttctcatgggttggcgcctttgcaagttgtangaggctggtaaaatgactcctggtcaagccagcttgggcaagtcatggatcacgctgagggctagggagaccgttgcactnggccgagagttacttggtgggaatggaatactatccgactttttagtcgcaaaggcatttggagatttggagccnatttacacatacgaaggaacatatgacattaacacgttggtgacgggtagggagatcacaggtatcgccagtttcaaacctgttataaagaagcctcaaatgagtcgcttgtaagcactttccctatcgaggaaatgaaattgtgtgtgtatgttatgttnaagatagtaataacttatgaaataaagaanaaacatacattttccattnntgttatatgcctgttacttgtcaaaatctagggggttgtacctaaattacctatgataccaattacaaaggtacatgtttcctgcctgctataacaaaaatgtaattatgtcgcggc

SEQ ID NO: 3202 - DNA, 1493 bp, Cephalotaxus harringtonia
cagatgcatttcctcaggctacttcagcctccaaattcccgccttgcgtatctgattattatcaattagatgatcttctcactcctgaagagaaatctattcgtaagaaagttagggaagctgtagaagctgaaattgcccctataattgcaaagtattgggaacgagcagaatttccatttgaggttgtgcctaagcttgcgaatcttaagctggctggaggtaccattaagggatatggttgccctggtctatctgttgttagtagtgctctttccatggctgagattgcgagggtagatgccagctgttctacatttattatggtgcattcttgcttagcaatgctcacaatttcaatgtgtggaaatgagcatcaaaagaaaaaatacttgccttctttggctcaactcgacaccatatcttgctgggctttgactgaaccaagctatggcagtgatgcaagctctttgagcacaactgcaactaaggtagagggtggctggaagttggatggccaaaaacgctggataggaaacagtacctttgcagacatactggttgtttttgctaggaacacaactacaaatcaaatcaatgggtttattgttaagaaagggactcctggattgaaagtaacaaaaatagaaaataaaattgggctgagaattgttcagaatggggatattcttatgaagggagtttttgttcccgatgaggataggttgacaggcatcaattctttccaagatacaaacaaggttcttgctgtatcccgtataatggtttcatggcagcccatagggattgcaatgggtgtgtatgatatgtgtcacaggtatttacaagagcgtaaacaatttggagcatctttgagttcttttcaaatcaaccaagaaaaacttgttcgtatgctggggaacattcaggcaatgtccctgatgggatggcgtctctgcaagttatatgaaagtgggaaaatgactccagggcatgccagcttagcaaaggcttggaacaccttacgtgcacgggagacagtttcgttaggacgagaactgcttggtggaaatggaatcttgtcagacttcctagtggctaaggcattttgtgatttggagcctatatactcatacgaaggaacgtatgatataaatgcactggtaacagggcgtgaagttactggaactgcaagttttaaagcaccacctgttagtagaggaataagagcaaagttatgatgcagatattctttcttacgtgagttccttactggcattgctgaaaatctggagggtttctaatttaccgtgtataactttcgaagggtagtagcatcaaatacattttgtgcgagtcattgtggcatgtttatgattgaactaggcctcctgagatagctctgaaatgaattgtgcttcaataatcttcatgcccttgttagcaaacgatatgacaataatttcataacttttagtaaaattgttcataaa

SEQ ID NO: 3203 - DNA, 1271 bp, Sciadopitys verticillata
ggaagttgtagaagctgaaattgcccctataatggcaaagtaattgggaggcgagcagagtttccatttgaaattgttccaaagcttgcaaatcttaagctagctggaggtaccattaagggttatggttgccctggtttatctgttactggcagtgctctttctatggctgagattgcgagggtagatgccagctgttctacatttataatggtgcatagttgcttagcaatgcttacaatttcaatgtgtggaagtgagcatcaaaagaaaaatacttaccttctttggctcgacttgataccatatcttgctgggctttgactgaaccaaactatggcagtgatgcaagctctttgagcacgactgcaactaaggtagaaggtggctggaagttagatggccaaaaacgctggataggaaacagtacttttgcagatatacttgttgtttttgccaggaacactagcacaaatcaaatcaatggatttattgttaagaaagggacacccggattgaaagtaacaaaaatagaaataaattgggctgagaattgttcagaatggggatattcttatgaagggagtttttgtacctgacgaggataagttgacaggcatcaattcttttcaagatacaagcaaggtgcttgctgtatcccgtataatggttgcttggcagcccatagggatttcaatgggtgtttatgatatgtgtcacaggtatttacgagagcgaaaacagtttggagtatcattgagttctttccaaatcaaccaagaaaaacttgttcgtatgctgggaaacattcaggcaatggccttgatgggatggcgtctctgcaagttgtatgaaagtggaaaaatgacaccagggcatgctagcttagcaaaggcatggaacaccttacgtgcaagggagacagtttctttaggacgagaattacttggtggcaatggaatcttgtcagacttcctggtggcgaaggcatttggtgacttggagcctatatactcatatgaaggaacatatgatgtcaatgtattggtaacagggcgtgaagtaactggaactgcaagttttaaagcaccacctgttagtagaggaataaaagcaaaactataatgcagattttcattcttgtattagttccttatatgcattgttgaaaatctggaagatgtttttttatatcataaatagcctttgggtttcagatttgagaatttgagaagggaaatgcggcttacctaagaaatcctagcagcaaa

SEQ ID NO: 3204 - DNA, 781 bp, Thalictrum flavum
ttacaaaaagtatttgtccctgacgaggataggttacctggtgtcaattcgttccaggatacaagcaaggtacttgctgtttcacgtgtcatggttgcatggcaaccaattggcatttcaatgggtgtctatgatatgtgtctcaggtatttgaaagagaggaaacagtttggagttccactggcagcatttcaaatcaaccaagagaaacttgtccgcatgttaggaaatgtccaagcaatgtttcttgttggatggcgcctttgcaagctgtatgagtcaggaaagatgaccctggccatgctagcatggggaaggcatggattaccttgagagcaagagagactgtttcccttgggcgagagttacttggtggcaacggaatttttggcagatttcttagttgcaaaggcattctgcgacttggagcccatattcacgtacgaaggtacatatgatattaacagcttggtgacaggaagagaagtcacaggtgttgccgccttcaaaccggctgctctgaagcaacacagccgaatgtaattattgttctctttgtttgtaaacacgttcatctctttccttggaagatggatttgtacgatgatggaaaataaagaacacaaggtatctactaaggccacctcaatttgtatggaaagcatcaaacttaattcaggtgaaataatcagttgatccatgtatgtatattatgttgtcagaaaacaaattctgtacaaaataagaattagatcgaaggtgtttttagtgatttacaaaa

SEQ ID NO: 3205 - DNA, 1613 bp, Brassica rapa
ggcatcgattttcgttcctatcacgaagccaaagaagctttccatatcgccatgactgtgctctcatctgcagatcgtgataatgctgagaagaaggtgaagagttcgtattttgatttgccgcctatggagatatctgcagcgtttcctcaagcaacaccagcctctaagtttccaccgtgcacttcagattattataatttcaatgatctattgactccggaggaacaggctgttcggaagagggtgagagagttcatggagaaagaagtggctcccataatgactgagtactgggagaaggcagagtttcctttccatatcattccaaagtttggagctttgggtgttgctggtggctccatcaagggttatggctgtcctggcctctccatcacagccaatgctattgctacagcggaaatatctagagttgatgcaagctgtgggacttttaatttggtgcatacctctttgggcatgcttactattgctctttgtggatcagaagcacagaagcagaaatatttgcctgatttggctcagatgaaaactgtgacttgttgggctttgacagaacctgacaatggaagcgatgcaagtgctctaacaacaactgccacaaaggtggaaggaggttgggtgcttgagggacaaaagcgttggattggaaacagcacttttgcagatcttttggtcatccttgctaggaatacgacaacgaaccaagtcaacggatttttagtccagaaagatgcgcctggcctaacggttacgaagatcccaaataaaataggtttacgtattgttcagaatggagacattctactaaagaatgtctttgttccggatgaggagcggttacctggggtaaattcatttcaggacacaagcaaggtcctggctgtctcacgtgtaatggtggcctggcaaccaattggtatatcaatgggagtctacgatatgtgtcacaggtatctaatggagaggaaacagtttggagcaccgttggctgcattccagttaaaccaacagaagcttgtgaagatgctgggcaatgttcaagcaatgtttatgatgggttggcgcctctgcaagctatatgagtcgggtcagatgactccaggtcaagccagtttaggaaaggcatggatttcatccaaggcaagggaaactgcttcgctaggtcgggagttactcggtgggaatggagttgtaggggattttctggtggcaaaggctttcggtgaccttgaacccatttttacatacgaagggacgtacgacataaacaccttagtgacggggagggaagttaccgggattgcgagtttcaaacccccagcttcacggggccgtagccgtctttaagattgtgcagtgtttgttgttgttggcagttagttactttggtaaaatgtaatgtgtgagctttacatttacctggagacactaagtgcgccaaataatattggcataaagggacatatgcaaccattgtattgcaataaaggatccgtgctgtatacggcatctagtttggtgggaataatccttccataaacattttgtgagtttagttcaaggatgaaataataaattacttttagtta

SEQ ID NO: 3206 - DNA, 1720 bp, Brassica napus
acttggtacgcctgcaggtaccggctcgcgaattcccgactcgacccacgcgtccgattgatgtatcatttcattctatctcattgtatcgattttcgttcctatcacgatcatcgccatgactgtgctctcatctgcagatcgtgataatgctgagaagaaggtgaagagttcgtattttgatttgccagctatggagatatctgtagcgtttcctcaagcaacaccagcctctaagttcccaccgtgcacttcagactattaccatttcgatgatctattgactccggaggaacaggctgttcggaagagggtgagagagttcatggagaaagaagttgctcccataatgactgagtactgggagaaagcagagtttcctttccatatcattccaaagtttggagctttaggtgttgctggtggctccatcaagggttatggatgtcctggcctctccatcacagccaatgctattgctacagcggaaatatctagagttgatgcaagctgtgggacttttaatttggtgcatacctctttgggcatgctcactattgctctttgtggatcagaagcacagaagcagaaatatttgcctgatttggctcagatgaaaactgtgacttgttgggctttgacagaacctgacaatggaagcgatgcaagtgctctgacaacaactgccacaaaggtggaaggaggttgggtgcttgagggacaaaagcgttggattggaaacagcacctttgcagatcttttggtcatcattgctaggaatacgacaacgaaccaagtcaacggattcttagtccagaaagatgcgcctggcctaacggttactaaaatcccgaataaaataggtttacgtattgttcagaatggagacattctactaaagaatgtctttgttccggatgaggagcggttacctggggtaaattcatttcaggacacaagcaaggtcctggctgtctcacgtgtaatggtggcctggcaaccaattggtatatcaatgggagtctacgatatgtgtcacaggtatctaatggagaggaaacaatttggagcaccgttggctgctttccagttaaaccaacagaagcttgtgaagatgctgggcaatgttcaagccatgtttatgatgggttggcgcctctgcaagctatatgagtcgggtcagatgactccaggtcaagccagtttaggaaaggcatggatttcatccaaggcaagggaaactgcttcgctaggtcgggaactacttggtgggaatggagttgtaggggattttctggtggcaaaggctttcggtgaccttgaacccatttttacatacgaagggacgtacgacataaacaccttagtgacggggagggaagttaccgggattgcgagtttcaaacccccagcttcacggggccgtagccgtctttaaggttgtgcagtgtttgttgttgttggctgttagttgctttggtaaaatgtaatgtgtgagctttacatttacctggagacactaagtgcgccaattaatattggcataaagggacatatgcaaccattgtattgcaataaaggatccgtgctgtgtatggcatgtagtttggtgggaataatccttccgtaaaacatttaatgagttcaaggatgatataataaattacttttagttatttgtgtttttggttgccaacattgaacaagtgcttggcagtac

SEQ ID NO: 3207 - DNA, 1579 bp, Brassica napus
gggcatcgattttcgttcctatcacgaagccaaagaagctttccatatcgccatgactgtgctctcatctgcagatcgtgataatgctgagaagaaggtgaagagttcgtattttgatttgcctcctatggagatatctgcagcgtttcctcaagcaacaccagcctctaagtttccaccgtgcacttcagactattataatttcaatgatctattgactccggaggaacaggctgttcggaagagggtgagagagttcatggagaaagaagtggctcccataatgactgagtactgggagaaggcggagtttcctttccatatcattccaaagtttggagctttgggtgttgctggtggctccatcaagggttatggctgtcctggcctctccatcacagccaatgctattgctacagccgaaatatctagagttgatgcaagttgtgggacttttaatttggtgcatacctctttgggcatgcttactattgctctttgtggatcagaagcacagaagcagaaatatttgcctgatttggctcagatgaaaactgtgacttgttgggctttgacagaacctgacaatggaagcgatgcaagtgctctaacaacaactgccacaaaggtggaaggaggttgggtgcttgagggacaaaagcgttggattggaaacagcacttttgcagatcttttggtcatccttgctaggaatacgacaacgaaccaagtgaacggatttttagtccagaaagatgcgcctggcctaacggttactaagatcccgaataaaataggtttacgtattgttcagaatggagacattctactaaagaatgtctttgttccggatgaggagcggttacctggggtaaattcatttcaggacacaagcaaggtcctggctgtctcacgtgtaatggtggcctggcaaccaattggtatatcaatgggagtctacgatatgtgtcacaggtatctaatggagaggaaacagtttggagcaccgttggctgctttccagttaaaccaacagaagcttgtgaagatgctgggcaatgttcaagcaatgtttatgatgggttggcgcctctgcaagctatatgagtcgggtcagatgactccaggtcaagccagtttaggaaaggcatggatctcatccaaggcaagggaaactgcttctttaggtcgggagttacttggtgggaatggagttgtaggggattttctggtggcaaaggctttcggtgaccttgaacccatttttacatacgaagggacgtacgacataaacaccttagtgacggggagggaagttaccgggattgcgagtttcaaacccccagcttcacggggccgtagccgtctttaaggttgtgcagtgtttgttgttgttggctgttagttactttggtaaaatgtaatgtgtgagctttacatttacctggagacactaaatgcgccaaataatattggcataaagggacatatgcaaccattgtattgcaataaaggatccgtgttgtgtacggcattttagtttggtgggaataatccttccgtgaacatttaatgagtt

SEQ ID NO: 3208 - DNA, 811 bp, Solanum tuberosum
attgcaatgtattaaattaggaaaccaaaattggatacggattgtttcaaaaggagacattctcttaaagagtttttgtccctgatgaggatagactacctggggtcaattcattccaggatacaaacaaggtgcttgctgtatcgcgtgttatggttgcatggcagcctattggcattacaatgggtgtttatgatatgtgtcacaggtacttgaaggagaggaagcagtttggagcaccattagccgctttccagatcaaccaacagaaattggtccaaatgttgagcaacattcaagcaatgattcttgttggttggcggctttgcaaactacacgagagtgataaactgactcatggtcatgcaagtttagggaaatcatggattacgttgagggcaagagagactgttgctctcggacgcgaactactaggtggcaacggaatcttggctgactttcacgtcgcaaaggcattttgcgatttggagccgatctatacatttgaaggtacatacgatatcaacacgttggtaacaggtagagaaattactggtttggccagtttcaagcctgcaccagtaaggcaaaagagtcgcctgtgaaaaatttcatcttctctgtgttttaagtattctgctgaataatgttctgtttaggcaattgtaaatctacaatgcttttacccaaaggaagtactttaagaattgaagttcctttttttcaaaaaaattaaaattgtatctaataattgattagttagactatcacctattgtaataaaaaattagcatcaaaaaaaaaaaaaaaa

SEQ ID NO: 3209 - DNA, 783 bp, Capsicum annuum
gcacgagggatggttcataatggagatatcttccttaagaaagtgtttgttcctgatgaggatagattacctggtgtcaattctttcaaggacacaaacaaggtgcttgctgtatcacgtgtcatggttacatggatgcctataggcattgcaatgggtgtatatgatatgtgtcacaggtacttaaaagagaggatgcagttcggagctccattggctgctttccaaataaatcaacagaagctggttcagatgttgagcaacattcaggctatgcttcttgttggttggcgtctttgcaagttatacgagagtggtaaaatgactcccggtcaggctagcttgggaaaatcatggaataccttgagagctagagagaccgtttctcttggacgggaattacttggtggtaacggtatcttgtccgacttcctagtggcaaaggcgttctgtgacttggagcccatctatacgttcgagggtacgtatgacatcaacacactagttacaggtagagaaattacaggtcttcctagcttcaagccagcaacattgaggccaaacagtcgtctgtagtgcttaaatcatattcccgttctctggaaatcgttctgctgaattcagtgcgatactatccgggaaaaagggtactcacccaatgattatgtaatgatcataatcataaagaagtctattgtaatgaagcaaacattgtatatttgaactagttcgttactacgtctcgtttatctttctgattttatataaattttattatccggg

SEQ ID NO: 3210 - DNA, 2885 bp, Medicago truncatula
ggaagatatatacgacatgagtgttgcgtagccattttctttttcttcccatcattgttttctgcataatcaacattttcacacttcccaacacaaaccaacccaatcgcttcatttcaccttccttcttcttcctccaccatgactcgttccaatccacaagataaaattggaaacatgccttcatattttgatttgccaccacttgatgtttctcttgcatttccacaagcaactccagcatctacttttcctccttgtgcttcagattattttcaattcgatgacttgttgaaaccggaggagcaggccattaggatgaaagtgagagagtgtatggaaaaaaatattgctcccataatgacccagtattgggagaaagccgaattcccatttcatgctattccaaagcttggtgaactgggtatcgctggtggcacaatcaagggttatggttgtcctggtctttccgtaactggaagtgctattgctacagcagaagttgctagagttgatgcaagttgttcaactttcattttggtccattcatccttggcaatgctcactatagcattgtgtgggtctgaagctcagaagcaaaagtatctaccgtcgttggcacagctaaaaactatagcatgttgggccttgactgaacctgactatggaagtgatgcaagtgctttgaagaccacagcaactaaagtggaaggtggttggatccttgagggccaaaagcggtggataggaaacagtacatttgctgatttgttggttatcttcgcaaggaatacctcaacaaatcaaataaacgggtatatcgtaaaaaaggatgcacctggtttaactgtcacaaaaatagaaaataaaattggacttagaatcgtacaaaatggagacattgttatgaggaaagtttttgtccctgatgaggacagaatagaaggagtcaattcttttcaggatacaaacaaggtacttgctgtttcgcgtgtgatggttgcttggcaacctattggtatatcaatgggcatctatgatatgtgtcacaggtacctaaaggagaggaaacaatttggagcaccattagcagctttccaaatcaaccaacagaaacttgttcaaatgctcagtaacgttcaagcgatgattcttgttggttggcgtctatgcaagttgtatgaaagtggtaaaatgaccccaggtcatgctagcttgggaaagtcatggatcaccttgagggcaagagaaacagctgctttggggcgagaattgcttggtggcaatggaattttggctgattttctagtggctaaggcattctgtgacttagaacctatctacacctacgaaggcacgtatgaaatcaatactttggtcacaggaagagaagttactggttttgccagctttaagccagctactcaaagaagtagaatgtgaaagtgtaaaagtgttcctctacagacactattgtattccattggttcatatttttgtaattaataagtactggtaaaacagaagcattcaataaaatgttgagtagattacaatgcagtgaaataaaaataatttttattgcatattcttgaagtctacatctcctcttttccttttcttggtgaatgctatgaagaacaagctgctttatcacctgttttccactttatataatctcttcactttcaatgtgtgagatttctgcattctcttgccctctctgagtgaagaatgaaccttgtgttgaggaaagtataaaaattacacctgttatgatgcaaaattgcaaatgtccaagtgcatgggaaattgaaaatgtgatttttttttttaaggttccacatcttatgcatctaagttattcttcactcacaaacatgtcttaatatcacaagaaaaaaaatctactatggtaaatataatatataatatatataatataataataacaataataagtaattaaatcagaggcagctatttgagtacagatcctggtctggctgtcactctttgtcatattgtagcttccagatgaaggatgcattgcatggcctgatcttgctcatcaaggaaacatcattagggatagaaaacctgaatgaacactaatcaatgcacatcatcactgctaaaccctatgtattacagaaggaaaaccaaaccaccttaaatttcccatgattcattcacccttggttttccctctgagcatccttatcaaaacccaaagacctaaccttgagctgaagctcagcaacagcaacaaaaaagttgagaacctgagctggtttcagtatctgcacaactctcaaagctgtctcagtcctcaaagcatcagcatttgtcaccaaattctccaatgtttccttgaatgaactagaaactgtaccctcttctgccatgaatgacctactcaaacacactcttccatggcttctaacattgtcaagaaccggtggcgccgccatactctcatgaaccttagccaattcatcatttagttctctctccttcatcttaatctcttgtttgagctcactcaacctctgcctctgatcctctgacaaatcctctaaagttttgtttacaagatgaaatgttaaccctggtttgaaccctgccacccagagaaaagatttttccaatgaactgaaccatggtggtgagaaaagaagaagaatattttgatgggctatctttgatttctcttcatagtattgtccatagtggcagagtactctgtttaacaaattcaacctatcagaatcagccaactcttgaggctgttgttgagctgagagaagatcattgaggtagtttctttgacgaatcatccatcctggagaaattcatcaaatgcagcaacatttacatcagtc

SEQ ID NO: 3211 - DNA, 1594 bp, Triticum aestivum
  misc_feature (381)..(381): n is a, c, g, or t
agcgtggtcgcggccgaggtaaacagattcagcctccatcgttacagagcattcaaatttaccgctacatcgttgcatgcgaattattcctcgtgaccaaaacagtggagcattttttatagcagtccttcagaaactctctccgctgaatgagagtctggtggtagaagtgatgaaaggtgagcgcagtacctcgaaagacaaggctttgaaatgttcgaatggtcagggatcagatacggtgccggctgaagaaatttcagttcagcagccaggggttgatgacacccatgttcttgttgagcaacaaaacagagacatggatactgaaatttcaaaagataaaagttctgaggaagctaaggtggttgctggtgaggngcaaaatgatcaagcgacaaggagagataaaagaaagacccagaaccaaggcagatggagaggggttgatcctgtgatatttttcaaagacgaagcgacaatcagaagcatagtgtctttctacggcatcaaggattcatttacccttgaaggccatcttgtgactaggaatcctgatactaatcatgttaaaagaatatactacgtctcaaaatcagttaaagaagttttggacctcaatttgaaagttggtgagcggctgaaaatcacttcacttggcttaaagatatttgaaaggcagtcgtcaaaggagggttcaccatgcacatttaggttgtcatccgagggattgcctctgctgcttccttacatcaccaaacagattctatatgcatctgcaatagactttcagcacctcttacaatacagaatcattaaattccctgattttgtggatgtaaaattcggtgagcaagcttcagctttgctacaaggttgctgtgtcgtaatattacgcgaagggcatgaggatctagagtccataggcatggatccctctgcaatcgccgttgtttgttggaaaggaaagaccaatctgtgcgtcatggtcactcccatggatgggagggagctgcttgaaaggatctcatttcgtttcgggctcaaaatcccaaaacttgatgatgggaagcctgacctgaagtgtgatgatggatcagatgagcagcccgatggtggcgccgagacggttgatccagattgtgtgcctgagagtaaagcatcagaagacatggatatctcagacgtcaaggacacggagtagctcggtttgacgccaatgcaaggaggcatgttatatctcgttacgatgatgcagcagagaccgctacttggcttacgagttgatgattactctaatgggagtgttgttgccatcccttggttcttcatgtagggattctatcctattgatttgccatgaaaaccacaccgcatacatggtgctagactgctaccccgctgcccccctgtaacgttctaccagtttgtttttggtgtgatgttggcacacaactgtcaaacggaacttcgaacatgagtgccgacaattctaatttgtttgagacattttgatcctgtgatggaagtgcatgggttagtcattccggtgatggtaggagaaactgtgccgtatccggaatgtttaatttca

SEQ ID NO: 3212 - DNA, 1840 bp, Triticum aestivum
tcaccttcaccgtcggcgggctcagcgccatcaacgccgtcgccggcgccttcagcgagaacctccccgtcatctgcatcgtcgggggccccaacagcaacgactacggcagcaaccggatcctccaccacaccatcggcatccccgatttcacgcaggaactccgctgcttccagaacgtcacctgttatcaggctgtggtgaacaacttggaggatgcacatgaacagattgacactgccatttccactgcactgaaggagagcaagcctgtttacatcagcatcagctgcaacctcccatcgatcccgcatcctacctttagccgccatcctgtccctttctttctctccccaaaactgtcaaaccagatgaccttggaagcagcagtggagaccgctgcggcttttctgaacaaatcagtcaagccggttcttgttggcggaccaaagatgagggtggccaaagcatgcgaggccttcgtagagctggctgatgcatgcggttatccggttgcagtgatgccttctgcaaaggggcttgtgccagagcaccattctagatttatcggcacatactggggtgctgtgagcactccattctgcgctgagattgtggagtcagctgatgcctatttgtttgctggcccgatatttaatgactacagctcggttgggtactcgcttcttctcaagaaggagaaggccatcattgtccagccggaccgagtcgtgattgggaatgggcctgcatttgggtgtgttctgatgaaggacttcctgcatgcacttgcaacccggctgaagaagaacacagctgcctacgacaactacagtcggatttttgtgcctcagggcgaacccctttcctctgagcctggagagcctttgagagtgaatatactttttaagcatattcagaaaatgttgtctggcagctcagctgttatagcagagactggggactcatggtttaactgtcagaagctgaaactaccagaaggctgtgggtatgaatttcagatgcaatatggatcaattggttggtctgtgggtgcaactctgggatatgcgcaggctgctaaggataagcgagtcatttccttcattggagatggcagctttcaggtgacggcacaagaagtgtcgacgatgctccggtgggaacagaacaacatcatctttctcataaacaacgggggttacaccattgaggtggagatccatgacggcccttacaacatcatcaagaactggaactacaccggcgtggtggaagcattccataatggcgagggcaagtgctatacggccaaggtccgaacagaggaggaactgaagaaggcaattgaggcatccctaggacccaacaaggacagcctgtgctttatagaggtaattgtgcacaaggatgacactagtaaagagcttcttgagtggggttctagggtttctgccgcgaatagccggccaccaaatccccagtgaacgcaccaggtcaccaaagatcctcatccagcttaatgatgtcatgtggaagttctgaatagatgttactgatctttaaataaatcatccatttgagtccactgctgttgcaagggctcatggttgctgtacatagatggtcttagttcaggaacctgtgcttgtatattacttcaataaatctgaaatcgatgtcatagccagctaaagacgcccttgattttggcatctttcttgattttgacaacagtttcaggcttgttgtgtttctgaaaagcatttgtaagacaaaacaagttgcgtttctagaatgcgaataagattcaattatgtggtgaaaaaaaaaaaaaaaa

SEQ ID NO: 3213 - DNA, 2156 bp, Quercus alba
aaaacccaacacttttcatcgatattctctctctctctctagttctagaactatcacacaaacaaaaacaactaaacaaaaccaaaaccaaaaccattcattcattcctcggattttttacactctctctcaaaacatggacaccaaaataggagcgctcgacgcttgcccacactccagcacagacctctgtgccgtaccgtcaaacggcgccgtctccaccatccaaagctcaaccccttccaccattgtcaccccctcggacgccacactgggtcgccacctcgctcgccggctcgtccaaatcggtgtcacggacgtattctctgtccccggtgactttaacctcactcttctcgaccacctcatcgccgagcctggtctcaccaacgttggctgctgtaacgagctcaacgctggctacgccgctgatggctacgcgcggtcccgcggcgtcggcgcgtgcgttgttactttcaccgtcggtgggctcagtgtgctcaacgcgatcgccggcgcttgcagtgaaaacctccctctaatttgcattgttggtgggcccaactccaatgactatggaaccaacaggattttgcaccatacaatcggattgcctgactttagtcaagagcttcggtgttttcagactgtcacttgctatcaggctgtggtgaataatttggaagatgcacatgagttgattgatacagcgatttcgacttcattgaaggaaagcaagcctgtttatattagtataagctgtaacttggctggggttcctcatccaacgtttagtcgtgaacctgttccattttcgttaagtcccagattgagtaatcagatgggattagaggctgcagtggaggcagcagcggggtttttggacaaggctgtgaaaccagtattggtggggggtcctaaactgagagttgcaaatgcaactgatgcatttgttgaactagctgatgcttgtggttatccccttgctgtgatgccatcagcgaaagggcttgtgcctgagcaccacccacatttcattgggacttattggggtgctatcagcactccattttgtgcggagattgtggagtctgccgatgcttatttgtttgctggacctatattcaatgactatagctctgttgggtactcattgcttctcaagaaagagaaggcaatcattgtgcaacctgaccgtgttgtgatcgggaatgggcctgcatttgggtgtattttgatgaaggatttcctcagagcacttggcaagcggctcaagcgtaatacaactgcttatgagaactatcataggatctttgttcctgatggacttcctttgaagtctgcaccaaaagaacctttgagggttaatgttctgttccagcatatacagaacatgctgtctagtgagactgctgtgattgctgagacaggggactcatggtttaactgccagaagctgaaattgccacagggctgcggatacgagttccaaatgcaatatggatcaattggttggtcagttggtgcgactcttggctatgcacaggctgtgcctgagaagcgagtgattgcttgcattggtgatgggagcttccaggtcactgcacaagatgtgtcaacaatgattagatatgggcaaaggaccatcatcttcctgataaacaacggtggatacaccattgaagttgaaatccatgacgggccttacaatgtgattaagaactggaactacactgggttggttgacgcaatccacaatggcgagggcaagtgctggacaacaaaggtccgttgcgaggaggagctgattgaggcaattaatacagcaacaggggataagaaggacagcctgtgcttcattgaggtgattgttcacaaggatgacaccagcaaagagctgcttgaatggggctcaagggtctctgctgccaatagccgcccacccaaccctcagtaaatcttagccacattaatgagattgaaaagcacaaaataaattgagcagttttatgttaacatagtaatattgagtttgcttcttaagtggtttgcgtaatgaacaaggagagttttgcagaattatgtgtatattttctttggatttgctttactattgaaagatcaaattaatgagttttgggattacatttttcaaa

SEQ ID NO: 3214 - DNA, 1445 bp, Hordeum vulgare
ggaggatgcacatgaacagattgacactgccatttccactgcactgaaggagagcaagccagtttacatcagcatcagctgcaacctcccctcgatcccgcatcctacctttagccgccatcctgtccctttctttctctccccaaaactgtcaaaccagatgaacctggaagcagcagtggagactgctgcggcttttttgaacaaatcagtcaagcctgtccttgttggcggaccgaagatgagggtggccaaagcatgtgaagctttcgtagagctggctgatgcatgcggttatccggttgcagtgatgccttctgcaaaggggcttgtgccagagcaccattctagatttattggcacatattggggtgctgtgagcactccattctgtgctgagattgtggagtcagctgatgcctatttgtttgctggcccgatatttaatgactacagctcggttgggtactcacttcttctcaagaaggagaaggccatcatcgtccagcctgaccgagtagtgattgggaatgggcctgcatttgggtgtgttctgatgaaggacttcctgcatgcacttgcaacccggctgaagaagaacacagctgcctacgacaactatagtcggatttttgtgcctcagggcgaacccctttcctctgagcatggagagcctttgagagtgaatgtacttttcaagcatattcagaaaatgttgtctggcagctcagctgttatagcagagactggggactcatggtttaactgccagaagctgaaactgccggaaggctgtgggtatgaatttcagatgcaatatggatcaattggttggtcagtgggtgcaactctgggatatgcgcaggctgccaaggataagcgagtcatttccttcattggagatggcagctttcaggtgacggcgcaagaagtgtcgacgatgctccggtggggacagaacaacataatcttcctgataaacaacggtgggtacaccatcgaggtggagatccatgacggcccttataacatcatcaagaattggaactacactggcgtggtggaggcattccataatggcgagggcaagtgctatacagccaaggtccgaacagaggaggaactgaagaaggcaattgaggcatccctaggacctaacaaggacagcctgtgctttatagaggtaattgtgcacaaggatgatactagtaaggagcttcttgagtggggttctagggtttccgctgcgaatagccgcccaccaaatccccagtgaacacatcaggtctcgacaagatcctcaagttctgaatagatgttactgatctctgaataaatcatccatttgagtccactgttgttgcacgtgctcatggttactgtacatagatggtctcagttcacctgtacttgtatattacttcaataaatctgaaatcgatgtc

SEQ ID NO: 3215 - DNA, 2270 bp, Lotus japonicus
tttctttctcggaagggggggattcatcaaaattttcctctcttcatattccctctgtttcactctactatctcattttttctttccttccattttccactaaaccatggacgtaaagttaggttctctcgacacaaccaagccagcaagcaacgacgtcgtttcatgcgccaccgccaaccacaccacggcgatccagtcctcgatcccatcaacggcggtgtccacctgcgacgccacgctcggccgccacctcgcgcgccgcctagctcagatcggcgtcaccgacgtgttctccgtccccggcgacttcaacctcacgctgctcgaccacctcatcgctgaaccgcagctcaacctcgtcggctgctgcaacgagctcaacgctgggtacgccgctgacggctacgctcgagcacgcggcgtcggcgcctgcgtcgtgacgttcaccgtcggtggactcagcgtgctcaacgctattgctggagcttacagtgagaacttgcccctcatttgcatcgttggtgggccgaactccaacgactatggaaccagcaggatccttcatcataccattgggttgccggatttcacacaggagttgaggtgttttcagactgttacttgctttcaggctgtggtgaataatttggaggatgctcatgagcagattgatacagcaatctcaactgcactgaaagagagcaagcctgtgtatataagcattagctgtaacttgcctgggattcctcatcctactttcagccgcgatcctgttcctttttcattgtctgccaaattgagtaaccagatggggttggaggcagcagtagaggcaactgcggagttccttaacaaggctgtgaaaccagtacttgtgggtggtcctaaactgagggttgcaaaagcatctgatgcctttgttgaactagctgatgcaagtggttatgctcttgctgtgatgccatcagctaaagggcaagttccagagcaccatccccatttcattggaacttattggggtgctgtgagcactgcattctgtgctgagattgtggagtctgctgatgcgtatttgtttgctggtcccattttcaatgactacagctctgtggggtactcacttcttctcaagaaagagaaggcaatcattgtgcagcctgatcgcgttgtgattgccaatgggcctgcatttgggtgtgtgctgatgaaggacttcctcaaggcacttgcgaagcgtctcaaacacaacaatgctgcatatgaaaactaccacaggatattcgtccctgaagggaagcctttgaagtctgcaccgaaagaacctttgagggttaatgttatgttccagcatatacaaaagatgctgtctggtgaaacagctgtgattgctgagacaggggactcatggtttaactgccaaaagctgaaattgccaagagggtgtgggtatgagtttcaaatgcaatatggctcaattggatggtctgttggtgcaacccttggctatgcacaggcagtccctgagaagcgagtgattgcttgcattggtgatggaagctttcaggtgactgctcaggatgtatcgacaatgctgcgatgcggtcaaaacaccatcatcttcctgataaacaatggtggatacaccatcgaggttgaaattcatgatgggccatacaatgtgattaagaactggaactacactgggctgattgaagcaatccacaatggtgaagggaaatgctggacttccaaggtcttctgtgaagaggagctagttgaagcaattgcaactgcaacaggaccaaagaaagattgcttatgcttcattgaggtgattgttcacaaggatgataccagcaaagagttgcttgaatggggctccagggtctctgctgccaatggtcgtcctcccaatcctcagtaaacttcagaccctgcctgttacttacattgctgaaattgcccttttactctgaagaattgagaacccttcttcgttagaattgagaaccctcaagatttgtacttccacggaatttgcttttcttattgtcttgctcgtttatgtaactttgtccaccgttttgtataaatgcattcaattgagatcaaaagcatccatcaccttgtttatctcgtaataatgcttatagttacttcaagattcttatgttgagcatcacttttttttctttctaggtgcattatgttaaagaatcattttacagacgttaattaatggatttcactcaaaatgttcccagcat

SEQ ID NO: 3216 - DNA, 2434 bp, Ricinus communis
actttctgtggttttggaaaaccgctagtcaaattccgttgaaaaagcggctattgttgctccttgttttcgattcctttatactacgacgcgacgccggtgttccccttttggttaccagagtaacagccaactggctcactgcattgcgcaccctcattatagcacagctaatattaagaaaccgggtaattgcattgggagagaatcgtggatcatcgtacaacaggtccaccgccaccactgcgaacaaataaacgttttaaaccaaaacccgccccttgtatccatttccatctcacttactactgaaccggccacttgtatataaactcttcccatttcctttctttctattcacaaaacaaaaaaacaaaacaaacaaacatctctttctctagctttcttttcttttcttttctcatctctacacctgtctccactccttcgctatggacacaaacattggatctattgacaccttgaaacccacaacaactgacgtgtgctgtccagcaaacggcgccgtttgcaccctccaaagctccacagtctccccatcatcgatcgtcagctcgcctgactccactctcggccgtcacttggctcgccgtcttgtgcaagtcggtgtcactgatgtcttctctgttcccggtgactttaacctcactcttcttgatcatttgattgctgagcctggacttaacgttattggctgttgtaatgagctcaatgctggatatgctgctgatggttacgcaagatcacgtggtgttggtgcttgtgttgttactttcactgttggtggattaagtgttctcaatgctattgctggtgcttacagtgaaaacttacccgttgtatgtattgttggtggacctaactccaacgattatgggactaacaggatcttgcatcataccattggtctgcctgattttagtcaggagttgaggtgtttccagcctgttacatgctttcaggctattgtgaataatttggaagatgcacatgagctgattgatactgctatatcaactgctttgaaagaaagcaagcctgtttatctcagcattagctgtaacttgtcagcgatccctcatcctacttttagtcgcgagccagttccattttcactctctcccagattgagtaataaaattggtttggaggctgctgttgaagcagcagcggagtttttgaacaaagcagtgaaaccagttttggttggtgggcctaaactgagggttgcaaaggcatgtgaggcctttgttgagttagctgatgcttgtggttatgcccttgctgtgatgccatcggctaaagggcttgtgccggaacaccattctcacttcattggtacttattggggtgcagtcagcactgccttctgtgctgagattgtggaatctgcagatgcttacttgttcgctggacccattttcaatgactacagctccgttggatactctctccttctcaagaaagagaagtcaatcatcgtgcagcctgatcgtgtggtgattggaaatggacctgcatttggatgtgttttgatgaaggattttcttaaagccctagcaaagaggctcaagaacaatactactgctcatgagaactaccgtagaatttttgtccctgaagggcaacctttgaaaagtcaacctaaagaaccattgagggttaatgttctgttccaacatatacagaaaatgctgtctagtgaaactgctgtgattgcagagacaggggactcatggttcaactgtcagaagctgaaattaccaaagggatgcgggtacgaatttcaaatgcagtatggatcaattggttggtcagttggggcaactcttgggtatgctcaggcggtgcctgagaaacgtgtgattgcttgtattggagatggtagctttcaggtgactgctcaagatgtgtcaacaatgctgcgatgtggacaaaagaccatcatcttcttgatcaataatggtgggtataccattgaggttgagatccacgatggtccttacaatgtgataaagaactggaactacactggcttggttgatgcaattcacaatggtgaaggcaagtgctggacggccaaggtccaatgcgaggaagagctgattgaagcgattgagactgcgacagagtcgaagaaagattgcttatgcttcattgaggttattgctcacaaggatgatacaagcaaagaactgttggaatggggctcaagggtctctgccgccaatagccgcccaccaaaccctcagtagattccaaagctacaaggttgcaacagtgataaatcttgatttcctatttgataaatgtctgtgctctgttgtttcctcgagtacatgagttgaatttgatcaagtttgcgtatttaatctagtttccaacaaaaaaaaagaaaaaatgtttgcgtatt

SEQ ID NO: 3217 - DNA, 2185 bp, Citrus sinensis
ttgctcgacccacgcgtccgctcactataaaatctctctggcaaacgccaatttcattcgttcatcgaacacttgtcacactctagaagttcaaaaaaaaaaaaaaacatttctcaaagacacttttcggaaacacattaacaaacggacaattcttcgtctccggcccttcaatcaatcatggacactaaaattggatcactcgacacctgcaagcccccatgcagcgacttagccagcccgccaaacggtgccgtttcaacaatccaatcctccgttcccgctactccactcgtcaacccgtccgagtcgaccctcggccgccacctcgctcgccggctcgtccaaatcggcgccaccgacgtcttctcggtccccggcgacttcaacttgacgcttctcgaccacctgatagccgagcccgggctcaacttgatcggttgctgtaacgagctgaatgccggatacgctgccgatgggtacgctcgctcgcgtggggtcggcgcctgtgtcgtgaccttcaccgttggtgggcttagcgtgcttaacgctatcgccggtgcttacagtgaaaatctgccgttgatttgcatcgttggtggcccaaactccaatgattacggaaccaacaggatccttcatcataccattggcttgcctgattttagccaagaactcagatgctttcagactgtcacctgttatcaggctgtggtgaataacttggaggatgcacatgagttgattgatacggcagtatcaactgctttgaaagaaagcaagcctgtttatatcagcgttgcttgtaacttgcctgcgattcctcatcctacttttagccgagagcccgttccattttcgctttctcccaagttgagtaatgagatgggcttggaggctgcagttgaggcagcagcagagttcttgaacaaggcggtgaaaccagtgttggttgctgggcccaaaatgagagtggccaaggcttgcaatgctttcgttgagcttgctgatgcttgtggctacgccgttgcggtgatgccatcagcgaaagggctagtaccagagcaccatccccattttattggaacttattggggtgccgtgagcactgcattttgtgctgaaattgtggaatctgctgatgcttatttgtttgctggacctatatttaatgactatagctcggttgggtactctcttcttctcaagaaggagaaggcagtcattctgcagcctgatcgtgtggtgattgctaatggaccggcatttggttgtgttttgatgaaggatttcctcaaagcactttcaaagcggctcaaaagcaacactactgcttatgagaattaccacaggatttatgttcctgaggggcaacctccgaagtgtgaacccaaagagcccttgagagtgaatgttctgttccaacatatacagaagatgctgtctagtgaaactgctgtgattgctgagacaggggactcttggtttaactgccagaaactgaaaattgcctaagggatgcgggtatgagttccaaatgcaatatggatcaattggttggtctgttggtgctactcttggatatgcacagtctgtgccagagaagcgtgtcattgcttgcatcggtgatggtagcttccaggtaactgcacaagatgtgtcaacaatgctgcgatgtgggcagaagactataatcttcctgattaacaatggtggttacaccattgaagttgagatccatgatggaccttacaatgtgatcaagaactggaactacaccgggttggttgatgcaatccacaatggcgaaggcaagtgctggacaaccaaggtcttctgcgaggaggagctcatcgaagccattgagaacgctactggacccaagaaggattgcttgtgcttcattgaagtaattgttcacaaggatgatacaagcaaagagcttttggaatggggctccagggtctccgctgccaatagccgcccaccaaatcctcagtagatatgaggcggctcatactgcaaattgcactctactaccatttatagccaaattaaatgagcgcatgtcttttctgtggttactttactaagttttgggtattttgaactatttgctggtttctaatgtaaattcattttaaaatttaatatctactaaatcctcttgcttgcttcaaaaaaa

SEQ ID NO: 3218 - DNA, 2096 bp, Carica papaya
gctgtaacgagcttaatgccgggtatgctgctgatggtttcgcaaggtcgcgtggcgtcggtgcttgcgtggttactttcaccgtcggtgggctcagcgtgcttaatgcaatagctggggcttacagcgagaatcttccagtcatttgcatcgtcggtggcccaaactcaaacgattatgggactaacaggattcttcatcacactattggtttgcctgacttcagccaagagcttagagctttccagactgtgacctgctatcaggctgtggtgaataacttggaggatgcacatgaacagattgatactgcggtatcaactgctttgaaagagagcaagcctgtttacatcagtataagctgtaacttgccagcaatccctcatcccacttttgttcgtgaacctgttccatttttcctctcccccagattgagtaatcacctgggtttagaggcagctgtggaggcaactgcagagttcttgaacaaggcagttaaaccagtcttggttggtggacctaaactgcgggttgcaaaagcaggcgatgcatttgttgagcttgccgacgctagcggctacgcggttgcggtcatgccatcagctaaaggccttgttcctgagcaccaccctcatttcattgggacttactggggtgcggtgagcactgcattctgtgctgagatagtggaatctgcggatgcttacttgtttgcagggcctattttcaatgactacagttctgttggctactctctgcttcttaagaaggagaaagctatcatcgtgcagcctgatcgtgtggtggttgcaaatgggcctgcttttgggtgtgttttgatgaaagattttctcaaagcgctggccaaacgtctgaagaagaacgatactgcttatgagaattatcataggatttttgtgcctgaagggcagcctgtgaaaggtgatcctgtagaacccttaagggttaatgttctgttccagcacatacaaaatatgctgtctggtgacagtgccgtgattgctgagacaggggattcttggtttaactgtcagaagctgaaactgccaaagggatgcgggtatgaattccagatgcaatatggatctattggatggtcagttggtgccactcttgggtatgcacaggctgtgccagagaagcgtgttattgcatgcattggtgatggtagcttccaggtgacggcacaagatgtgtcaacaatgataagatgtgggcagaaaagcatcattttcctcataaataatggtggatacaccattgaagttgagatccatgatggtccatacaatgtgatcaagaactggaactacactgccctagttgatgcaattcacaatggggaaggcaagtgctggacagccaaggttcggtgtgagaaagaactcattgaagcaatctctgctgcaacagggcccaagaaggattgtttgtgcttcattgaggtgatagttcacaaggatgatactagcaaagagcttcttgaatggggttccagggtgtctgctgcaaatagtcgcccaccaaatcctcagtagactcttcttctagctcactgcaacaattgggttattccaagtagatgagaaactcttatattgctcctaaaggttagtaagttatgagtatatgttgtattcaaagagtttgattgtattttgcgggtttcatgttggtgtttgatgtaaatttcctttgaatttgattatatgaaagaaccccaagtcttctggttttcatttctctctttgttttgtcgatggctccatgtgacaaggaagaacattggtgtaaaattcacatgcaaacaacgcgggacaaccacgttctgcacggtgctgggcccaagaagaaaaaacaaaaacaaaaatctccacggaccgagactgtcaattcttaattgctgaaaatagccaaaagaaaaagaaaagaaatagtaggagtggattccacggattaattgcagaaatatttctattagtagttaagcgaacaatactgtttcttttcttgatctagtaaaaaccaaagatgttatgtgaatgatttaataaatcaagattgatttggagttg

SEQ ID NO: 3219 - DNA, 2176 bp, Citrus clementina
cttgctcccagtcacaaactcactataaaatctctctggcaaacgccaatttcattcgttcatcgaacacttgtcacactctagaagttcaaaaaaaaaaaaaaacatttctcaaagacacttttcggaaacacattaacaaacggacaattcttcgtctccggcccttcaatcaatcatggacactaaaattggatcactcgacacctgcaagcccccatgcagcgacttagccagcccgccaaacggtgccgtttcaacaatccaatcctccgttcccgctactccactcgtcaacccgtccgagtcgaccctcggccgccacctcgctcgccggctcgtccaaatcggcgccaccgacgtcttctcggtccccggcgacttcaacttgacgcttctcgaccacctgatagccgagcccgggctcaacttgatcggttgctgtaacgagctgaatgccggatacgctgccgatgggtacgctcgctcgcgtggggtcggcgcctgtgtcgtgaccttcaccgttggtgggcttagcgtgcttaacgctatcgccggtgcttacagtgaaaatctgccgttgatttgcatcgttggtggcccaaactccaatgattacggaaccaacaggatccttcatcataccattggcttgcctgattttagccaagaactcagatgctttcagactgtcacctgttatcaggctgtggtgaataacttggaggatgcacatgagttgattgatacggcagtatcaactgctttgaaagaaagcaagcctgtttatatcagcgttgcttgtaacttgcctgcgattcctcatcctacttttagccgagagcccgttccattttcgctttctcccaagttgagtaatgagatgggcttggaggctgcagttgaggcagcagcagagttcttgaacaaggcggtgaaaccagtgttggttgctgggcccaaaatgagagtggccaaggcttgcaatgctttcgttgagcttgctgatgcttgtggctacgccgttgcggtgatgccatcagcgaaagggctagtaccagagcaccatccccattttattggaacttattggggtgccgtgagcactgctttttgtgctgaaattgtggaatctgctgatgcttatttgtttgctggacctatatttaatgactatagctcggttgggtactctcttcttctcaagaaggagaaggcagtcattctgcagcctgatcgtgtggtgattgctaatggaccggcatttggttgtgttttgatgaaggatttcctcaaagcactttcaaagcggctcaaaagcaacactactgcttatgagaattaccacaggatttatgttcctgaggggcaacctccgaagtgtgaacccaaagagcccttgagagtgaatgttctgttccaacatatacagaagatgctgtctagtgaaactgctgtgattgctgagacaggggactcttggtttaactgccagaaactgaaattgcctaagggatgcgggtatgagttccaaatgcaatatggatcaattggttggtctgttggtgctactcttggatatgcacagtctgtgccagagaagcgtgtcattgcttgcataggtgatggtagcttccaggtaactgcacaagatgtgtcaacaatgctgcgatgtgggcagaagactataatcttcctgattaacaatggtggttacaccattgaagttgagatccatgatggaccgtacaatgtgatcaagaactggaactacaccgggttggttgatgcaatccacaatggcgaaggcaagtgctggacaaccaaggtcttctgcgaggaggagctcatcgaagccattgagaacgctactggacccaagaaggattgcttgtgcttcattgaagtacttgttcacaaggatgatacaagcaaagagcttttggaatggggctccagggtctccgctgccaatagccgcccaccaaatcctcagtagatatgaggcggctcatattgcaaattgcactctactaccatttatagccaaattaaatgcgcgcatgtcttttctgtggttacttcactaagttttgggtattttgaactatttgctggtttctaatgtaaattcattttaaaatttaatatctactaaatcctctccattgcttca

SEQ ID NO: 3220 - DNA, 1967 bp, Euonymus alatus
ttccactgtcgtaataccaaacagatgatcattgaacctggcttctttctttaaaaagaacctcgaaactttctttgttcttgttctctttctaaatttgctctcatggacaccaaggtcggatccatagataccagcaaggccgaaagcagcaacgttgggtgtccatccaacgttggcgtttcggcagtccaggactccgtcaacaccatttttggccactcgtcagagtcaactcttggccgccacctcgctcgcaggttagtccaagttggcgtcaccgacgtgttctcagttcccggagactttaatctggctcttctcgatcacctcgtcgccgaaccggggcttaacctcattggctgctgcaacgagctcaacgccgggtacgctgccgacggttacgcgcgatcgcgtggcgtcggtgcttgcgttgtcactttcacagtcggtggcctcagtgttctcaatgcgatcgccggagcatacagtgagaatctgcccctcatttgcatcgttggtgggcccaactccaatgactacggtactaacagaattcttcaccacaccattggattgcctgattttagtcaagaattgcggtgcttccagaatctcacttgctaccaggctatggtgaataacttggaggatgcacatgaactgatagatactgcaatatcaacagcgttgaaggaaagcaagcccgtttacattagcataagttgtaacttgcctgcgattcctcatcctacttttacccgagagccagtaccattttcactgtctcccaaattgagcaatcagatgggcttagaggcagcagtggaagaagctgcagcgttcttgaacaaagcagtgaaaccggttctggtggctgggcctaaactgcgatctgcgaaggcatgtgacgcctttgttgaactagctgatgcttgtgggtattcactcgctgtgatgccatcggccaaagggcttgtgccagagcaccaccctcatttcattgggacttactggggtgctgtaagcactgcattttgtgctgagattgtggaatctgcagatgcgtacctgtttgctggacccattttcaatgactacagctctgtgggttactctcttcttctcaagaaagagaaggcaatcattgtgcagcctgatagggtcaccattgctaatggccctgcgtttgggtgtattctgatgaaggattttctgaaagcactcgcaaaaaggctcaagcgcaacaccacagcttatgagaattaccacaggatttatgttcctgatggacatcctttgcagagtgcgccaaaagaacctttgagggttaatgtgttgtttgaacacatacaaaaaatgctgtctcatgaaacagccgtgattgccgagacaggggattcttggtttaattgccagaaactcaaattgccaaatggttgtgggtatgagttccagatgcagtatggatcaatcggttggtctgtgggtgcaacccttggatatgcacaagctgtgccagagaagcgtgttattgcttgcattggtgatggtagcttccaggtgacggcacaagatatatcaacaatgctgcgatgtgaacagaggagcatcattttccttataaacaatggtggatacaccattgaagttgagatccacgatgggccttacaatgtgattaagaattggaactatactggtctggttgacgcaatccacaatggcgaaggcaaatgctggacaaccaaggtcttatgcgaggaggatctgattgaagcaatagagacagcaacaggacctaagaaggattgcttgtgcttcattgaagtgattgctcacaaagatgatacaagcaaagagctattggaatggggctccagggtatcagccgccaatagtcgcccgccaaatcctcagtaaacctggcgtaaccacatcagattcgtcgagtactggctgtttaa

SEQ ID NO: 3221 - DNA, 2175 bp, Citrus sinensis
cttgctcccagtcacaaactcactataaaatctctctggcaaacgccaatttcattcgttcatcgaacacttgtcacactctagaagttcaaaaaaaaaaaaaacatttctcaaagacacttttcggaaacacattaacaaacggacaattcttcgtctccggcccttcaatcaatcatggacactaaaattggatcactcgacacctgcaagcccccatgcagcgacttagccagcccgccaaacggtgccgtttcaacaatccaatcctccgttcccgctactccactcgtcaacccgtccgagtcgaccctcggccgccacctcgctcgccggctcgtccaaatcggcgccaccgacgtcttctcggtccccggcgacttcaacttgacgcttctcgaccacctgatagccgagcccgggctcaacttgatcggttgctgtaacgagctgaatgccggatacgctgccgatgggtacgctcgctcgcgtggggtcggcgcctgtgtcgtgaccttcaccgttggtgggcttagcgtgcttaacgctatcgccggtgcttacagtgaaaatctgccgttgatttgcatcgttggtggcccaaactccaatgattacggaaccaacaggatccttcatcataccattggcttgcctgattttagccaagaactcagatgctttcagactgtcacctgttatcaggctgtggtgaataacttggaggatgcacatgagttgattgatacggcagtatcaactgctttgaaagaaagcaagcctgtttatatcagcgttgcttgtaacttgcctgcgattcctcatcctacttttagccgagagcccgttccattttcgctttctcccaagttgagtaatgagatgggcttggaggctgcagttgaggcagcagcagagttcttgaacaaggcggtgaaaccagtgttggttgctgggcccaaaatgagagtggccaaggcttgcaatgctttcgttgagcttgctgatgcttgtggctacgccgttgcggtgatgccatcagcgaaagggctagtaccagagcaccatccccattttattggaacttattggggtgccgtgagcactgctttttgtgctgaaattgtggaatctgctgatgcttatttgtttgctggacctatatttaatgactatagctcggttgggtactctcttcttctcaagaaggagaaggcagtcattctgcagcctgatcgtgtggtgattgctaatggaccggcatttggttgtgttttgatgaaggatttcctcaaagcactttcaaagcggctcaaaagcaacactactgcttatgagaattaccacaggatttatgttcctgaggggcaacctccgaagtgtgaacccaaagagcccttgagagtgaatgttctgttccaacatatacagaagatgctgtctagtgaaactgctgtgattgctgagacaggggactcttggtttaactgccagaaactgaaattgcctaagggatgcgggtatgagttccaaatgcaatatggatcaattggttggtctgttggtgctactcttggatatgcacagtctgtgccagagaagcgtgtcattgcttgcataggtgatggtagcttccaggtaactgcacaagatgtgtcaacaatgctgcgatgtgggcagaagactataatcttcctgattaacaatggtggttacaccattgaagttgagatccatgatggaccttacaatgtgatcaagaactggaactacaccgggttggttgatgcaatccacaatggcgaaggcaagtgctggacaaccaaggtcttctgcgaggaggagctcatcgaagccattgagaacgctactggacccaagaaggattgcttgtgcttcattgaagtacttgttcacaaggatgatacaagcaaagagcttttggaatggggctccagggtctccgctgccaatagccgcccaccaaatcctcagtagatatgaggcggctcatattgcaaattgcactctactaccatttatagccaaattaaatgcgcgcatgtcttttctgtggttactttactaagttttgggtattttgaactatttgctggtttctaatgtaaattcattttaaaatttaatatctactaaatcctcttgcttgcttca

SEQ ID NO: 3222 - DNA, 2157 bp, Glycine max
attcaaaaccccaaataccattcaactcttgtcatttttttcactttctctttttcaaaatactcttagtctctctctaaccttcttccagttgtctctaaacctcttgaaatccgtgatggacaccaggataggttcactcgacgcggccaagcccgcctgcaacgacgtcgtatcgtgcaaccacaccaccagcgccgccatccagccctgcgtgccggcgacggtgatcaacggcgccggcggagactccactttaggcggccacctggcacgccggctggtcgaaatcggcgtcaccgacgtgttctccgttcccggggacttcaacctgacgctgctggaccacctgatcgcagagccggcgctgaacctggtcgggtgctgcaatgagctcaacgccgggtacgccgccgatggctacgcgcgcgccaggggagtcggcgcgtgcgtggtgactttcaccgtcggcgggcttagcgtgctcaacgccatcgccggagcgtacagcgagaatttgccgctgatttgcatcgtcggtgggcccaactccaacgactacggcaccagtcggatcctccaccacaccatcgggttacccgatttcagccaggagttgaggtgcttccagaccattacttgcttccaggctgtggtgaataacttggaagatgctcatgagttgattgatacagcaatctcaactgcactgaaagaaagcaagccggtgtatataagcattagctgtaacttgcctgggattcctcaccccactttcagtcgtgatcctgttcctttttcgttatctccaagattgagtaacaagatggggttggaggctgcagtggaggcagcggcagaattccttaacaaggcagtgaaaccagtgctggtgggtggtcctaaactgagggtggcaacggcatctgatgcctttgttgaactggctgatgcgtgtggttatgcgcttgctgtgatgccatcggctaaagggcaggttccagagcaccatccccatttcatcggaacttattggggtgctgtgagcactgccttctgtgctgagattgtggagtctgcggatgcgtacttgtttgctggtcccatttttaatgactacagctctgtggggtattcgctccttctcaagaaggagaaggcgatcattgtgcagcctgatcgggtggtgatcgcaaatggacctgcatttggttgtgtgctgatgaaggatttccttaaggcacttgcaaagcgcctcaagcacaacaatactgcatatgaaaattaccacaggatatttgtccctgaaggacatcctttgaaggctacacccagagagcctttgagggttaatgttcttttccaacatatacagaagatgctgtctggtgaaactgctgtaattgctgagacaggggattcctggtttaactgccaaaagctgaaattgccaaagggatgtgggtatgagttccaaatgcaatatggttcaattggatggtctgttggtgctactcttggttatgctcaggctgttcctgagaagcgagtgattgcctgcattggtgatggaagttttcaggtgactgcccaagatgtatcaacaatgttgcggtgtgggcaaaagaccattatctttctggtcaacaatggcggatacaccattgaggttgaaattcatgatgggccatacaatgtgattaagaactggaactacactgggttgattgatgcaatccacaatggtgaagggaaatgctggactgccaaggtgttctgtgaagaggagctagttgaagcaattgccacagccacaggacacaagagagactccttatgcttcattgaggtgattgttcacaaggatgacaccagcaaagaattgcttgaatggggctcacgagtctctgctgccaatagccgtccccccaatcctcagtaaacttcagatgtcggcctatgattaaattgctgcaattgccctttagctctatgaaattgagaatcatttgagatgttgtccttgtaggaaatttacctttgttaatggcttgaaatatttatgcaaaactgagtccccacttgtttgtgtaaattctttcacttgagataaaaatatatccatcacctttgttcttatgtaaagcatcgtttttt

SEQ ID NO: 3223 - DNA, 2328 bp, Glycine max
ttaccacttaccactttcccaagccatccattctcacacacaaaactttccaccacatactatataaacatcccattcatttccacactcttctcattcaagtcctaaaataccaaaaacccattcacttttccacaagccttagttcttctcatttattctctttttcaaaatactttcactctctctaaccttccagttctcactaaacctcgtgaagctcgtgatggacaccaagataggttcactagacgcgcccaagcccaacagcaacgacgtcgtatcatgcaacctcaccagcagcgccgccatccagccctgcttgccggcgacggtgatcaacggcgccggctgtagtgactccaccttgggcggccacctggcccgccggctggtggaaatcggcgtcaccgacgtgttctccgttcccggggacttcaacctgacgctgctggaccacctcatcgcggagccggcgctgcacctggtcgggtgctgcaacgagctcaacgccgggtacgccgccgacggctacgcgcgcgccaggggagtcggcgcgtgcgtggtgacgttcaccgtcggcggcctcagcgtgctcaacgccatcgccggagcgtacagcgagaacttgccgctaatttgcatcgtcggtgggcccaactccaacgactacggcaccagtcggatcctccatcacaccatcgggttacccgatttcagccaggagctaaggtgctttcagaccattacttgcttccaggctgtggtgaataacttggaagatgctcatgagttgattgatacagcaatctcaactgcgctgaaagaaagcaaacctgtgtatataagcattagctgtaacttgcctgggattcctcaccccactttcagtcgtgaccctgttcgtttttcattgtctccaagattgagtaataagatggggttggaggccgcagtggaggcagcggcggaattccttaacaaggcagtgaaaccagtgctggtaggtggtcctaaactgagggtggcaacagcatctgatgcctttgtcgaactggctgatgcgtgtggttatgcgcttgctgtgatgccgtcggctaaagggcaggttccagagcaccatccccattttatcggaacttattggggtgctgtgagcactgccttctgtgctgagattgtggagtctgcggatgcatacttgtttgctggtccaatttttaatgactacagctctgtggggtattcacttcttctcaagaaggagaaggcgatcattgtgcagcctgatcgggttgtgatcgcgaatggacctgcttttgggtgtgtgctgatgaaggatttcctcaaggcactcgcaaagcgcctcaagcacaacaatactgcatatgaaaattaccacaggatatttgtccctgatgggcatcctttgaaggctgcacccagagagcctttgagggttaatgttctgttccaacatatacaaaatatgctgtctggtgaaactgctgtaattgctgagacaggggactcctggtttaattgccaaaagctgaaattgccaaaggcatgtgggtatgagttccaaatgcaatatggttcaattggatggtctgttggtgctactctgggttatgctcaagccgttcctgagaagcgagtgattgcctgcattggtgatggaagttttcaggtgactgcccaagatgtatcgacaatgttacggtgcgggcaaaaaaccatcatctttctgatcaacaatggtggatacaccatcgaggttgaaattcatgatgggccgtacaatgtgattaagaactggaattacactgggttgattgatgcaatccacaatggtgaagggaaatgctggactgccaaggtgttctgtgaagaggagctagttgaagcaattgccacagccacaggacccaagaaagactccttatgcttcattgaggtgattgttcataaggatgacaccagtaaagaattgcttgaatggggctcaagggtttctgctgccaatagccgtcctcccaatcctcagtaatcttcagaatttatcctatgactaaattgctgcagttgccctttagctctatgaaagtgagaatcatttgagatgatgcccttgtagggaatttacctttgttaatggcttgaaacatttatgctaaactgactccccacttgtttgtgtaaattctttcacttttgttcacctttgtttatcacctttgttcatttcgattattcttaagtaaagcatcgttctttttatccttttctgtttgctacattttgttaaacaggaaccgatttcat

SEQ ID NO: 3224 - DNA, 2119 bp, Vigna unguiculata
  misc_feature (443)..(443): n is a, c, g, or t
  misc_feature (639)..(639): n is a, c, g, or t
actaaaaaaaactctccaatcaccttttagatctctttccaaccaaaaaccataaccattcacaagtctcacaccttctccattacttcctctcaacttctcactgaaagcctcaagtccaagccatggacaccaagataggttcattggacgttgtcaagcctccctgcaacgacatcgtatcgtgcaatcagaccaacagcgctgccatacagccctgtgttccttccgccgtcatcaacggctgcggagactccactctcggcggccacctcgcgcgccgcctcgttgaagtcggtgtcaccgatgttttctccgttcccggcgacttcaacctcactctgctcgaccacctcatcgctgagcccgcgctcaacgtcgtcggctgctgcaacgagctcaacgccgggtacgctgccgatggctacgcccgtgctcgaggngtcggcgcttgcgttgtcacgttcaccgttggcgggctcagcgtgctcaacgcgatcgccggagcgtacagcgagaacttgccgctgatctgcgtcgttggtgggcccaactccaacgactatggtacgagtcggatcctccaccacaccatcgggttgcccgatttcagccaagagttgaggtgctttcagaccnttacttgcttccaggctgtggtgaataacttggaagatgctcacgagttgattgatacagcaatctcaactgcactgaaggaaagcaagcctgtgtatataagcattagttgtaatttgcctgggattcctcaccccacattcagtcgtgatccagttcctttttcattgtctcccagattgagtaacaagttggggctggaggcagcagtggaggcagctgcagagttccttaacaaggcagtgaaaccagtgctggtggggggtcctaaactgagggtggcaacagcaggtgaagcctttgttgaactggctgatgcttgtggttatgcgcttgctgtaatgccatcagctaaagggcaggttccagagcaccatcctcatttcattggaacttattggggtgctgtgagcactgccttctgtgctgagattgtggagtctgccgatgcatacttgtttgctggtcccatttttaacgactacagctctgtgggatattcccttcttctcaagaaggagaaggccatcattgtacagcccgatcgggttgtgatcgcaaatgggcctgcatttgggtgtgtgctcatgaaggatttcctcaagggactcgctaagcgcctcaagcacaacaatactgcatatgaaaattaccacaggatatttgtccctgaaggacatcctttgaaggcagcaccaaaagaacctctcagggttaatgttctgttccaacatatacaaaatatgctgtctggtgaaactgctgtgattgcagagacaggggactcctggtttaactgccaaaagctgaaattgcccaagggatgtgggtatgagttccaaatgcaatatggctcaattgggtggtctgttggtgcaactcttggttatgctcaggctgttcctgagaagcgagtaattgccttcattggtgatggaagctttcaggtgactgcccaagatgtatcaacaatgctgcggagcgggcaaaagaccatcatctttctgataaacaacggtggatacaccattgaagttgaaattcacgatggaccgtacaatgtgattaagaactggaattacacagggttagttgatgcaatccacaacggtcaggggaaatgctggactgccaaggtgttctgtgaagaggagctagttgaagcaattgccacggccacaggacccaagaaagattccttatgcttcattgaggtgattgttcacaaggatgacaccagcaaagaattgcttgaatggggctcaagggtctctgctgccaatagccgtcctcccaatcctcaataaacttcagatttcattcagcctatatgtctaaattgcttcaattgtccctttgacatgtccttctagggaatttacttttattaatggctttaaactgcttttgcaactgagtccttttgtttgtgtaaattctttcacttgagataaaaatctatatccttcaactttgttca

SEQ ID NO: 3225 - DNA, 2000 bp, Ipomoea batatas
caggaagatactacaccatttctcaaccgttcttttgttgctgttatggatactaagatcggatcgattgaagcttgtaagccagggagcggcgacgtagccaacgcgccgacaaacggcgtcaatacggttcactcaacgcccgttgccttcagctcggctgaggctactctaggccgccatctggcgcgccgcctcgtccagatcggggtgaccgacgtgttcagcgtccccggggactttaaccttactctgcttgaccacctcattgcggagccgaggctcaacctgatcggctgctgcaacgagctcaacgccggatacgccgccgacggctatgctcgggcccgcggtgtcggagcctgcgtcgtcactttcaccgtcggaggacttagcgtcctcaacgctatcgccggcgcgtacagtgaaaacctcccgctgatatgcatcgtcggtggtcccaactcgaacgactacggaactaaccggatcctccaccacactatcggtttacccgattttagccaggagctccggtgctttcaaaccgttacttgctatcaggctgtggtgaacaatttggaagatgctcacgagttgatcgatacggcggtatcgacggcggtgaaggagagcaagccggtttacataagcatcggctgtaacttggcagggatccctcatcccacctttattcgtgaaccggttccattttcacttaaccccaaattgagtaatcagatgggtttagaggcagcagtggaggctgctgcagagttcttgaacaaagctgtgaagccagtgctggttggagggccaaaaatgcgtgttgcaaaagcttgtaaagcctttgtcgagttggcagattcttgtgggtatgccacggctgttatgccctctgctaaggggctagtacctgagcaccacccgcatttcattggaacctactggggtgcagtgagcactgccttctgtgctgagattgttgaatcagctgatgcttgcctgtttgcgggaccaatattcaacgactacagctcggttggctattctttgcttcttaagaaggagaaggcagtcattgtgcaacctgatcgtgtgaccattgccaatggtcctgcatttggctgtgttctaatgaaggatttcctttctgcacttgcaaagagacttaagcacaacaaaacagcttatgagaattactctaggatttttgtccctgaaggtcaaccactcgagtgtgagccgaaggagccattaagggtcaatgttcttttccagcacatccagaaaatgttgtcaggtgaaacagctgttattgctgagacaggggactcatggttcaattgtcaaaagttgaaattaccccaaggatgtggatacgagttccaaatgcagtatggatctattggatggtctgttggtgcaactcttgggtatgcacaagctacaccagagaggcgggtgatttcttgcattggagatggtagctttcaggtgacagctcaggatgtgtcaacaatgctgcgttgcggtcagagaccgatcattttcctgataaacaatggtggctatacgattgaagtagagatccatgatggaccttacaatgtcatcaagaactggaactacactgcactcattgatgcaatccacaatggtgagggcaagtgctggacagccaaggttttttacgaagaggagctcattgaagcaattgagactgcgaccggagccaagaaggattgtctgtgcttcattgaagtgattgttcacaaggatgatacgagcaaagagctgcttgagtggggttctagggtctctgcagctaacagcaggcctccaaaccctcagtaaactgttaagtgtcgttgagggaggaaataacaaaggggaattggcttgtctaccttgaacaactttcaagtttccccctcttacttacgtttgtgtaatcattgaactattatattgctcatctgtatatcggaatttttttt

SEQ ID NO: 3226 - DNA, 1842 bp, Aquilegia formosa
ttttttttttttaatggaaaccaagattcttcttgactcaaacaatcctacaacacatgatgtaggttgtttacctcataatggaactgtttcaactgttcaaaactctgttgttccaattggatcggttgaatcaacactgggtcgacatttagctcgtcgattggttcaagttggtgtaaatgatgtattctctgttcctggtgattttaacttgactttacttgatcatcttattgctgaaccaggtttgaataatattggttgttgtaatgaacttaatgctggttatgctgctgatggttatgctcgatctcgtggtgttggtgcttgtgttgttacttttactgttggtggtcttagtgttcttaatgctattgctggtgcttatagtgaaaatcttccacttatttgtattgttggtggtcctaataccaatgattatggaaccaatagaattcttcatcatactattggattacctgattttagccaagaacttcgttgctttcagactgtcacttgttatcaggctgtggttaacaatttggaagacgcacatgagcagattgatacagctatatctactgctttgaaagaaagcaagcctgtttatatcagtgtcagttgtaatttgccttcaatcccacatccttccttcagtcgggaacccgttccattcgtcttaactcctagattgagcaataagatgggtcttgaagcagctgtggaggccacagcagagttcttgaataaggcagtgaagccggttctggttggtgggccaaaacttcgcgtggccaaggcttgtaatgcctttgttgaattagcagatgcttgtggttatccagtttcagtgatgccatcagccaaagggtttgttcctgagaaccacccaaggttcataggaacctactggggtgctgtgagtacagcattttgtgctgaaattgtggaatcagctgatgcttacctgtttgcagggcctatttttaacgattacagctcagtcggttactcgctactactcaagaaggagaaagcaattattgttcatcctgaccgagtggtcattgccaatggcccttcatttggatgcattttgatgaaagatttcctaagtgcactcgcgaagaggcttaaacccaatccaaccgcttatgagaattatcaccgaatatatgtaccagatggaattcctcttaagtgtgctcctcaggagcctataagggttaatatcttgtttaagcatattcaagcaatgctttcaggtgatactgctgtgattgctgagactggagattcctggtttaactgccaaaaactgaaactgcctaaaggctgtgggtacgagtttcagatgcaatatggatcaattggatggtcagttggagcaacacttggttatgcacaggctgcaaaagataaacgagtgattgcctgcattggggatggaagttttcaggtgacagcccaggatatttcaacaatgttgacatgtggacaaaacactattatcttcttaataaacaatggtggatatacaatagaggtggagatccatgatggaccttacaatgtgattaagaactggaactacactgggcttgtagaggcaatccacaatggtcaaggcaaatgctggacggctaaggttcgctgcgaggaagatctggtggaagctattgagactgcaacaggggaaaagaaggattgcttgtgcttcatagaggtgatctgtcacaaggatgatacaagcaaagagctgcttgaatggggttccagggtctctgctgccaatagtcgcccacctaatccacagtaaactccaagccttgcact

SEQ ID NO: 3227 - DNA, 2219 bp, Castanea mollissima
aaaactcctacactattcctctctctctctctctgattctagaactatcacacaaacaaaaacatcaaaacaaaaccaaaaccattcattcattcccttgattttttacactccctctcaaaacatggacaccaaaataggagcactcgacgcgtgcccacacaccagcacagacctctgtaccgtaccgtcaaacggcgccgtctccaccatccaaagctcaaccccttccaccattgtcaccccctcggacgccacactgggtcgccacctcgctcgccggctcgtccaaatcggtgtcacggacatattctctgtcccgggtgactttaacctcactcttctcgaccacctcatcgccgagcctggtctcaccaacgttggctgctgtaatgagctcaacgctggttacgccgctgatggctacgcgcggtcccgtggcgtcggcgcgtgcgttgttactttcaccgtcggtgggctcagtgtgctcaacgcgatcgccggtgcttacagtgaaaacctccctctcatttgcattgttggtgggcccaactccaatgactatggaaccaacaggattttgcaccatactattggattgcctgactttagccaagagcttcggtgttttcagacagtcacttgctatcaggctgtggtgaataatttggaagatgcacatgagttgattgatacagcgatttcgacttcattgaaggaaagcaagcctgtttatattagtataagctgtaacttggctggggttcctcatccaacgtttagtcgtgaacctgttccattttcgttgaatcccagattgagtaataaaatgggattagaggctgcagtggaggcagcagcggggtttttggacaaggctgtgaaaccagtattggtggggggtcctaaactgagagttgcaaatgcaaccgatgcatttgttgaactagctgatgcttgtggttatccccttgctgtgatgccatcagcgaaagggcttgtgcctgagcaccacccacatttcattgggacttattggggtgctgtcagcactccattttgtgcggagattgtggagtctgccgatgcttatttgtttgctggacctatattcaatgactatagctctgttgggtactcattgcttctcaagaaagagaaggcaatcattgtgcaacctgaccgtgttgtgatcgggaatggacctgcatttgggtgtattttgatgaaggatttcctcacagcacttggcaagcggctcaagcgtaatacaactgcttatgagaactatcataggatctttgttcctgagggacatcctttgaagtcagcaccaaaagaacctttgagggttaatgttctgttccagcatatacagaacatgctgtctagtgagactgctgtgattgctgagacaggggactcatggtttaactgccagaagctgaaattgccacggggctgcggatacgagttccaaatgcaatatggatcaattggttggtcagttggtgcgacccttggctatgcacaggctgtgcctgagaagcgagtgattgcttgcattggtgatgggagcttccaggtcactgcacaggatgtgtcaacaatgattagatatgggcaaaggaccatcatcttcctgataaacaatggtggatacaccattgaagttgaaatccatgacgggccttacaacgtgattaagaactggaactacactgggttggttgatgcactccacaatggcgagggcaagtgctggacaaccaaggtccattgcgaggaggagctgattgaagcaattaatacagcaacaggggataagaaggacaacctgtgcttcattgaggtggttgttcacaaggatgacaccagcaaagagctgcttgaatggggctcaagggtctctgctgccaatagccgcccacccaaccctcagtaaatctttagccacattaatgagattgaaaagcacaaaataaattgagcagttttatgttaacatagtaatattgagtttgcttcttgagtggtttgcgtaatgaacaaggagagttttgcagatttatgtgtatattctctttggatttgctttactattgaaagatcaaattaatgagtattgggataacatttttcaaaactttttccagtagtctgttgtgcataataaaagtatcaatcacaacttatgattttagacgaaaaaaaaaaga

SEQ ID NO: 3228 - DNA, 1646 bp, Cajanus cajan
ggggggggcgggctgagcgtgctgaacgcgatcgccggagcgtacagtgagaacttgccgctgatttgcatcgtgggtgggcccaactccattgactacggcaccaaccggatcctccaccacaccattgggttacccgatttcagccaagagttgaggtgctttcaaactgttacttgttttcaggctgtggtgaataacttggatgatgctcatgagttgattgatacagcaatctcgacctcactgaaagaaagaaagcctgtgtatataagcataggttgtaacttgcccgggattcctcaccccactttcagtcgtgaccctgttcctttttcattgtctccaagattgagtaacaagatggggttggaggcagcagtggaggcagctgcggaatttcttaacaaggcagtgaagccagtgctggttggtggtcctaaactgagggtggccacagcatctgatgcctttgttgaactggctgatgcatgtggttatgcacttgctgtgatgccatcggcgaaagggatggttcctgagcaccatcctcatttcattggaacttactggggtgctgtgagcactgcattctgtgctgagattgtggagtctgcggatgcatacttgtttgccggtcccatctttaatgactacagctctgtggggtattcccttcttctgaagaaggagaaggcgatcattgtgcagccggatcgggttgtgatcgcgaatgggcctgcatttgggtgtgtgctgatgaaggatttcctcaaggcactcgcgaagcgcctcaagcacaacaatactgcatatgaaaattaccacaggatatatgtccctgaagggcatcctttgaaggctgcacccaaagagcctttgagggtcaatgttatgttcaaacatatacaaaacatgctgtctggtgaaactgctgtaattgctgagacaggggactcctggtttaactgccaaaagctgaaattgccaaagggatgcgggtatgagttccaaatgcaatatggctcaattggatggtctgttggtgcaactcttggttatgctcaggctgttcctgagaagcgagtgattgcctgcattggtgatggaagctttcaggtgactgctcaagatgtatcaacaatgctgcggtgcgcgcaaaagaccatcatcttcctgattaacaatggtggatacaccatcgaggttgaaattcatgacgggccgtacaatgtgattaagaactggaattacaccgctttggttgatgcaatccacaatggtgaagggaaatgctggactgccaaggtcttctgtgaagaagagctagttgaagcaattgccacagctacaggacccaagaaagattccttgtgcttcattgaggtgattgttcacaaggatgacaccagcaaagaattgcttgaatggggctctagggtctctgctgccaatagccgtcctccaaatcctcaataaacttcagacttcagcctatgattaaattgctgcagtttccctttagctttatggtagtaagaatcatttgaattgaaatgaccttgtacggaatttgcttttgttaatggcttgcaacgtttatgcatctgagtccatttgtttgtgtaaattctttcacatgagat

SEQ ID NO: 3229 - DNA, 2074 bp, Glycine max
ctcatcatcatctaactcattcacatttttctctatcatctcgtttctactgtttcctcatggacactaacattggatctctatccctcgacgcgtgcaagcctgctaacaacgacgtcggttgtcccccgaacggagccgtttcagcaatcaaaccctccgtccccgcaaccacgatgacgtcctcggatgccacgctaggacgccacctagcacggagactcgtgcaggtgggggtgacagacgtcttctccgtgccgggtgactttaacctcaccctcctcgaccacctcatcgcggagccgcagttgaaaaacataggatgttgtaacgaactcaatgccgggtacgctgctgacggctacgcgcggtgcaggggcgtgggcgcgtgtgtcgtcacgtttactgttggaggactgagtgtaatcaacgcgattgcgggcgcgtacagcgagaatcttccgctgatctgtattgtgggtgggcccaatacgaacgattttggtaccaacagaatcttgcatcacaccattggattgtccgatttcagccaggagctcaggtgcttccaaacagttacatgctatcaggctgtggtgaataacatagaagatgctcatgaattgattgatactgcaatctcaacctgcctgaaagaaagcaagcctgtgtacataagcataagttgtaacttgcctggcattcctcaccccacattcagtcgcgagccggttccattttctctgtctccaagattgagtaacaagatggggttggaggctgcagtggaagcagcagcagagttcctaaacaaggcagtgaagcctgtaatggttggaggtcctaaactaagggtggctaatgcatgtgatgcatttgttgagcttgctgatgcatgtggctatccatttgctgtgatgccatcagccaagggactagtcccggagcacaaaccccacttcattggcacattctggggtgctgtgagcaccgcattctgtgctgaaatcgtcgaatctgctgatgcatacttgtttgctggccccattttcaatgactacagctctgttgggtactcactcctcctcaagaaggagaaggccatcatcgtgcagccggagcgcgttgtgatctccaatggacccgcattcgggtgtgtcctcatgaaggacttcctcagggaactcgcaaagcgtctcaagcacaacaacactgcttatgaaaattactcaaggatttttgtccctgagggaaagcctgtgaaagctgaacccagagagcctttgagggttaatgttctgtttaagcatatacaagatatgctgtctggcgaaaccgcggtgattgctgagacaggggactcttggtttaactgccagaagctgaagttgccaaaggggtgtgggtatgagttccaaatgcaatatggttcaattggttggtctgttggtgctacacttggttatgctcaggcggttcctgagaagcgagtgatttcttgcattggtgatggaagctttcaggtgacagctcaggatgtgtccacaatgctgcgaaatgagcagaagaccatcatcttcctgataaacaatggtggatacaccattgaagttgaaattcatgatgggccatacaatgtgattaagaactggaactacactggcttggttgatgcaatccacaatggtgaaggaaaatgctggaccactaaggttacatgtgaagaggagcttgttgaggcaattcagacagcaacaggtgacaagaaagattgcttgtgcttcattgaagtgattgttcacaaggatgacacaagcaaagaattgcttgaatggggctcaagggtttgtgctgctaacggtcgtcctcccaatcctcagtgaatttcaaacacttaattgagccattacaaatttgctggagtttctccctatttcaaacacttactcttgctgatagaaaaaagaaaatagaacaatttaatttcatgttttatttaacaaagacaataactaccatgagatttacttatatttatttttaaataaaattgagttttttaattagctttcac

SEQ ID NO: 3230 - DNA, 1959 bp, Glycine max
ctcatcatcatctaactcattcacatttttctctatcatctcgtttctactgtttcctcatggacactaacattggatctctatccctcgacgcgtgcaagcctgctaacaacgacgtcggttgtcccccgaacggagccgtttcagcaatcaaaccctccgtccccgcaaccacgatgacgtcctcggatgccacgctaggacgccacctagcacggagactcgtgcaggtgggggtgacagacgtcttctccgtgccgggtgactttaacctcaccctcctcgaccacctcatcgcggagccgcagttgaaaaacataggatgttgtaacgaactcaatgccgggtacgctgctgacggctacgcgcggtgcaggggcgtgggcgcgtgtgtcgtcacgtttactgttggaggactgagtgtaatcaacgcgattgcgggcgcgtacagcgagaatcttccgctgatctgtattgtgggtgggcccaatacgaacgattttggtaccaacagaatcttgcatcacaccattggattgtccgatttcagccaggagctcaggtgcttccaaacagttacatgctatcaggctgtggtgaataacatagaagatgctcatgaattgattgatactgcaatctcaacctgcctgaaagaaagcaagcctgtgtacataagcataagttgtaacttgcctggcattcctcaccccacattcagtcgcgagccggttccattttctctgtctccaagattgagtaacaagatggggttggaggctgcagtggaagcagcagcagagttcctaaacaaggcagtgaagcctgtaatggttggaggtcctaaactaagggtggctaatgcatgtgatgcatttgttgagcttgctgatgcatgtggctatccatttgctgtgatgccatcagccaagggactagtcccggagcacaaaccccacttcattggcacattctggggtgctgtgagcaccgcattctgtgctgaaatcgtcgaatctgctgatgcatacttgtttgctggccccattttcaatgactacagctctgttgggtactcactcctcctcaagaaggagaaggccatcatcgtgcagccggagcgcgttgtgatctccaatggacccgcattcgggtgtgtcctcatgaaggacttcctcagggaactcgcaaagcgtctcaagcacaacaacactgcttatgaaaattactcaaggatttttgtccctgagggaaagcctgtgaaagctgaacccagagagcctttgagggttaatgttctgtttaagcatatacaagatatgctgtctggcgaaaccgcggtgattgctgagacaggggactcttggtttaactgccagaagctgaagttgccaaaggggtgtgggtatgagttccaaatgcaatatggttcaattggttggtctgttggtgctacacttggttatgctcaggcggttcctgagaagcgagtgatttcttgcattggtgatggaagctttcaggtgacagctcaggatgtgtccacaatgctgcgaaatgagcagaagaccatcatcttcctgataaacaatggtggatacaccattgaagttgaaattcatgatgggccatacaatgtgattaagaactggaactacactggcttggttgatgcaatccacaatggtgaaggaaaatgctggaccactaaggttacatgtgaagaggagcttgttgaggcaattcagacagcaacaggtgacaagaaagattgcttgtgcttcattgaagtgattgttcacaaggatgacacaagcaaagaattgcttgaatggggctcaagggtttgtgctgctaacggtcgtcctcccaatcctcagtgaatttcaaacacttaattgagccattacaaatttgctggagtttctccctatttcaaacacttactcttgctgatag

SEQ ID NO: 3231 - DNA, 1908 bp, Amsonia hubrichtii
acccaatcatcatcaccgtcgtcgccatttctgcatttaatggatactaagatcggacctcttgacgttgttaagccacagtctaacgacgtcgggtgtctgccaacaaacggtgctgtgacaattcagcaaacgtccgttcccattggctccgctgacgccactctcggtcgtcacttggctcaccggcttgttcagatcggtgttaatgatgttttcgcggttcccggagactttaacctcacgcttctcgaccatctcatagctgagccaggtcttaacctcataggctgctgtaacgagcttaacgctggatacgctgctgacggctatgctaggtcccgcggtgttggtgcttgtgctgtcaccttcaccgtgggcggcttaagcatcctgaacgctatagctggagcctacagtgagaaccttccagtcatatgtattgttggtggtccaaactctaatgactatggcaccagcaggatcctccatcatactatcggcttaccggattttagccaggagcttcgttgcttccaaactgtcacttgctatcaggctgtggtgaataatttggaagatgcgcatgaagcgattgacacggcaatttccacggcattgaaggagagtaagcccgtatacatcagcataagttgtaacttgcctgcgattcctcatcctacgtttagtcgcgagcccgttccgttttcgctgtcccctaaattgagtaatcagatgggtttagcagctgcagttgaagcagcagcagagttcttgaataaatctgtgaagccagtgatggtgggagggccgaaaatgcgagttgcaaaggcttgtgatgcttttgttgaattagcagatacttctggttatgcccttgcagtgatgccatcggcaaaggggctagttccagaacaccatccacatttcattggaacttactggggggctgtgagcactgcattctgcgctgaaattgttgagtcagctgatgcttacttgtttgctgggccaatattcaatgactatagctcagttggttactctctgcttctcaagaaagagaaggctatcatagtgcagcctgaacgtgtgaccattggcaatggtcctgcatttggctgtgtcctaatgaaggatttcttgagggaattagctaagaggctaaagcacaacaatactgcttatgagaattaccacagaatttttgttcctgatggacatcctctgaaatgcgagcctaaggagccattgagggttaatgttctgtttgagcacattcagaggatgttgtcaggtgactcagcagtgattgctgaaacaggagactcatggttcaattgccagaagttgaaactgccaaagggatgcggatatgagtttcaaatgcaatatggatccattggttggtctgtgggtgctacccttgggtatgctcaagctgtaccagaaaggcgtgtgattgcttgcattggtgatggcagcttccaggtgactgctcaagatgtatcaacaatgatacgttgtggccaaaagactatcatctctcataaacaatggtggttatacaattgaagttgagatccatgatggcccttataatgtgatcaagaactggaattacactgcgttggttgatgctattcacaatggagaaggcaaatgctggacaactaaggttcgctgtgaagaggaacttgttgaggcgattgaaactgcaactggcgctaaaaaggattgcttgtgctttattgaggtgattgttcacaaggatgatacaagtaaagagctgcttgaatggggttctagggtctctgcagctaatagccgtcctccaaaccctcagtaaattccccaaggaggtgcaaactgtactgaaatcagctgatgctgaaccattattaattc

SEQ ID NO: 3232 - DNA, 1850 bp, Malus domestica
aaccaaattccataaatcccatggacaccaaaatcggttccctcgacgtttgcaagccggcgtgcaccaacgtcggcagcctcccgaacggcgccgcttcggcaatccaaagcactgccccctccaccgtcaactcctctgacgccactctgggtcgccacatcgcccgccgcctcgtccaaatcggcgtcactgacgtgttcactgtccccggtgactttaacttgaccctcctcgaccacctcatcgccgagcccgggctcaccaacatcggctgctgcaacgaactcaacgccgggtacgctgctgacggctacgctcggtcgcggggagtcggggcgtgtgttgttactttcactgtcggtgggctcagtgttctcaatgctatcgccggagcttacagtgagaatcttccattgatttgtatagttggaggacccaactcgaacgattacgggacgcacaggattcttcaccacactattggcttaccggattttagccaagagctgacatgcttccagaccgtcacttgctatcaggctatggtaaataatctggaagatgctcatgaaatgattgataccgcaatttcaaccgccttgaaagaaagcaagcctgtttatatcagcataagctgcaacttggctggaattcctcatcctacttttagccgggatcctgttccgttttcattgtctccaagattgagcaatcatttgggcttagaggctgccgtggaggcagctgcagagttcttgaacaaggcagtaaagccggttatggttggggggcctaaacttcgagttgcacatgctggcgatgcctttgttgaactagctgatgctagtggttatgctctggctgtcatgccatctgcaaaggggcttgtgccagagcaccacccccatttcattggaacatactggggtgctgtgagcactgccttttgcgccgagattgtggagtctgcagatgcatacttgtttgctggaccgattttcaatgactacagctctgttggatactctctgcttcttaagaaagagaaggcaattgtggtgcagcctgatcgcgtgaccatagcaaatggcccttcatttggttgtgttctcatgaaggatttcctccgagctctggcaaagaggctcaagcacaacaaaactgctcatgagaactacagcaggatctttgttcccaacggacaccctctaaagtctgcaccgaaagaacctttgagggttaatgtactgttccaccacatccagaatatgctgtcaagtgaaactgctgttattgctgagacaggggactcatggtttaactgccagaaactgaaattgccggctggttgcgggtatgagttccaaatgcagtatggatcaattggttggtcagttggagcaactcttgggtatgctcaagctgttcctgagaagcgtgtgattgctttcatcggcgatgggagtttccaggtgactgttcaagatgtgtccaccatgatccgaaatgggcagaagaacatcatcttcctgataaacaacggcggatacacaattgaggtggagatccatgacggaccctacaatgtgatcaagaactggaactacactggactagttgatgccatccacaacggggagggcaagtgctggacaaccaaggtccgttgcgaagaggagctgattgaagcgattgagactgcaaccggggcgaagaaggatagcttgtgcttcattgaggtgatagcccacaaggatgataccagcaaagagttgcttgagtgggggtctagggtttctgctgccaacagccgctcacccaaccctcagtaaagtcatctcatttcc

SEQ ID NO: 3233 - DNA, 2063 bp, Gossypium hirsutum
aacaatttctcgattacttcgaaacttagaaaaaaaaagagagagaattcactcctttctttccctctacaatttcttcgcggaatttcgtatttcttttctctgaaatggataccaatattggatcacttgacagctgcaaacctacttccaacgacgtttgctgtccagcaaacgttaccgtttctaccatccaaggatccgtttcccccaccatcatcaactcctctgaagccactttgggccgccacttggctaggcggcttgtgcagatcggaataagcgatgttttctctgttcccggggatttcaacttgactttgcttgaccatttgatagccgagccagggcttaacctcatcggctgctgtaacgaactcaacgctgggtacgcagctgatggttacgctcgatcacgtggcgttggcgcttgcgttgtcactttcaccgttggtgggctcagcgttttgaacgccatcgccggtgcttacagtgagaatctccctcttatctgcattgtgggtggacccaactccaatgactatggaactaaccggattcttcaccatactattggcttgcctgattttagtcaagaacttagatgcttccagactgttacttgctatcaggccgtggtgaataacttggaggatgctcatgaaatgatcgacacagctatttcaactgctctgaaagaaagcaaacctgtttatatcagcatcagctgtaacctgcctgcaattcctcaccccacttttgcccgcgagccagttccattttcactctctccaaaattaagtaataagattggattagaggcggcggtggaggcagctgcagagttcttgaacaaggcggtcaaacccgttttagtcggtggaccaaagctgcgtgttgccaaggcatgcgaggcttttgttgagttggctgatgctagtggctacgccgtagcggtgatgccatcgggtaaagggcttgtccctgagcatcatcctcatttcattgggacatattggggagctgttagtactgcattttgcgctgagatcgttgaatctgctgatgcttacttattcgctggacctatttacaatgattatagctctgttgggtactctttgcttcttaagaaagagaaggcgattattgtgcagcctgatcgggtggtcattggtaatgggcctgcatttgggtgtgttttgatgaaagacttcctaagagagcttgccaagaggcttaagcacaataatactgcttatgagaattaccataggatttttgttcctgagggacaacctttgaaggcagcacctaaagaccctttgagggtcaatgttttgttccaacatatacagaagatgctttctagtgactcagccgtgattgctgaaactggggattcttggtttaactgccagaagctgaagttgcccgcaggatgtgggtatgaattccaaatgcagtatggatcaattgggtggtcagttggtgccactcttggatatgcacaggctgttccggagaaacgtgtcatcgcttgcattggtgatggtagtttccaggtgactgcacaagatgtgtccacaatgctgcgatgtgggcagaagaccgtaatcttcctcataaacaatggtggctacaccattgaagtcgagattcatgatggaccatacaatgtgatcaagaattggaactacactgccttggttgatgcaattcataatggtgaaggcaagtgctggacagccaaggtattttgtgaggaagagctcatagaagcaattgagacggcaacgggagccaagaaggactgcttatgctttattgaagtgatggttcacaaggatgatactagcaaagagctgttggagtgggggtctagggtctctgctgccaatagccgacccccaaatcctcagtaaattctacagtatgctttatgctataagcttttgagtttctgaatgctgagttaaaaatctgtagttttcaacattttgcaaaatttacggagtgcttgctcatcttggtgtaaattcattttcagtaatgaaagctat

SEQ ID NO: 3234 - DNA, 851 bp, Triticum aestivum
  misc_feature (33)..(33): n is a, c, g, or t
  misc_feature (42)..(42): n is a, c, g, or t
  misc_feature (57)..(57): n is a, c, g, or t
actgtcagtggtgatctatctgctatcatcagnacttatggnagacgggtcccaagnatatgccagaagtatattgagtgtcctgcgcttttccaaggaagaaagtttgaccttcggtacattgttttggtccgcagtatatgccctttggatatacttctttgtgatgttttttgggtcaggttagcaaacaatcagtacactttggagaaaactagcctttttgagtacgagacccatttcactgtgatgaactataacggaaggatgaaccatatgaatactccagagttcgtcaaggcgtttgagaaggagcaccaagttaaatggctggagattcatgaaagcatacgtattatgataaggcgtgtctttgagtcagcctcagctgtccatcctgagatgcagaactcattctgtcgggccatctatggtgttgatgttatgcttgatgataaattcaagccaaagattttggaggtgacatattgcccggactgcacgagggcatgccagtatgacacacaagctctcgttggaagccagggccccatcaaaggcagtgattttttcaacacggtgtttggctgcctttttctcgacgatttgacgaatgtgtcaccactgtaatcatcttgtcaagagctgtttccccctgaatgtcaagagctgttgtaacaccaatgtccttgcatcatgatatgatgaagggttcttgtacgtttatgcatcaacgaactgcatttgtgacaggatagaaactctgatatgatcatgtatttatgtgaatgaagcttaagatgggatttgcttgtgttacttgataaatattgctgtttctgatactaatg

SEQ ID NO: 3235 - DNA, 1946 bp, Triticum aestivum
tcttgaattatttagtgggtttacacagttacaggagctggaggtagacattcctggccctcttggagacagtgcgatttccattcttgagtctcttcccaatataaatttgctgaatggtgtcaatgcgtcaactatagtcgagaacgctaagcatgtagtggactctgcacttagaccacgtgttccagaatggtcacctgaagaatccctggctgaaagagttattggtgcaatgtggctgtatcttatgacataccggcttgccgatgaagaaaagtttgatgaaacacccatttggtatgtcatggatgagttgggctcagcgatgcgccatagtgatgatgcaaactttaggatatctccttttttgttcatgccagaaggaaaattagcttctgctataagttacacaattctgtggcctatttgtgatgttcatactggagaagaatgtacccgagatttcttgtttggtattggcgaagacaaacaacgctcagctaggcttacagcttggttccacacaccagagaagtattttattcaggaattcaggaagtaccaggagcagcttcagtcaactactatttgtcctacaaaagaggcgccctcaaccaaaagtgcacttccaagtgatggccgtccacttcgagtattcactgatataccccaagtagaggagttcttaacacgtccagagtttgttctcacaactgatccgaaggatgcagacatcatctgggcaggcatgcaaattgattctgaattaaagagttcactaggtctcacagaccaacaatacatgaatcagtttccttttgaggcttgtctggtcatgaagcaccacctagcggatactatccacagggcatggggctcacctgagtggcttcaacctacatataacctagagacccatttgtctcaactaattggtgattactctgtgaggaaacgggatggtaaggacaacttatggatcatgaagccttggaatatggcaagaacaattgataccactgtcagtggtgatctatctgctatcatcagacttatggagacgggtcccaagatatgccaaaagtatattgagtgtcctgcacttttccaaggaagaaagtttgatcttcggtacattgttttagtccgcagtatatgccctttggatatacttctttgtgatgttttttgggtcaggttagcaaacaatcagtacactttggagaaaactagcctttttgagtacgagacccatttcactgtgatgaactacaatggaaggatgaaccatatgaatactccagagttcgtcaaggcgtttgagaaggagcaccaagttaaatggctggagattcatgaaagcatacgtattatgataaggcgtgtctttgagtcagcctcagctgtccatcctgagatgcagaactcattctgccgggccatctatggtgttgatgttatgcttgatgataaattcaagccaaagattttggaggtgacatattgcccggactgcacgagggcgtgccaatatgacacacaagctctcgttggaagccaaggccccatcagaggcagtgattttttcaacacggtgtttggctgcctctttctcgatgatttgacgaatgtgtcaccactgtaatcatcttgtcaagagccgtttctccctcgaataccaagagctgttgtaacaccaatgtccttgcatcatgatatgatcaagggttcttgtacgcttatgcatcaacgaactgcatttgtgtcaggatatgatcatgtattcatgtgaatgaagcttaagatggatttgcttgtgttacttgataaatattgctgcttctgatactaatgttgcatgcatatgagattgaactatatcaagtagcaaattattacaatgccatgccattgcaagagtattgcaatagtttaccggggta

SEQ ID NO: 3236 - DNA, 1598 bp, Avena sativa
ttggtgcaatgtggctatatcttatgacataccggcttgctgatggagaaaagttggatgaaacacccatttggtatgtcatggagagttggcctcagccatgcgccatagtgatggtgctaacttcagaatagctcctttcctgttcatgccagaaggaaaactaacttctgctgtaagttacacaataatgtggcccatttgtgatgttcatactggagaagaatgtacccgtgatttcttgtttggtattggtgaagacaaacaacgctcagctaggcttacagcttggttccacacaccagagaactattttattcaggaattcagaaaatatcaggagcagcttgaatcaactagtatttgtccttctacaaaagagataccctcaaccaaaagtgtccgcccaagtgatggccgtgcacttcgagtattaactgatatatcccaagtagaggacttcttaactcgtccagagtttgttctcacaactgatccgcaggatgcagacataatctggctaggcgcgcaagttgattcggaattaaagagttcactaggtcttacgggccaacaatacacaaatcaatttccctatgaagcctgcctggttatgaagcaccacctagcagatactatccacaaggcatggggctcacctgagtggcttcaacctacatataacctagagacccatttgtctcaactaattggagattattgtgtgagaaaacgagatggtatggacaacttgtggatcatgaagccttggaatatggcaagaacaattgataccactgtcagtggtgatttatctgctattatcagacttattgagacaggtcccaagatatgccaaaaatatattgagcatcctgcgcttttccaaggaaggaagtttgatcttcggtacattgttctggtccgcagtatatgccctttggatatatttcttactgatgttttttgggtcaggttagcaaacaaccagtacactttggagaaaactagcttttttgagtacgagacccatttcactgtgatgaattatacaggaaagatgaaccatatgaatactccagagttcgtcaaggagtttgagaaggagcaccaagttaaatggctggagatccatgaaaacataaggaaaatgataaggcgtgtctttgagtcggcctcggctgttcatcctgagatgcagaacacattctctagggccatttatggcgttgatgtcatgcttgataataaattcaagccaaagattttagaggtgacttattgcccagactgcacgagggcatgccaatatgacacgagagcccttgtcggaagccagggccccatcagaggcagtgattttttcaacacggtgtttggctgcctctttctcgatgatttgacgaatgtgtcaccactgtaatcatcttgtcaaaagctgctgtaacaccattgctcttgcaccttgatatatgtacaagggggaggctgtaattgacaaccaagagctgttgtacggtttatgcatcatgaacggtgatactctgtatgatcatttgaatgaagcttaatagttttttgctcatgtgggttgatag

SEQ ID NO: 3237 - DNA, 1680 bp, Pennisetum glaucum
gcacatagttgactccgcacttcaaccacggcttccagaatggtcatcagaagaatctcttgctgaaagagttatcagtgcaatgtggttgtatcttatgacataccggcttgcagatgaagaaaagattgatgaaacacctgtttggtatgtcatggacgagttgggctcagccatgcgccacagtgataatccaaacttcagaatagctccattcttgttcatgccggaagggaaactagccactgctataagttacacaatcctgtggcccactgatgatgttcatactggagatgagtgtacccgggatttcttgtttggtattggtgaggagaagcaacgttcagctaggcttacagcttggtttcacacaccagagaactactttattcaggaattcaggaagtacaaggaacaacttcaaatgaatagcatttgttcttcaacaaaaacaaaagagacaccttcaaccaaaagtgtacgtccaagcgatgggcgcgcacttgacatacctcatgttgaggagttcttaacacgaccagagtttgttctcacaactgatccaaagaaggcggacatcatctgggtaagcatgcaggtggattcagaagtaaagaaagcactaggtcttacagaccaacaatacacaaatcaatttccttttgaggcttgcctggtcatgaagcaccatcttgcggagaccatccataaggcatggggctcacctgaatggcttcaacctacatataacctagaggcacatttgtccccactgattggtgattattgtaagaggaaacgagatggcatggacaacttatggatcatgaagccttggaacatggcaagaacaatagatactacagttactggtgatttatctgctatcatcagacttatggagacaggtcccaagatatgccaaaagtatattgaacgccctgcacttttccaaggaaggaagtttgatcttcggtacattgttttggtccgcagtatatgccctttggagatatttctttctgatgttttctgggttaggttagcaaacaatcagtacactctggagaagactagcttttttgagtatgagactcatttcactgtgatgaattatattggaaggatgaaccatatgaacacgccagaattcgtcaaggagttcgagaaggagcaccaagttaaatggctggagatccatgaaagcatacggtctatgatacgttgtgtctttgagtccgccactgctgttcatcctgagatgcagaaccctttctccagggccatttatggggtagatgttatgcttgataacagattcaagccaaagattttagaggttacgtattgcccagactgcgggagggcgtgcaaatatgacacacaagctctggtaggcagccagactaccatcaagggcagtgattttttcaacacggtgtttggctgcctctttctggacgagcaaacaaatgtgtctccgttgtaaccatcacccgtaaggctgttgtaatttaacgtcaagtttatcagaacatgacatgtataagctgtcaggcctgttgccaatgcgaaaggattgttgtattggccttgttgaagctttccgtgacagtacttctctgaaagtctgaaccattctcgttattgaatgtgctgctgtggtggtttggttag

SEQ ID NO: 3238 - DNA, 669 bp, Leymus cinereus x Leymus triticoides
gtatatgccctttggatatacttctttgtgatgttttttgggtcaggttagcaaacaatcagtacactttggagaaaactagcctttttgagtacgagacccatttcactgtgatgaattataatggaaggatgaaccatatgaatactccagagtttgtcaaggcgtttgagaaggagcaccaagttaaatggctggagattcatgaaagcataaggaatatgataaggtgtgtctttgagtcagcctcagctgtccatcctgagatgcagaactcattctgtcgggccatctatggtgttgatgttatgcttgatgatagattcaagccaaagattttggaggtgacatattgcccggactgcacgagggcatgccaatatgacacacaagctcttgttggaagccagggccccatcagaggcagtgattttttcaacacggtgttcggctgcctctttctcgatgatttgacgaatgtgtcaccactataatcatcttgtcaagagttgttttttcccgaatgtcaagagttgttgtaacaccaatgtccttgcatcatgatatgatcaagggttcatgtacgtttatgcatcaacgaactgcatccgtgacaggatagaaactttgatatgatcatgtattcatgtgaatgaagcttgagatgga

SEQ ID NO: 3239 - DNA, 1467 bp, Setaria italica
gagtgtacccgggatttcttgtttggtattggcgaggagaagcaacgttcagctaggcttacagcttggtttcacacaccagagaactactttattcaggaattcaggaagtaccaggaacaacttcaaacaaatagcatttgttcttcaacaaaaactaaagaggcaccatcaaccaaaagtgttcgtccaagtgatggccgtgcacttcgagtatatactgacatacctcacgtagaggagtttttaacacggccagagtttgttctcacaactgatccaaaggaggcggacatcatctgggtaagcatgcaagtggattcagaagtaaagaatgcactagggcttacagacaaacaatacacgaatcaatttccttttgaagcttgcctggtcatgaagcaccatcttgcggagaccatccacaaggcatggggctcacctgaatggcttcaacctacatataacctagagacccatttgtctccactgattggtgattattgtacgaggaaacgagatggcgtggacaacttatggatcatgaagccttggaacatggcaagaacaattgataccacagttactggtgatttatctgctatcatcagacttatggagacaggtcccaagatatgccaaaagtatattgaatgccctgcacttttccaaggaaggaagtttgatcttcgttacattgttttggtccgcagtatacgccctttggagatatttctttccgatgttttctgggttaggttagcaaacaatcagtacactctggagaagactagcttttttgagtatgagacccatttcactgtgatgaattacattggaaggatgaaccatatgaacacgccagaattcatcaaggagttcgagaaggagcaccaagttaaatggctggagatccacgaaagcatacggtctacgatacggtgcgtcttcgagtcggccaccgctgttcatcctgagatgcagaaccctttctccagggccatctatggggtagacgttatgcttgataacagattcaagccaaagattttagaggtgacgtactgtccagattgcgggagggcgtgcaaatatgacacacaagctctcgtgggaaaccagaataccatcaagggcagtgattttttcaacagggtgtttggctgcctctttctcgacgagcaaacaaatgtgtcgccgttgtaatcatcacccggaaggccggaaggctgttgtaacttgtaatatcaaggttatcacaacatgacacgtataagctgtcaggcctgttgccaatgcgaaaggaatgatggattgtctctttctttgcctgtttctagtcgtagtttgttgaagctttccgagacagagtattctctgaaagtctgaaccatgctcgttactgaatgtgttgctgtggtggtttggatgatacgtcttacgtagtagtagcatactttattctgc

SEQ ID NO: 3240 - DNA, 1649 bp, Saccharum officinarum
atttatctttgctaaatggtgtggattcctcaagtataatagggagtgggaagcacgtaattgactctgcacttgaaccgtggcttccagaatggtcgcctgaagaaccccttgccgaaagagttattggtgcaatgtggttgtatcttatgacataccggcttgctgatgaggaaaagattgatgaaacacctgtttggtatgtcatggacgagttgggctcagccatgcgccacagtgataatgcaaacttcagaatagctccattcttgttcatgccagaagggaaactagacactgctataagttacacaattctgtggcccactcatgatgttcatactggagaagagtgtacccgtgatttcttgtttggtattggcgaggacaaacagcgttcagctaggcttacagcttggttccgcacacctgagaactactttattcaggaattcaggaggtaccaggaacaacttcaatcaaatagcatttgttcttcaacaaaaatagaagagaccccctctaccaaaagtatacgtccaagtgatggtcgtgcactttgagtatatactgacatacctcatttagaggagtttttaacacggccagagtttgttctcacaactgatccaaaggaggctgacattatctgggtaagcatgcaagtggattcagaagtaaagaaagctgtagggctcacagaccaacaatacacaaatcaatttccttttgaagcttgccttgtcatgaagcaccaccttgcggagaccatccacaaggcttggggctcacctgaatggcttcaacctacatataacctagagacccatttgtctccactcattggtgattattttgtgaggaaacgagatggcatggacaatttatggatcatgaagccttggaacatggcgagaacaatcgataccacagttactggtgatttgtctgctatcatcagacttatggagacaggccccaagatatgccaaaaatatattgaacgccctgcacttttccaaggaaggaagtttgatcttcggtacattgttttggtccgtagtatccgccctttggaaatatttctatctgatgttttctgggttaggttagcaaacaatcagtacactttggagaagactagcttgtttgagtatgagacccatttcactgtgatgaattatattggaaggatgaaacatatgaatacaccagagtttgtcaaggagtttgagaaggagcaccaagttaaatggctggacatccatgaaagcatacggtctatgatacgctgtgtctttgagtcagccgcagctgttcatcctgagatgcagaacccattctcccgggccatgtatggtgtagatgttatgcttgataacagattcaaaccaaagattctagaggtgacatactgtccagactgcgggagggcgtgcaaatatgacacgcaagctctggtagggagccaggataccatcagaaggcgtgattttttcaacacggtgtttggatggctctttcttgacgagcaaacaaatgtatcgcccttgtaagcatcaccccagaggctggtgtaacatcagatctatcacaacatgacatgtataacctgcttgtctggtgccatatgagatgggacggagggg

SEQ ID NO: 3241 - DNA, 661 bp, Cenchrus ciliaris
  misc_feature (183)..(183): n is a, c, g, or t
  misc_feature (204)..(205): n is a, c, g, or t
  misc_feature (208)..(209): n is a, c, g, or t
  misc_feature (233)..(233): n is a, c, g, or t
  misc_feature (241)..(247): n is a, c, g, or t
  misc_feature (249)..(249): n is a, c, g, or t
  misc_feature (252)..(252): n is a, c, g, or t
  misc_feature (273)..(273): n is a, c, g, or t
  misc_feature (294)..(294): n is a, c, g, or t
  misc_feature (306)..(306): n is a, c, g, or t
  misc_feature (407)..(407): n is a, c, g, or t
  misc_feature (409)..(409): n is a, c, g, or t
  misc_feature (618)..(618): n is a, c, g, or t
gttttggtccgcagcatacaccctttggagatatttttttctgatgttttttgggttaggttagcaaacaaccagtacactctggagaagactagcttttttgagtatgagacccatttcaccgtgatgaattatactggaaggatgaaccatatgaacacgccagaattcgtcaaggagttngagaaggagcaccaagttaannggnnggagatccacgaaagcatacggtntatgatannnnnnntnttngagtcggccaccgctgttcancctgagatgcagaaccctttntccagggccatntatggggtggacgttatgcttgataacagattcaagccaaagattttagaggtgacgtactgcccagactgcgggagggcgtgcaaatatgacacacaagntntggtaggaagccagtcaaccatcaagggcagtgattttttcaacacggtgtttggttgcctctttctcgacgagcaaacaaatgtgtcgccgttgtaatcatcacccgtaaggctgttgtaacttgtaatatcaagtttatcacacatgtataagctgtcaggcctgttgccaatgcgaaaggattgatgtactttcttcacctgtttntagtcgtagtttattgaagcattccgaggcagagtacttttca

SEQ ID NO: 3242 - DNA, 2790 bp, Zea mays
ccctattctactccactctgttttctggaggctgctaaactaaacccttcttctccccactccgccctcggacccgccgccgccgccgcttgccgggtctatagccatgtcaccagcggttgcctctgcctcatctggcgaccgcatacgaacctacgaagacttcgtgcgggtacacgcgtacctgctggccgcggcgggcatcccgccgtcgctgcaccggaggctgtaccgcaagctcgcggacgaggtcttcgacggcggggaggtctttgccgtagagccgtgcgaggacgggaggcagcggcgcctcgtgctcaccgccgatcagtctctaggaaaagagtccgatgtcttcctcgtcgaccatgcgtggtccttccgcctccctgatgcgctcaagcagttgagggaagtaccaggattggctgaaaggatggcagcattaatgtgtgtcgatttggaccgcaagattgaagcagatgagcaggatgatgacgagagtgggagcttggagcatgtatcgcaagtagtcgagaaagaaagggctagagttcaggagagaagtgattctacagcttggctggaacttgaagaacttggaattgatgatgacatgctagtagccttggatctatctgcaaattttccgaatctggtagctctgaacctatggggaaacaagctgcgggatccagagaaagttatgcaagaaatcaggaagtgcacaaagctaaaggcactttggttgaacgagaatcctgttcttggcaaaagtattgacaaagctgttttcgatggcctctctggattggaaatatacaattcacattttacaagtaaagccggagagtgggcactaggtttttgcgcagacattgttggagcagataatccctgttcttctgtggaaagcacattgtttgggagcattgggactattgacctttctgatagatgcattcacaagctaccagaggtgttctctcctagtaaattgccatctctgtcaaaattgaacattcgtggtaatcctctggatcaaatttctggcgatgatctcttaaagctatttggtggattcactcagttacaagagttggaggttgacattcctggccctctgggaaacagtgcaatctccattcttgagtctcttcctaatttatctttgctaaatggcgtggattcctcaagcataatagagagtgggaagcatatagttgactctgcacttgaaccacggcttccagaatggtcacctgaagaaccccttgctgaaagagttattggcgcaatgtggttgtatcttatgacataccggcttgctgatgatgaaaagattgacgaaacacctgtttggtatgtcatggacgagttgggctcagccatgcgccacagtgataatgcaaacttcagaatagctccattcttgttcatgccagaagggaaactgcacactgctataagttacacaattctgtggcccactcatgatgttcatactggagaagagtgtacccgggatttcttgtttggtattggtgaggataaacagcgttcagctaggcttacagcttggttccgcacacctgagaactactttattcaggaattcaggaggtaccaggaacagcttcaatcaaatagcatttgttcttcgacaaaaatagaagagacacagacaccctcaacccaaaagtgtacgctcaagggatggtcgcgtccttcgagtatatactgacatacctcatgtagaggagtttttaacacggccagaatttgttctcacgactgatccaaaggaagctgacatcatctgggtaagcatgcaagtagattcagaagtaaagaatgctgtagggctcacagaccaacaatacacaaaccaatttccttttgaagcttgcctggtcatgaagcaccaccttgcggagaccgtccacaaggcttggggctcacctgaatggcttcaacctacatataacctggaaacccatttgtctccactcattggtgattattgtgtgaggaaacgagatggcatggacaatttatggatcatgaagccttggaacatggcgagaacaatcgataccacagttactggtgatttgtctgctatcatcagacttatggagacaggccccaagatatgccaaaaatatattgaacgccctgcacttttccaaggaaggaagtttgatcttcggtacattgttttagtccgtagtatccgccctttggaaatatttctgtctgatgttttctgggttaggttagcaaacaatcagtacactttggagaagactagcttttttgagtacgagacccatttcactgtgatgaattatatcggaaggatgaatcatatgaacacaccagagttcgtcaaggggttcgagaaggagcaccaagttaaatggctggacattcatgaaagcgtacgatctaccatacgccgtatctttgaggcggccgcagctgtccatcctgagatgcagaacccattctccagggccatctacggtgtagatattatgcttgacaacagattcaaaccaaaggtttttagaggtgacatactgtccagactgcgggagggcatgcaagtatgacacgcaagctctggtaggaagccaggataccatcagaggccgtgattttttcaactcggtgtttggctgcctctttcttgacgagcaaacgcatgtattgcccttataggcatccgccccagaggcggctgctgtaacatcaggttttatcataataacgtgacatatgtat

SEQ ID NO: 3243 - DNA, 706 bp, Lolium multiflorum
cggtacattgttttggtccgcagtatatgccctttggatatatttcttactgatgttttttgggtcaggttagcaaacaatcaatacactttggagaaaactagcttttttgagtatgagacccatttcactgtgatgaattatactgggaagatgaaccatatgaatactccagagttcgtcaaggagtttgagaaggagcaccaagttaagtggctggagatccatgaaaacatcaggaatatgataaggcgtgtctttgagtcagcctcagttgttcatcctgagatgcagaacgaattctgcagggccatttatggcgttgatgttatgcttgataacaaattcaagccaaagattttagaggtgacatattgcccagactgcaccagggcatgccagtatgacacacgtgctctcgttgggagccagggccccatcagaggcactgattttttcaacacggtgtttggctgcctctttctcgacgatctgacaaatgtatcaccactgtaaccatcttgtcaagatctgctgtaacactaccattcttcttgcaccatgatatgtacaaggggaaagttgtaattgacaaccaagggctgttgtacatttatgcatcaacggcatccatggcagtatatccaaccatgaactattgtactagtatgatcgtgtgaatggggcttccgatggaattttctat

SEQ ID NO: 3244 - DNA, 1074 bp, Brachypodium distachyon
gctcccgttgcccagcccaatcgatccgctggcaggggagcaggcgccggctgcggggacgagaagcgaggtcggcggtggcgccatccagtgcgcccctgcaatgacggtttcctttgcactgcgcctagggccaccggcgagtgcgacgagcggaggaggtggccgccctaccggcacccgagcgctggtgtcaaagaggccaaacaaggaacaacatttgtggatcaggaaggattcagcggggtcagggaagaaggcccttcgcttggttaatactgtttcaaagttaccaaatggaaaagaagctgtatatggtgcattggataggtggactgcttttgagactgagtttcctattatagcagcggcaaaagctttggaaatgttgaaaaggcaaagacaatggatacagattattcaggtaactaagtggttgatgagcaaaggccaggttctgacgtggacaacatatgatacattgctgttggctctttttatggatggaagattagatgaggctgagtcaatttggaatactgtcatacaaaagcatacacgctcagtgccaaagagattgttttctcggatgatcctgatttatgacagtcgtcgtcttccagacaaagttttggaggtatttgctgacatggaggaattaggggtgcatccagatgaggatacgactagaaggattggaagagcatttgcgagctcaggccaggaagataagcaaaaacctgttctcgagaagtacttgaaaaagtggaagtacatccatttcaacggcgagcgcgttcgggtgaggagggcgggacctttggcgtagtaaccattctctggatcgcttaaacaaccaaacaaacgaatataaccgtgtctggaaagatgtgattgctgtctttttccgagttcctatgtgagtattagtatgacaggtggaacaaagtgaggaaagttgtaatgcagtcaactactaacaggataatatcttatgtatgcgtacgcgtataagttgtgatgtttcaaacatgctgatatcttaggtacgctggtatttcactcgttttcttt

SEQ ID NO: 3245 - DNA, 703 bp, Triticum aestivum
  misc_feature (190)..(190): n is a, c, g, or t
  misc_feature (573)..(574): n is a, c, g, or t
  misc_feature (584)..(584): n is a, c, g, or t
  misc_feature (604)..(604): n is a, c, g, or t
  misc_feature (608)..(608): n is a, c, g, or t
  misc_feature (655)..(655): n is a, c, g, or t
ttctctgtggacggcgtgccggtgcgcgtgttccggaaccacgacgcgaacggcgtgccgtacctgagcaggcaggcgatgaaggtgcacgccaccatctgggacggcgacacctgggccacccgcggcggccgggtcaagatcgactgggcgcacgcgcccttcgtcgcctcctacgggacctacgccnccagcgcctgcgtctccgcggccggcaacggcgatcaggacggagcgccgtcggccttctgctgcccgggcgacgcctcgtcgtggatggcccggcggctggggcccgacggcgagcgcgcggtggcgtgggcgcgcgacacgtacatggtgatggactactgcgacgacccctggaacctgggccgccccgccgagtgcgacatggaccagctcgcctctgccgtctgattgttcggttccgtcggccatactaccgcacacgtgtcgtcgtgttattagacgagacagacgtacggtgtttgtgttggtgcttctagcgtagcctgctaggtcgtctcactcaagatgtgacgtgtaggcgtagcgtatataatacagganntaactactangagttttctctagcggatcntagnaaggatgattcctgcagaaacctgcccctgctgtaacctgtagccgngtaattcatgcatatacagacgctgagataagattaacgcatttactg

SEQ ID NO: 3246 - DNA, 1941 bp, Saccharum officinarum
gcaccagtagagcagaaatttaatcttcatttgatggtcaatacggatagagaactgcttgctcagaaagttgcacctcaccgggacttctacaacgttaggaaggttgatactcatgttcatcactcagcatgcatgaaccagaaacacctgttgagatttatcaagtctaagttgaggaaggaacctaatgaggttgtaatctttagagatgggacctatttgactcttaaggaggtttttgagagtttggatttgacagggtatgacctcaatgttgatctcttagatgtccatgctgataagagtacatttcatcgttttgacaagttcaatctgaaatataatccatgtggtcaatctcgcctgagggagatctttttaaagcaggataatcttattcaaggtcgcttccttgctgagctgacaaaagaagtattttctgaccttcaagcaagtaaatatcagatggctgagtatcggatatctatttatgggaggaagaaaagtgaatgggaccaaatggcaagttggatagtgaacaatgaattatatagcgagaatgttgtttggttaattcagattcctcggatatacaatgtatacagggagatgggcacaatcaattcattccaaaacctccttgacaatatttttctccctctttatgaagtaactgttgacccagcttcacatcctcagctccatgttttcttagaacaggttgttgggttggatttggtggatgatgaaagcaaacctgaaagacgcccaacaaaacacatgccaacacctgagcaatggactaatgttttcaatccagcctatgcatattatgtgtactattgctatgccaatctgtatacactgaacaagcttcgtgagtccaagggcatgacaacaatcaaactgcgtccacactgtggggaggctggtgatatcgatcaccttgctgcagcgtttcttacttcacataacattgctcatggggtgaacctaaagaaatcccctgtacttcagtacttgtattatcttgctcagattggtcttgcaatgtctcccttaagtaacaactcactgtttatcgactatcatcggaaccctttcccaacattcttcttaagaggtcttaacgtgtctctttcgactgacgaccctctacaaattcacctgacaaaggaacctttggttgaagaatacagtgttgctgcttcactttggaagctgagctcatgtgacttgtgtgaaaacgctagaaattctgctaccagtccggtttctctcacaggctcaagtctcactggatcgggagaaactactacaaaaggggtccggagggcaatgacatccaccagacaaatgttcctcacatcagggttgaatttcgacacactatctggaaagaagaaatggagctgatacattttggaaatgttaaactacccgaagaaattgacaggtgaagagtacgggaattgtgattgccgtggcagtgaagtctggcagtggctgtgatcggggaggagaaaaggtgtcgacatgatcccgcctttcgatgaatctcttatttgcagaggtatatcatgactatgatgttgccaagggctactagtatactcactccgtgcctaggccataccatctataaagaataagtcagaaagcacaaatacactcctagtatttagaagcgttgaatccagatgtgccatgaggtgggaggcaacgcatcatgtacttcgttacgtttatactttatagacgtgtgtaatggtgggtggatcgacgaatgtctgtcatctagtatttgttagccaaattgcatgataaattaattagttatccaaaaaaaaacttatgttttatacttttaaaaaaatctttattaggtaaagaagtgagtaggcgcaccatgtaaatacaatgaaataggggttactg

SEQ ID NO: 3247 - DNA, 2682 bp, Manihot esculenta
atggatacttatacggtgcatctgaccatggcggcgctgttgggagcttcgctggtggcagtatcggcgtattatatgcaccgcaaaaccctaacacagttgctggagtttgcgaagacggtcgagagagaaagagagagggagagagatgataactctgatggagactcgccgcagcatttgaagaagcgccgtagtcatggccggaggaagggaaacggttactaccgtcgtggctctgcgtctttgccggatgtctctgccatttctggtggcggtggaggagtcgatggaatggagaagcgtaatggtccgctgcatgttgacgggattccccccgggttacccaggctccacacgctgcctgaaggatcagatgaagaagataatatgactgacagcactaagatagacattacatatatccataccaatggaaatgctgctgctggccctgagtgtaaaggcctgtttgacaatttgccaaaacaagttaatgccaacggagagcaaattcctatacctgcttcaagcatgattcgatcacatagtgtatctggtgacttgcatggtgtacagcctgatcctattgcagctgatattcttagaaaagagccagaacaagaaacttttgcacggcttaaaatttcccctactgaggtaccatctcctgatgaagtggagtcctacatagttctccaagagtgccttgaaatgcgaaaaaggtatgtgtttaaggaagcaattgctccatgggagaaagaagttatttctgacccaagtacaccaaagcctaatccagagcccttcttctatgctccggagggaaagtctgatcattactttgagatgcaagatggagtcattcatgtgtatgcagataaagattctcaggaagaactctttcctgttgctgatgcaacaaccttcttcactgatttgcatcacatacttcgagttattgcagctgggaatatcagaactttatgccatcatcggctgaatcttctagaacagaaattcaaccttcatttgatgcttaatgcggacagggagtttcttgctcagaaaagtgctcctcatcgtgacttctataatgttaggaaagtggatacacatgttcatcattcagcatgcatgaaccagaagcatcttttaaggtttattaagtcaaaattgaggaaagagcctgatgaggttgtcatatttcgggatgggacctacttgactttgaaggaagtgtttgaaagcttggatttgactggcaggtatgaccttaatgttgacctgttggatgttcatgctgataagagcacatttcaccgctttgataagttcaaccttaagtacaatccatgcggtcagagtaggcttagggagatcttccttaaacaggacaatcttatccaaggtcgtttccttgctgaggtgacaaaacaagtgttttctgatctttctgcaagcaaatatcagatggctgaatatcgaatatcaatatatggccgcaagcaaagcgaatgggaccaattagctagctggatagtgaacaatgaattgtacagtgagaatgttgtttggttaattcagcttccaaggctgtacaatgtgtacaaggagatggggatagtgacatcatttcagaacattcttgacaatatctttattccactctttgaggttactgtggatccagattcacatccacagttgcatgttttcttaaaacaggttgttggattggatttggtcgatgatgagagcaagcctgaaagacgtcccacaaagcacatgcctacaccagctcaatggaccaatgtgttcaatcctgcatattcatattatgtatattactgttatgccaacctttacactttaaacaagcttcgcgaatcaaagggcatgactactatcaaatttcggccacattctggagaggctggtgacattgaccaccttgctgctacatttctgacggctcataacattgcacatgggattaatttaagaaagtctcctgtacttcagtatttatactatctagcacagattggtctggcaatgtctcctcttagcaacaattccttatttttagactaccatcggaatccatttcctatgttcttcctacggggtctcaatgtttccctttcaactgatgatccactccagatccacttaacaaaggaacctttggtggaagaatacagcatagctgcttctgtctggaagttgagttcatgtgatctgtgtgagatagcgcggaattcagtgtatcagtcaggtttctcacatgctctaaagtcacactggattggaagagagtactacaagaggggcccagatggaaatgacattcacaaaacaaatgtgcctcacatccgggtggaatttcgtgaaacgatatggagagaggagatgcaacaggtttatcttggcaaggccattatccctgcagaactggacaagtaaatggcaaggccattcatgtataagtataaaggaagagaagaacgttgttaaaattttgagaaggcagaatacacctgatcatgcaaattgagaaccggaccaacatacaaagataagttgaacagggtctgaaaacaaacccaagaccatacatctgacaaaattgccggcttcgatgacatttggattacagcaataagatgccaacattgt

SEQ ID NO: 3248 - DNA, 3240 bp, Aquilegia formosa
cttcactctctcttcttcttggtttagggtttcgatttcatcttcttctttttctctaattcgaaacattttttcacaaatctttccatcaatggaaccatacacacttcatttagctatggcggcactagttggtgcatcatttgtagcagtttcagcttattatatgcatagaaaaaccctaactcaactacttgaatttgcaaaaacagttgaacgagaacgagaccgtgaattcagtagtggtgttggtgatggtgttggtgaagatgaacaagttgaaaaagacgattcacctcagcattataataatattaataagaagtattcagataaaagaaagaatcataataaacgtaataaagcttctaattattatcgtcgtgcttcaacttctttacctgatgttactgttatttccgatctagaagagaagcggaatggttctgtattacttgatgatcgtaatttctctattcctgctggtttgcctcgattacatactcttcctgaaggacaatctgttagtcgggcaagctgtgcaaagagatctggacatatgatcagaccaccttctcccaagtctcctgttgctagtgctagtgctttcgagagcctagaaggatcagatgaagaggataatctgactgataattctaaactagacaatggctatctacatgataacggaaatgggggagcagagtgtaaaagtttatttcaaaacatgccagatcaaaataacaacaaggtggaccaaaaccctcttcctgcagctagcatgatacgatctcatagtgtctctggtgatcttcatggtgttcagcctgatcctgtagcagcagatattctccgtaaagaacccgagcaagaaacatttgtacgccttagaatatcaccaactgaggtaccatcaccggacgaagcagaagtttatttggttctccaagattgccttcgtttgcgggagagttatgtgttcagggaagaggtcgctccttgggagaaagaagttataactgatcccagcacaccaaagcctaacccaaacccattttcatactctcctgaagggaaaactgatcactattttcagatggaagatggtgttgttcaagtttatgcgaacaaagattcaacagaaaagcttttccctgtagctgatgcaacaaccttttttactgatctgcatcgtatccttcgagtaactgcagctggcaatattcgaactttgtgtcatcatcgactggttcttcttgagcaaaaattcaatcttcatctgatgcttaatgcggacagagagtttcttgcccagaaaagtgccccacatcgtgatttctataatgttagaaaagtggatacacacgttcatcattctgcatgcatgaatcagaagcatctattgaggtttataaaatcaaagttgagaaaagagcctgacgaggttgttattttccgagatggaacatatcttactttgaaagaagtttttgagagtttggatttgactgggtatgacctcaatgtggatctgctagatgttcatgctgataagagtacatttcatcgatttgataagtttaatcttaaatacaatccttgtggacaaagtaggctaagggagatatttcttaagcaggataatcttatacaaggtcgttttcttggtgagctaacaaagcaggtgttttcagatctaactgcgagtaaataccagatggccgagtatcgtatatcaatctatggaagaaagcaaagtgagtgggaccaacttgcgagttggatagtaaataatgatctgtacagtgaaaatgtcgtgtggttgattcagcttccacggctttacaatgtatacaaagaaatgggaattgttacttctttccaaaatattttggataacatttttcttccactttttgaggttactgttgatccggattcacaccctcagttgcatatcttcttaaaacaggttgttgggttagatttggtggatgatgaaagtaagcctgagagacgaccaacaaaacacatgcctacaccagctcaatggaccaatatctttaatcctgcattctcatactatgtgtattactgttatgcgaatctgtacactctgaataagctccgtgagtcaaaaggcatgacaaccatcaaattgcgtccacactcaggcgaggctggtgacatagaccacctggcagcaaccttcctcacatcccacaatattgcgcatggaatcaatttgagaaaatctcctgttcttcaatacttatattaccttgcacagattggcttggctatgtctcctctgagtaacaattctttatttctggattatcatcgaaatccttttccaatgtttttcctacgtggcctcaatgtttccctatctacggatgatccattacaaattcatttgacaaaagaacctttggtggaagagtatagtattgcagcttcagtatggaagttaagctcgtgtgatctatgtgagattgcccgaaattcagtctaccaatcaggattttcgcatgctctgaagtctcattggattggaaagtcatactataagagaggtcctgatgggaatgacattcacaagacaaacgtccctcatattcgggttgaattccgtgacacgatttggaaggaagagatgcaacaggtttatctgggaaaagctcaaatacccgaagttgtggatgaataaagagaaagatgcatctaattctctattcgttatgatcatatatattattggcatgaagaaactgaaggaacctaatttgtgttcatcatctagcatcaaagcaaagctgttgaaacacacgtgaggaaattgagcattggctgccacaagctgagagaagcaagtaattgacatgtgtggagattttggcccggggatgcatatatcatcaataagaaacatattgacaaaaggaaatatcaaggcaaccatgtatggtgctcctgtgatgccctccaaaagagtacaaaagcaagcagttgctttctatactaagtagtattttagactccgtaggaaggtgaacctttttgtcgtgcagttagttttctttatattgttacatttcccatacaaggtggagcaaaaatgaattcatttataatttttgcttttattgtcatagaaatgaatttgcgattggcaagtctttatctactgatgtatcaaaagggagatctctcctattctaacagcagtttttaatg

SEQ ID NO: 3249 - DNA, 3124 bp, Fragaria vesca
atggagtcttacgcggtgcatttggccatggcggctctggtaggggcttcgctggtcgcggtctcggcttactatatgcaccggaaaaccctaactcagctgctggagttcgcgaagacggtggagagggagcgggacgagaactccgacggcggcgacgccgactcgccgcagcagatgaggaagcgtaggggacaacggcgcaagggcggcggttattaccggcgcggctcggggtcgttgccggacgttacggcgatttccggcggggttgacggtaacggaatggtggacggtattccggctgggttgccgaggctgcacacgcttccggaaggaaaatctgctgaccatgtgggttcaactaagaggactgctatccgagctgtttctccaaagtctccagttgcaagtgctagtgcctttgagagtgttgaaggttcagatgatgaagataatttgactgacaatgccaaagtatatcatgctaatggcaatgcggggcctgatttaccaaaccatgttactaccaatggagagcaaattgctatagctgcttcaagtatgattaggtcacattctgtatctggtgatctgcatggtgtccagcctgatccaattgcagctgacattctaaggaaagagcctgagcaagaaacttttgcgcgacttcaaattactcccactgaattaccatcatctgatgaagtagaggtctatgtggttcttcaagaatgtcttgaactgcgaaagagatatttattcagtgaggcagttgctccgtgggagagagaagttatatctgatcccagtaccccaaagcctaacccagaaccatttttctacacttctgagggaaagtctgatcatcattttgagatgcaagatggagtaattcacgtgtatccaaataaagattcaaaagaagagctttatcctgttgctgatgcaactacctttttcactgaccttcatcacatacttcgagttatagcagcagggaatataagaactttatgccatcatcggttgaatcttctggaacaaaaattcaatcttcacttaatgcttaatgcggataaggaatttctggcccaaaaaagtgccccacatcgtgatttttataatgttaggaaagttgatacccatgttcatcactcggcatgcatgaaccagaagcatcttttgaggtttataaagtcaaagttgaggaaggagcctgacgaggttgtaatatttcgagatggaacctatttgaccttaagagaagtttttgagagtctggatttgaatgggtatgacctgaatgtggaccttttggatgttcatgcagataaaagcacatttcatcgttttgataagttcaatctgaagtacaacccctgtggtcaaagtaggctcagggagattttccttaagcaggataatcttatccaaggccgtttccttgctgagctgacaaagcaagtgttctctgatctttctgccagtaaatatcagatggctgagtacagaatatcaatatatggcaggaagcaaagtgagtgggaccaaatggctagttggatagtgaacaatgaattgtacagtgagaatgttgtatggttgatacagctgccacggctgtacaatatatacaaggaaatggggatagtcacatcatttcagaatattcttgacaatatattcataccactgtttgaggttaccgtagatccagattcccacccgcagttgcatgtttttctgaaacaggttgttgggttggatttggttgatgatgaaagcaaacctgaaagacggcccacaaaacacatgccaactccagcacaatggacaaatgttttcaatcctgcattttcatactacgtgtactattgttatgctaatctctacacattaaacaagcttcgcgaatcgaagggcatgacaaccatcaaattccgtccacattctggggaggctggggacattgaccaccttgctgcaacgtttcttactgcaactaacattgcacacggaatcaatttgagaaagtctcctgtgcttcaatatctgtattatctagctcagattggtctggctatgtcacccctgagtaacaattcactgttcttggactaccatcgcaacccttttcctgtatttttcttacggggtcttaacgtgtctctctctactgatgatcctcttcaaatccacttaacgaaagaacccttggtagaagaatatagtatagctgcttctgtatggaaattgagttcatgcgatctatgtgaaattgcccgtaattcagtttaccagtcaggtttctcacatgcgttgaagtcacactggattgggagagagtactacaagagaggtccagatggaaatgatatccacaaaacaaatgttccccatatccgggtggaattccgtgaaacgatctggagggaggagatgaaacaagtttatcttggcaaggctagaatccccagagaagttgacagataaggaggtcccaaggggtgtgaaacgttgatactgcaccggaatagttactgtagatgtgaggaattttctgctcatgcctatacatccatgcaagctgagaattggcttggcaaaaggcggagtctaagaatgagaggcgcgtgtatgatactgcatgtcaagattacgaactctgcactgtctcggacagtgtcaagatcacaaatagggtcaagacgccgataggcttcaaaaaattagtagtggttttacatgtagtgttagttcaaattttagactactgtacgtctgtacaccaagtgttatacttaagtaggaagcttatctccggtgaggaaggaaaattctctcttcctcagcttgtgttctccaattatgttcacttgttcagtagtttgagatagatgctgtagatgttaaagcagaacaagcacaaatgggatgtggtgaaccaacatctccaccatcccttgataactagtagcaattttcttttggttttgtcccggatgttagatggttccaatgagaaaagaaccaatagagtacttcatttgcgatatcaattctatctgtaactatcgcagttgtgaaacgaacaaatggttcatcaatccagtccctcgac

SEQ ID NO: 3250 - DNA, 2022 bp, Quercus alba
aaataaggattctaaagaagagcttttcccagttgctgatgcaacaacctttttcactgatctgcatcacatacttcgagttattgcagctgggaatattagaactctatgtcatcatcggcttaatcttctggaacaaaaattcaatcttcatttgatgcttaatgcggatagagaatttcttgctcagaaaagtgctccacatcgtgacttctataatgtcaggaaagttgatacgcatgttcatcactcagcgtgcatgaaccagaagcatcttttaaggtttataaagtcaaagctgaggaaagagcctgatgaggttgtaatttttcgagatgggacatatctgaccttgaaagaagtatttgagagcttggatctaactgggtatgatctgaatgttgaccttttggatgttcatgcagacaagagtacttttcatcgctttgataagttcaatcttaagtacaacccctgtggtcaaagtaggctccgggagattttccttaagcaagataatcttatccaaggtcgtttccttggcgagctgacaaagcaagtgttttctgatctcgatgcgagtaaatatcagatggctgaatacagaatctcaatatatggtaggaagcaaagtgagtgggaccaaatggctagttggatagtgaataatgaactgtacagtgagaatgttgtttggttgatccagcttccacgtctgtacaatgtgtacaaggaaatgggaattgtgacatcatttcagaacattcttgacaatatctttattccattatttgaggttactgtggatccagattcacatcctcagttgcatgttttcttgaaacaggttgtgggattggatttggtggatgatgaaagtaagcctgaaagacgtcccacaaaacacatgcccacacctgctcaatggactaatgtattcaatccagcattttcatactatgtgtattactgttatgctaacctatacacactaaacaagcttcgtgaatctaaaggcatgacgacaataaaattccgtccgcactctggggaggctggtgacatcgaccaccttgctgcaacctttcttacagctcataatattgcacatggaatcaatttgagaaaatcgcctgtactacaatatctgtattatctagcacagattggtctggccatgtctccattgagcaacaactcgttatttttggactaccatcggaatccctttcctacttttttcttacggggtctcaatgtttcactttcaactgatgatccactgcaaattcacttaacaaaagaacctctggtggaagaatatagcatagctgcttcagtgtggaagctcagttcatgtgatttatgtgagatcgcccgtaattcagtctaccaatcaggtttctcacatgccctcaagtcacactggattgggaaagaatactacaagagaggaccaagtggaaatgacatacatagaactaatgtgcctcatattcggttggaattccgtgatacgatctggagagacgagatgcgacaagtttatctgggcaagccgattatccctgaagaagtggacaagtgatgtgcaaggcaaatgaacctaatccatccttgaatatcaatatgtttttagaggaggcaaggaacttgcattacacttgctcatctgcataaaagagaatacatatgaaactgacgctctagctgaaatttggcttggcacaagtggcatgataacagaagttaaacctggtctgaagatgaggtagcaatgcacatcatgggtattgtattatggtcgatccgcattatctcatgcagattctcaatctggaatatagcctatagcaacaagatctcaatctcttctctgagcaaataatggaagtggttttgtagtaacaatggcagagtttagaacaataattagatacatcttaggcctttttttttttggctgttgcagcaaagttatatgtaaaatgctatcatgtaatgcttacccatggcaagaag

SEQ ID NO: 3251 - DNA, 3075 bp, Ricinus communis
aaaaacacacaggaaaaaaaaagagagagagagagaactctttcctcttccctctatagctctctctactgttattcaggagctttctaatttggcttctcatttcgacctctactgttttccagtactctactgtaaaagtgtctatacataaacacagagagagagagagagagagagagagagagagagattgttctagagagagaaagtgatggatacaaattatacagtgcatctagcgatggcggcgctagtaggagcttcactagtggcagtatcggcatattatatgcatcgtaaaaccctaactcagttgttagaatttgcaaagactgttgagagagatagagatgataataactcggatttagactcgcctctgcatttaaagcagaagcgccgtagccatcacggtggtggtggtcggagaaaggggaacggttattaccgtcggggctctgcttctctgccggatgtaactgtcatttctgctggcgatggagaggagaaacggaatggaaaagctgctagtcatccaaagagatctggaaatcttattagaccaacttctccaaaatctcctgttgccagtgccagtgcctttgaaagtatggaaggatcagatgaagaagataacctcactgacaattccaagctggatacggcatatctgcataccaatggaaatgctgtaactgaacacattaatgccaatggggagcaaatccctatacctgcttcaactttgattcgatcgcatagtgtatctggtgacctgcatggtgttcagcctgatcctattgcagctgatattctaaggaaagagccagaacaagaaacttttgcacggcttaaagttacgcccactgaggtgccatctcctgatgaagtggagtcctatatagttcttcaagaatgtcttgaaatgcgaaagaggtatatattcaaggaagcaattgctccgtgggagaaagaaattatttctgaccctggcacaccgaagcctaatcctgatccattcttctatgccccagagggaaaatctgatcattattttgagatgcaagatggggtcattcatgtctatccaaataaagattgtaaggaagagctctttccagttgctgatgcaacaactttcttcactgatttgcatcacatacttagagttattgcagctgggaatatcagaactttgtgccatcatcgactaaatcttcttgagcaaaaattcaaccttcatttgatgcttaatgcggatagggagtttcttgctcaaaaaagtgcccctcatcgtgacttttataatgtcaggaaagttgatacacatgttcatcattcggcgtgcatgaaccagaaacatcttttaagatttataaagtcaaaattgaggaaagagcctgatgaggtcgtcatatttcgggatgggacatacttgactttaaaagaagtttttgagagcttggatttgactgggtatgacctaaatgttgaccttttggatgttcatgctgacaagagcacatttcatcgctttgataagttcaacctcaagtacaatccatgtggtcagagtagactcagggagatttttctgaagcaggataatctcatccaaggtcgtttcctcgctgagctgacaaaacaagtattttctgatcttggtgcaagtaaatatcagatggctgaatatcgaatatcaatatatggtcggaagcagagtgaatgggatcaattggcaagctggatagtgaataatgaattatacagtgagaatgttgtttggttaattcagcttccaagactgtacaatatctacaaagagatggggatcgtgacatcatttcagaacattcttgacaatatattcattccactctttgaggttactgtggatccagattcacatcctcagttgcatgttttcttgaaacaggttgttggattggatttggttgatgatgaaagtaagcctgaaagacgccccacaaagcacatgcctacaccggctcaatggacgaatgtgttcaatcctgcattttcatattatgtgtattattgttatgccaacctgtacacgttaaacaagcttcgtgaatctaagggtatgaccaccatcaaattccgcccacattctggagaggctggtgacattgaccaccttgcggcaacatttcttacgtctcataacattgcgcatgggatcaatttgaggaaatctcctgtgcttcaatatttatactatctagcacagattggtctggcaatgtctcctctgagcaataattcattatttttagactaccatcggaacccttttcctatgtttttcctgcgcggtctcaatgtctccctgtcaacagatgatccactccaaatccacctgactaaagagcctttggttgaagaatatagcatagctgcttctgtatggaagttaagttcatgtgatctgtgtgagattgcccgtaattcagtctaccaatcaggtttctcacatgctttgaagtcgcactggattgggaaagagtactacaagagaggacctgatggaaatgacattcacaggacaaacgtgcctcatatccggttggaattccgtgatacgatatggagagaagagatgcggcaggtttatcttggcaagcctgttattcctgtcgaggtggacaagtaaatagcggggaatcacctgcagccccatccttaacgtgtgattgtaaaggttctctaggaaatcatcatttcctgctggcatgataaatttttaaaggagggcaatatggccccctaatcatgcaaagtgagaagtagcaaatcttggatcaaacatgccaagaggggttgatcgagattggagaaccaagaccaattatgatgacaaaatgaaattgttaagactttgagtttgagagctgaaatctgtaggaccgcaacaaggggcgatcttgtggcagctgaaataactgtgtaatctatattattacatgtagcttagtaaaatcatgtcatacatcaaaggatgaattttgtggtgtttttagaatataataaagacgatgtattccaaga

SEQ ID NO: 3252 - DNA, 1844 bp, Vigna unguiculata
gatcacaggctcaatcttctagaacaaaaattcaatcttcatttgatgctaaatgcggatagagaatttcttgctcagaaaagtgctccacatagagacttctataatgttagaaaagttgatactcatgtccaccattcagcatgcatgaatcagaagcatcttttaagattcataaagtcaaagctgagaaaagagcctgatgaggttgtaatatttcgtgatgggacatatctaaccttgaaggaggtcttcaagagtttggatttaactgggtatgatctcaatgttgaccttttggacgttcatgctgacaagagcacttttcatcgctttgataagtttaatcttaaatacaatccttgtggtcaaagtaggctcagggagatatttctaaaacaggataatctcattcaaggtcgttttcttggtgaggtgactaagcaagtgttttcggatcttgctgccagtaaatatcagatggccgaatatagaatttcaatatatggtaggaagcaaagtgagtgggaccaactagccagttggatagttaataatgacttgtacagtgagaatgttgtttggttgattcagcttccgcggttgtacaatgtatacaaagaaatgggaattgtgacatcattccagaacatgcttgacaatatttttattccactttttgaggttactgtcgacccagattcacatccacagctgcatgttttcttgaaacaggttgttgggttggatttggtggatgatgaaagcaaacctgaaagacggcccacaaaacacatgcctacacctgaacaatggactaacgtgtttaatccggctttttcatactatgtctattactgttacgcaaatctttacaccttaaacaagcttcgtgaatcaaaaggaatgacaacaatcaaattccgtccacattctggagaggctggtgatatcgaccatcttgcagcaacctttctcacggctcacaacattgcacatggaatcaatttgaaaaaatctcctgttcttcaatatttatattatttagcccagattgggctggcaatgtctcctttgagcaataactccctattcttagactaccatcggaatccttttccaatgttcttcttaaggggtctgaatgtgtccctttctactgatgatcctctccaaattcacttaacaaaggaaccattggttgaagaatatagtatagctgcttctgtctggaagttgagctcctgtgatttgtgtgagatagcccggaattctgtatatcaatcaggtttttcacatgctttaaagtcacattggattggtaaggagtactacaagagagggccaaatggaaatgacattcagagaacaaacgttcctcatatacggttggaattccgtgatacgatttggaaggaggagatgcaacaggtttatctgggcaaagcagtcattcctgaagaagtagagaaataagatgtgagaggcaggttaggtagagaactcaaacccatgttgcatcagagatattctaaggccgaagacattataacactggttggatgatacgaaccaaatacatactatagagaatcatcaatatggctgagcttgagcatcgagcaatgtttacagctacaaatcaacggacccctgcgaaagtttttgcttgtatgattttgggttagtaataaatgcatgcttcaagcaaattcatgcctgtttgtgttggaatgtaagctatgatccttggaaagggggacattcatctcccaaaattttgattcgcaatgtttatccatatatatagtacactccactcgaaacttgaaggacggttgccc

SEQ ID NO: 3253 - DNA, 1778 bp, Castanea mollissima
caagtaaatatcagatggctgagtaccgaatatcaatatatggtaggaagcaaagtgagtgggaccaaatggctagttggatagtgaataatgaactgtacagtgtgaatgttgtttggttgattcagcttccacgtctgtacaatgtgtacaaggaaatgggaattgtgacatcatttcagaacattctcgacaatatcttcattccattatttgaggttactgtggatccagattcacatcctcagttgcatgttttcttgaaacaggttgtgggattggatttggtggatgatgaaagtaagcctgaaagacgccccacaaaacacatgcccacacctgctcaatggactaatgtattcaatccagcattttcatactatgtgtattactgttatgctaacctatacacactaaacaagcttcgtgaatctaaaggcatgacgacaataaaattccgtccgcactctggggaggctggtgacatcgaccaccttgctgcaacctttcttacggctcataatattgcacatggaatcaatttgagaaaatcgcctgtacttcaatatctgtattatctagcacagattggtctggctatgtctccattgagcaacaactcgttatttttggactaccatcggaatccctttcctacttttttcttacggggtctcaatgtttcactttcaactgatgatccactgcaaattcacttaacaaaagaacctctggtggaagaatatagcatagctgcttcagtgtggaagctcagttcatgtgatttatgtgagattgcccgtaattcagtctaccaatcaggtttctcacatgccctcaagtcgcactggattgggaaagaatactacaagagaggaccaagtggaaatgacatacatagaactaatgtgcctcatattcgggtggaattccgtgacacgatctggagagaggagatgcgacaagtttatttgggcgagctggttatccctgaagaagtggacaagtgatgtgcaaggcaaatgtacctaatccatccttgaatatcaatatgtttttatagaaggcagggaacttgcattacacttgctcatctgcataaaagagaatacatatgaaactgacgctctggctgaaatttggcttggcacaagcggcatcttaacagaagatgaggtagcaatgcacatcatgggtattgtattatggtcgatcccacaatatctcatacagattctcaatctagaatatagcctatagcaacaagatctcaatctcttctctgagcaaataatggaagtggttttgtagtaacaatggcagaggttagaacaataattagatacatcttaggccttttgtattttgcattttttgctgttgcagcaaagttttatgtaaaatgctatcatgtaatgcttacccatggcaagaagggaaattggtctcttactaatgtactgttcccatacaagatgaactgtttcctacaatcaatacattttgctaattgatagaaaaggctaaaagctgaaaaccgattttctccctgctacagcattgagctcgtcttcaattaagcttgtgtacgctcatgcaaatttggagcttttgagtgcaatggtagaatgacaaggtcatgcagattatcttgtttatagtctgtttcactgtaccccttttgtatgagggcaagatttaggtacaacattttggtattgttctttgggtttctcttgtaagattttgtcatttggattttttttataaaatgaaag

SEQ ID NO: 3254 - DNA, 3093 bp, Malus domestica
gcactatccctgttctctctctctgctcgcctcagctctttcagtagggttttgttttctctctctagaactcgcacaatccaatcggacagacattttctctctcctgattccctgtcctcggcagggcggaagcgtgagcgagagatatggagtcgtacgcgctacatttggccatggcggctctggttggagcttcggtggtggctgcgtcggcctattacatgcaccgcaaaaccctaactcagcttttggagttcgccaagacggtggagaaggagagggagggtgactccgacggcggtggcggtggcgactcgccgcagaacatgaagaagcgtaggagtcacgcgcggcgcaagggaaacggatattaccggcgaaacgcggcgtctttaccggacgtgacggcgatttctggagggattgacggtgatgatcataggcgcaacggatttctacccgtcgacggtattccggccgggttgccgaggctgcacactctcccggaagggaaatctactgagcttgcgaattcagttaagagaaccggtagtcttatccgaccaatttctcccaagtctccagttgcaagtgcaagtgcctttgagagtgtagaaggatcagatgatgaagacaacatgactgacaattctaaacttggcacggaggggccagatggtaagataatatatgaaaatttaccgaaccatgttaatgccaatggagagcaaatacctatagctcctacaagtatgattaggtcccatagtgtatctggtgacctgcacggtgtccagcctgatccaattaccgctgatatcctgaggaaagagccagaacaagagacttttgcacgacttaaaattactccaattgaagtgccatctagcgatgaagcggaggtctatgtggttcttcaagaatgcctcgaattgcgaaaaagatatttattcactgagacagttgctccgtgggagaaagaaattatatcagacccaagtaccccaaaacctaacccagctccattttcttatacttctgaggggaagtctgatcattatttcgaaatgcaagatggggttgttcatgtgtatccaaataaagactcaaaagaactttttcctgttgctgatgcaaccacctttttcactgacctacatcacatactccgagttacagcagcagggaatatcagaactttatgccatcatcggctgaatcttctggaacaaaaattcaatcttcacttaatgcttaatgcggatagggagtttctggctcagaagagtgctcctcatcgtgacttttataatgtcagaaaagtagatacacatgttcatcactcagcatgcatgaaccagaaacatcttttgaggtttataaaatcaaagttgaggaaggagcctgatgaggttgtaatatttagagatggaacctatttgaccttgaaagaggtttttgagagtttggatttgactgggtacgacctaaatgttgaccttttggatgttcatgctgacaagagcacgtttcatcgttttgataagtttaatcttaagtacaacccctgtggtcaaagtaggctccgggagattttccttaagcaggataatcttattcaaggacgtttccttgctgagctgacaaaacaagtgttttctgatcttgctgccagtaaatatcagatggctgagtacaggatatcgatatatggtaggaagcagagtgagtgggaccaaatggctagttggatagtgaacaatgaattgtacagtgagaatgttgtttggttgattcagctgccccggctgtacaatatatacaaggaaatgggaattgtaacatcatttcagaacattctcgacaatatctttattccactgtttgaggttactgtagatccagattcccatccacagttgcacgttttcctgaaacaggttgtggggttagatttggtggatgacgaaagcaaacctgaaagacgccccacaaaacacatgccaacgccagcacaatggaccaatgtattcaatcctgcattttcatactacgtgtactactgttatgctaatctctacacattaaacaagcttcgtgaatctaagggcatgacgacaatcaatctccgtccacattctggggaggctggtgacattgaccaccttgctgcaacctttcttaccgcaactaatattgcgcatggaatcaatttgagaaaatctcctgtacttcaatatctgtattatttatcccagattggtctggctatgtcacccctgagcaacaattcgttgtttttggactaccatcggaatccttttcctatgtttttcttacggggtcttaatgtttctctctccaccgatgatcctctccaaatccacttaacaaaagagcctttggtggaagaatatagtatagctgcttctgtttggaaattgagctcatgtgatctatgtgaaattgcccgtaattcggtctaccaatcaggattttcacatgcattgaagtcgcactggatcggcagagagtactacaagagaggaccagatggaaatgatatccacagaacaaatgtgcctcatatccggttggaatttcgtgatacgatctggagagacgagatgcaacaggtctatctcggcaaggccattatcccaaaagaagtcgacaggtgaatcccaaaggcatgtgcagctttaaccccttcttgaagagtaatctgataccggaggtgaggaagttgcatctatgcccccgtacctgtgtgaaagtatgataatcatggaaactgagatgacaggcaccggagaagacgcgcaatcacaaggcaaactgggtcgagaaatgaggtggacatgtatatgctcaatcaaaaattacaaacagcgagaaaacccgactataatagccttagttaaataagaagtggtttttgtacccaagttaattagggttagtttaataattagcttcaatgtcacctaaatactctactgtcgcagttagttttatgtaaaaccatgtaagatgtcaccgtacaaaggcttatagagcgcaagctgtcgatatgcttcattgttcttc

SEQ ID NO: 3255 - DNA, 1893 bp, Tropaeolum majus
gataaggaatttcttgctcagaaaagtgcaccacaccgtgacttttataatgttaggaaagtggatactcatgttcatcattcagcatgcatgaaccagaaacatctattacggtttattaagtcaaagttgaggaaggagcctgatgaggttgtaatatttcgagacgggacatacttaaccttaagagaagtttttgagagcttggatcttacggggtatgatctgaatgttgaccttttggatgttcacgctgacaagagtacttttcatcgttttgataagttcaatcttaagtacaatccttgtggccaaagtaggcttagggagattttcttaagcaggataatcttatccaaggtcgtttccttgctgagttgacaaaacaagtgttttctgaccttgaagctagtaaatatcagatggctgaatacaggatatctatatatggcaggaagatgagcgagtgggatcagatggctagctggattgtgaacaatgaattatacagtgagaatgttgtttggttgattcagcttccacgtctttacaatgtgtataaggaaatggggatagtgacatccttccagaacattcttgacaatattttcattccactctttgaagtcactattgatccagattcacatcctcagttgcatgtttcctgaaacaggtcgtagggttagatttggtggacgatgaaagcaagcctgaaagacgccccacaaaacacatgcccacaccggcacagtggactaatatattcaatcctgcattttcttactatgtttactactgttatgctaacctctacacattaaacaagcttcgtgagtcaaagggcatgacaacaatcaaattgcgtccacattctggagaggctggtgatattgaccaccttgctgcaacgtttcttacttctcataatattgctcatggaatcaatcttagaaaatctcctgtgcttcagtatctttattatcttgcacagattggtctggctatgtctcctctgagcaacaattccttatttctagactaccatcggaaccctcttcccatgtttttccttaggggcctaaatatttcactttctactgatgacccgcttcagatccacttaacgaaagaacctttagtggaagaatacagcatagccgcttctgtgtggaagttgagttcatgcgacctatgtgagattgctcgtaattctgtctaccagtcaggtttctcacatgctctcaagtcacattggattggaaaagaatactacaagagaggacctgatggaaatgatattcacaaaacaaatgtgcctcacattcgcgttgaatttcgtgacacgatctggagggaggagatgcaacaagtttatttggggaatgcaataatctctcccgaagtagacagatggtgatgcagatgatgggtggtgttaatatcactagtgatagttgagaacatttgcaatgaggtgctaagaactttgggttatattatcgaacccatggaggttaaatctgggatttgcatatggaattggtgaggagaagttgaagatgtacaatattatgtatattcccataaagctggaggtctggatacaacgtgatagcaacaagatgccagttttgcattcaggcaaataagtaaaaaggtcatctgaatattttattaccagttaaatgtggagggaaaataatttagtaatctgcatcgtaggcttatagaagcgaacttttggtatattatgtaatatgtcaactcacacgtttatctttttcttggtcataagtgttaaagaccaggaagacttcgtcttcataaaattttggaaataatctttgctaataattattatgcttttggattgctgaaaaaaaaaaaaaa

SEQ ID NO: 3256 - DNA, 2574 bp, Glycine max
atggatacgcacgcggtgcatttggccctggcggcgctcgtcggagcctccgtcgtggccgtgtcggcgtactacatgcaccgcaagacgctggcgcagctgctggagttcgcgcgtacggtcgagagggaggctgacgccggcggctccgacgctgaatcgccgccggcccacgcgaagaagcgccggggcagctccaggaagcgccgcaacggcggataccgccggggctccgcgtcgctgccggacgtcacggcgatctctggcgggttcgacggggacgagaagcggaacgggccggtgcacgtcgaggggattccggcggggctgccaaggttgcacacgctccgggaaggaaaatcatcccaatctggttcctttaagagaagtcttttaagaccaacttctcccaagtcccctgttgcaagtgccagtgcctttgaaagtgtagaaggatcagatgatgaagataacatgacagacaaagttaaacttgatactacatatctgcatgcaaatgggactgttggtccagaaggtaaaatcccatttgagactttacctaatcatgttaatgccaatggagagcagatggcaattacaccgagtatgatccgctctcatagtgtttctggtgacctgcatggtgtgcagcctgatccaatagcagctgacattctgaggaaagagccagagcatgaaactttcacaagattgagaataactcctcttgaggctccgtcacctgatgaaattgaagcttatgtggttctgcaagaatgccttgaaatgagaaaaagatatgtttttagagaagctgttgctccgtgggataaagaagttatatccgaccccagcacacccaagcctaacccagatccatttttatacattcctgaaggaaattctgatcattattttgaaatgcaagatggggttattcgtgtatatccagatagagatgcaaaagaagagctttttcctgtagctgatgcaactacatttttcactgatcttcatcacttacttcgagtcatagcagcagggaatataagaactttatgccatcataggctcaatcttctagaacaaaaattcaatcttcatttgatgctaaatgcggatagagaatttcttgctcagaagagtgctccacatcgagacttctataatgttagaaaagttgatactcatgtccaccactcagcatgcatgaatcagaaacatcttttaaggttcataaagtcaaagctgagaaaagagcctgatgaggttgtaatatttcgagatgggacatatctaacgttggaagaggttttcaagagtttagatttgtctggatatgacctcaatgttgaccttttggacgttcacgcagacaagagtacttttcatcgctttgataagttcaatcttaaatacaatccttgcggtcaaagtaggctcagggagatatttcttaagcaggataatctcattcaaggtcgttttcttggtgagttaactaagcaagtgttttcagatcttgctgccagtaaatatcagatggctgaatatagaatatcaatatatggtaggaagcaaagtgagtgggaccaactagccagttggatagtgaataatgatttgtacagcgagaatgtcgtttggttgattcagcttccacggttgtacaatgtgtacaaagaaatgggaattgtgacatcattccagaacatgctcgacaatattttcattccactttttgaggtcactgtcaacccagattcacatcctcagctgcatgttttcctgaaacaggttgttgggttggatttggttgatgatgaaagcaaacctgaaagacggccaacaaaacacatgcctacacctgagcaatggactaatgttttcaatccggcattttcatactatgtctattactgttatgcaaatctttacaccttaaacaagcttcgagaatcaaagggaatgacaacaatcaaattccgtccacattctggagaggctggtgatattgaccaccttgcagcaacctttctcacggctcacaacattgcacatggaatcaatttgaaaaaatctcctgtgcttcaatatttatattatttagcccagattgggctggcaatgtctcctttgagcaataactccctattcttagactaccatcggaatccttttccaatgttcttcttacggggtctgaatgtgtcactttctactgatgatcctctccaaattcacttaacaaaggaaccattggttgaagaatatagcatagctgcttctgtgtggaagttgagctcatgtgatttatgtgagattgcccgtaattcagtttatcaatcaggtttctcacatgctttaaagtcacattggattggtaaggagtactacaagagtgggccacgcggaaatgacattcagagaacaaacgttcctcacatccggttggaattccgtgatacgatttggaaagaggagatgcaacaggtttatttgggcaaagccatcattcctgaagaagtagacaaataagatgtcagggggcattcctttcatacacatgag

SEQ ID NO: 3257 - DNA, 2263 bp, Aristolochia fimbriata
cttgagttgcgagagagctatatttttagggaagaggtgcctccttgggaaaaagaagtaattactgaacctggcaccccaaaatccaaccccaatccatttgcgtatgttcctgagaagaaaactgatcatcactttcaaatggaagatggagtagtgtatgtttatgccaataaggattcaactgaaaggctcttccctgttgtggatgcaacgacatttttcactgatctgcatcgcatccttaaagtaattgctgctgggaatatccgaacactgtgccaccatcgcttggtccttctagaacaaaaattcaatcttcatctgatgctcaatgcggatcgagagtttcttgctcaaaaaagtgcacctcatcgtgacttctataatgtgagaaaagttgacacacatgttcatcattcggcttgcatgaatcagaaacatctattgaggtttataaagtcgaaattgaggaaagaacctgatgaggttgtgatatttcgggatgggacatatcttacactgaaagaagtttttgagagtttggatttgacagggtatgacctgaatgttgatctgttagatgttcatgctgacaagagtacatttcatcgatttgataagtttaacctcaagtataatccttgtgggcagagtaggcttagagagatttttctgaaacaggacaatctcatccaaggtcgtttccttgccgagttgacgaagcaagtgttctctgaccttggggctagtaaataccagatggcagaatatagaatatcgatatatggaaggaaacaaagtgagtgggaccaacttgctagttggatagtgaacaatgagttatacagtgataatgttgtttggttgattcagcttccacgcctgtacaatgtgtacaaggaaatgggaatagttacttctttccagaacatccttgacaatatttttcttcctctgtttgaggttacggttgatcctgattcacatccgcagttgcatgtcttcttgaagcaggttgttggtttggatttggtagatgatgagagcaagcctgaacgacggccaactaaacacatgcccactcctgaacagtggacaaatatattcaaccctgcttattcatactatgtctactactgttatgcaaacttgtacacattaaataagcttcgtgagtcaaagggcatgtcaaccatcaaatttcgtcctcattcaggggagactggagacattgatcacctagctgcaacatttcttactgctcataatattgcacatggaattaatctgagaaaatctcctgtgcttcaatatttatattatcttgcacaaattggcttagctatgtcaccattgagcaataattccttatttttggactaccatcggaatccttttccaatgttcttcttaagaggtcttaatgtttctctttcaactgatgaccctttgcaaatacacttaacaaaagagccactggttgaggagtacagtatcgctgcttcagtgtggaagcttagttcatgtgatttatgtgagattgcccgaaattcagtttatcaatcaggcttttcccatcctctcaagtctcattggattgggaaatcttactacaagagaggtccagatgggaatgacattcacaagacaaatgtgcctcatattcggcttgaatttcgtgatacaatatggagagaagagatgcaacaggtttacttgaggaaagctaaaatctgtgaggaaatagataactgagatgctaaaggagtactaacactaagcagtcgttattggatgatcctccataaatccccgttctttgccttagaatgccacccctgagggtcctaatgagcgtttgagaaggcctttcaggttggaattcttgccccgtaaatgcgaaggattagcaagaagaggatgtgcgagtggccaaggaatgtgtacgataagtgtaagatagagatctcaaaaaccaccagagatcagagaacgaggcgttatacacaggaaattgaacgacggccatcactgtattgccgtaataaactgaagggtgttttgttgaaataaactgtcttgctcagaatctaatgtggatagttccccttctgtaaatgtttatataatgttttgtgccagttcctttatgttaaatctcgtttttttcctttggatatggacctgatgaaagaattacagaaggggttcgatcattgcccatccaataggagggagtcgaaatccccctctcgcacga

SEQ ID NO: 3258 - DNA, 3131 bp, Brachypodium distachyon
atggacgattcctccgcctcctcctacaagctgcagctctccgtcgcggcgctcgtgggcgcctccgcggccgccgcatccgcctactacctgcactgccgcgccgtcgcgcagctcggcggcgacatcgtccgctcctcaaccgccgccgcaaaaagcggcctgcagcggcggcgccaccgcgaggccggaaagccccctcccccccgccgcacggccgccggctcctcctcgctccccgacctctctgccatctacgccgccggcggtgtcgccaggggttaccccgtgggggaggagtacgacgacgatgaggaaggggtgggcccgtacgtggacgacgcgctcaccgccgccgccgcctgcatgcagatccccgagggcttgccaaggctgcaagtggggcctgacggcaacaaacaacttggtcgttcaagttcaaacagacgggttggattaatcagaccaaatttacccaagtccgttccgggtgcaagtacttttgagagtgtagagggatcagatgaggatgtcgccatgaagatcagtggcaaacttgataatggctacctgaatgcaaatgggaatcttgagggagaacacaaaggaaatgcaatcatggaaaatggggctgcaataccattagctgccaaaaacctcgcccggtctaagagtatatccaatgatcttcatggggtccaacctgatccagttgctgcagatattcttcggaaagaacctgagcaagaatcattcgtcaagctattgactgctccaaatgagatcccatctcctgatgaaattgaggtctacaaaatccttcaaaagtgccttgagttaagagattgttacctatttagagaagaggttgctccatgggagaaggaggtcataaatgatccttgtacaccaaaaccgaatctaaatccattcacttatgggcctgaaccaaaatcagagcatgttttccaaatggtcgatggtgttgtccaggtctatgcggataaggactatacggaaagaatttatcctgttgctgatgccacaacctttttcactgacttgcattatgttctccgggtgactgccgcggggaacacgagaactgtctgtcataaccggttgaatcttctagagcataagtttaaatttcatctgatgttaaacgcggacagggagtttcttgcccagaagactgcaccgcaccgtgatttctacaatgttaggaaggtcgacacccatgttcaccactcagcatgcatgaatcagaaacatttgctgagattcataaagtccaaactgagaaaagaacctgatgaggttgtcattttcagagatggtacttatatgactctgaaggaggtttttgagagtttggacttaactgggtatgatttgaatgttgatttgctagacgtccatgcagacaaaagtacgtttcatcgttttgacaaattcaaccttaaatacaatccatgtggccaaagtaggctccgtgagattttccttaaacaggacaatcttattcaaggtcgttttcttgctgagctgacgatgcaagttttttcggatcttaatgcaagcaaatatcagatggccgaatataggatttcaatctacgggaggaagcaaagtgagtgggaccaacttgcgagttggatagtaaacaatgaattgtatagtgaaaatgttgtctggttggttcagattccacgcttatataatgtgtacaagcaaatgggcattgttacatcatttcaaaatcttctcgacaacattttccttcctctgtttgaggttactgttgatccatcttcgcacccacagcttcatgtcttcctaaagcaggttgtagggttggatttggttgatgatgagagtaaacctgaaaggcgtccaactaagcacatgcctacgcctgagcaatggactaatgtcttcaaccctgcattttcatattatgcatactactgctatgctaacttatacacactgaacaagttgcgtgagtcaaaggggatgaacactatcaaattccgtccacatgctggtgaggctggcgacgtcgatcacttggcagcgacatttcttctttgtcacagtatatcacatggaatcaatttaaggaagtctcctgtgctccaatatctgtactatcttggtcagattggtctggcaatgtccccactaagcaacaactcattgttccttgattaccatcggaacccttttccgatgtttttccaacgaggactgaatgtctcactgtccacggatgatccattgcaaatccacctgacgaaagaaccattggttgaagaatacagcattgctgcttcgctgtggaagctcagttcttgtgatttatgtgaaattgcgagaaattctgtatatcaatcagggttttcacatgctctcaaggcacattggattggtaagaactactacaaaagaggcccttcagggaatgatatccacagaactaatgtgccacatatcaggattgaatttagggatctgatctggagagatgaaatgcagctcgtttaccttaacaacgtcatcttacctgaagaggtggaccagtaagaggtgcccaggtgtaaatgctgtagacctcgtggaatgaatccgtagttcatgtttgcgtacatttattatccacactgagccgaagctcgacccacagccggtagaatcttcaaataagtattgtccaagaaccaccaccaaagtggaaaaacacatgcagcataatgtcagataacaagcgaagtgatgaagtggctcacactcagtgctaggttagcgttagagggtgacaagtgcacaaactgcttggtgttactgtcaccctctcatttgcaaaggatgtagttaacaatggatgttgtactccgactgtttactgcctgtgagaaaagcgatgcggcaaaagttcttctggaaacggttttgctactgagaagacgcctgatattttgttatagatcagtacatacgtgtaactgagttgtgtaattcctaggacacaacatgagtttttctgtttttattcagtctttgtcactacattacaatatttatgctgctgaaatttattaaaatttgtggagttcaaatttaacttt

SEQ ID NO: 3259 - DNA, 3203 bp, Gossypium hirsutum
atggggcccgaataaaagagagctcatctctctctctcccaacccacacttgccaaaagctattcagtttcatcgctttgttttgttttgtgtttttgtgctttttttatatcctttgctggcagcagtagattgggagagaggaaaaaagagtgagtttttctttttagatggacacgtctacagttcatctagcgatggcggctctggtcggagcttcgttggtggcagtgtcggcgtattatatgcataggaaaaccttaaatcagttgctggagtttgccaagacggtggagagggaaagggaggacatttccgagggagaagagtcgccacagccgcagcactccaagaaacggcgcggccaacacttccgctggaaggggaacggatactaccgccgcggttcggcgtctttgccggatgttactgtgatatccggcggatttgatggagaagagaaacgcaatggtcctgtcaatgtcgatgggattcctcccggtttgccgaggctccatactctgcctgaagctaagagatctggaagtcttatccgacccacttctccaaagtcccctagtgcaagtgcctttgagagcatagaagggtcggacgatgaagataatatcaccgacagttctaagttagacattacatatctgcatactaatggaaatgccggcccaaatttgcctgatcacatcaatgctaatggagaggcaatgcagatagctgcttctagtatgattcggtcccatagtatagccggtgacctccatggtgttcaacctgatcctattgcagctgatattctaaggaaagagccagagcaagaaacttttgcacgacttaaaatttccccttctgaggtaccatcgccggatgaagttgaggtctatgtagttctgcaagaatgcctggaaatgcggaaaagatatgtattcaaggaggcagttgctccttgggaaaaagaagttatatcagacccaagcacaccaaaacctaatccagagccctttttttatgctcctgaaggaaaatctgatcattattttgagatgcaagatggagtaatacatgtctatgacaataaagatactagaagggagctctttcctgtagctgatgcgacaacctttttcactgacttgcaccacatacttcgcgttatagcggcaggcaatatcagaactttgtgttttcaccggctaaatcttctagaacaaaaattcaatcttcatttgatgctaaatgcggatagagaatttctggctcagaaaagtgcaccacatagggacttctataacgtaaggaaagttgatacacatgtgcatcattcagcgtgcatgaaccagaaacaccttttgaggtttatcaagtcgaagttgaggaaagaaccggatgaggttgtaatatttcgagatgggacatatttgaccttgaaagaagtttttgagagcttagatttaactgggtatgatttaaatgtggaccttcttgatgttcatgctgacaaaagtacctttcatcggtttgataaatttaacctcaagtataatccttgcggtcaaagtaggctcagggagattttcctcaagcaagacaatcttatccaaggtcgattccttggtgagttgacaaaggaagtgttttctgatcttgctgcaagcaaatatcaaatggctgaatacagaatatcaatatatggtaggaagcaaagtgagtgggaccaactggctagttggattgttaacaatgatttgtacagtgagaatgttgtttggttaattcagatccctcgactctacaatgtttacaaagagatggggattgttacttcatttcagaacattcttgacaacatttttatacctctgtttgaggttactgtggatccagattcacatcctcagttacatgttttcttgaagcaggttgtagggctggatttggtagatgatgagagtaagcctgaaagacgccccaccaaacacatgccaacaccagatcaatggactaatgtatttaatcctgcattctcctactatgcgtattattgctacgcaaacctctataccttaaacaagcttcgtgaatccaagggcatgacaaccatcaaattccgaccacattctggggaggctggtgatattgaccaccttgctgcaacatttctaactgctcataatattgcacatggaatcaatttaaggaaatctcctgtactacagtatctttattatttggcacagattggcttggctatgtctcctctgagcaacaattccttgtttctggactatcatcggaatccttttccaatgtttttcctacgtggtctgaatgtttccttgtctacggatgatccacttcaaatacacttaacaaaggaacctttggtggaagaatatagcatagctgcttctgtgtggaagctgagtgcatgtgatttatgtgagattgcccgtaattcagtctaccagtctggtttttcacatgctttgaagtcacactggattggaaaggagtattacaagagagggcctaatggaaatgagatacagaggacaaatgtacctcatatccggctggaatttcgtgacaggatctggagagaggagatgcagctggtgtacctgggcaatgccattatccctgaagaagtggacaagtaatgtgcaaccatactgcacaaaattccattgtttaacactacacatcacatatactgaggagtggcatttatttattacaacagcaggaggcggcaaagaaaagaagctggcctttggacatgaatcctgcataaaaaaagggatatgacgatcaacatgggaagctaatggatggtatttacaaggccactggttgggcaaagcaaaagcaaagcttagcttgtaggtggtggtggtggagggaaacttctgcaaacatgacaaacacaagaggaagcagaatccttaaacaataccatttcagatgacaatcaaagatgatatcttctattgttaggtaggttaaagctatcatagaatactactacttactgttttatatagttactacaataatatatatttatttatcaaggtaggaagtttgctctcttctcttgtcttctcatgcattatcaattttgaccagacttctaatttcaatgttattcgaaaataatcatttataaaattaatataactttggaa

SEQ ID NO: 3260 - DNA, 1478 bp, Cajanus cajan
caaggtcgttttcttggtgagttgacaaagcaagtgttttcggatcttgctgccagtaaatatcagatggctgaatatagaatatcaatatatggtaggaagcaaagtgagtgggaccaactagccagttggatagttaataatgatttgtacagcgagaatgttgtttggttgattcagcttccacggttgtacaatgtgtacaaagaaatgggaattgtgacatcattccagaacatgcttgacaatatttttattccactttttgaggttactgtcgacccagattcacatcctcagcttcatgttttcttgaaacaggttgtcggttggatttggtggatgatgaaagcaagcctgaaaggcgaccaacaaaacacatgcccacacctgatcagtggactaatgtattcaatccagcattttcatactatgtctattactgttatgcaaatctttacaccttaaacaagcttcgtgaatcaaaggggatgacaacaatcaaattccgaccacattctggagaggctggtgatattgaccacctagcagcaacttttctcacggctcacaatattgcacatggaatcaatttgaaaaaatctcccgtgcttcaatatttatattatttagctcagattgggctggcaatgtctcctttgagtaataactccttattcttagactaccatcggaatccttttccaatgttcttcttacggggcttgaatgtgtcactttctactgacgatcctctccaaattcacttaacaaaggaaccattggttgaagaatatagcatagctgcttctgtatggaagttgagctcatgtgatttatgtgaggttgcccgtaattcagtttatcaatcaggtttctcacatgctttaaagtcacattggattggtaaggagtactacaagagagggccaaatggaaatgacattcagagaacaaatgttcctcacatccggttggaattccgtgatacgatttggaaagaggaaatgcaacaggtttatttgggcaaagccatcattcctgaagaagtagacaaataagatgccagaggcattcctttcatgcatgaaaaatggaggtagaaagtgaattcgtcaaaaccatccaacatcagagatgtcctatggttgaagacattactggtctgatgatatgaaccatatatacatactatagagaatcaacaagatcgctgagcttgagcattgagcaaggtttacagctacaaatcgacatagccccagaatagttttttcttgtattattttgggttaggggtcacaaaaatcgcatgcttcaagcaaaatgatgcttgttgatgttagaaatgtaagttatgatcctttgaagggagacatttttctcctaaaattttgattcctatttatccatatagttgaaagacggtggccctattactcgtaccgtaatgatctattatgctgatgccgttgcag

SEQ ID NO: 3261 - DNA, 2583 bp, Prunus persica
aaatggagtcgtatgcgatacatttggccatggcggctctggttggtgcttcgctggtggctgtgtcggcctactatatgcaccgcaaaaccctaaatcagcttcttgagtttgcgaagacggtggagagggagagagaggacaactccgatggcggtgactcaccgcagcacatgaaaaagcgtagaagccacgcgcgtcgcaagggcagcggctattaccggcggtgctcggcgtcgttgccggacgtgacggcgatctcaggcgggattgacggtgacgatcataggcgcaacggcttgcttccggttgatggtattcctgccgggttgccgaggctgcacacgcttccggaagggaaatctactgagcttgcgagttcagctaagagaactggtaatcttatacgtccaacttctcctaagtctccagttgcaagtgccagtgcctttgagagtgtagaaggatcagatgatgaagataatatgactgacaatgctaaactaggcactgtggggccagatggtaaaatcctttttgagaatttaccgaaccatgttaatgccaatggagagcaaattcctatagctccttcaagtatgattcggtcccatagtgtatctggtgatctgcatggcgttcagcctgatccaattgcagctgatattttaaggaaagagccagaacaagagacttttgctaaacttaaaattactcctactgaagtgccatctaccgatgaagtggaggtctatgtggttcttcaagaatgccttgaattgcgaaaaagatatgtattcagcgagacagttgctccgtgggagaaagaaattatatctgaccccagtaccccaaagcctaacccagcaccatttttttatacttctgaggagaagtctgatcattattttgaaatgcaagatggggttgttcatgtgtatcctaataaagattcaagagaagagctttttcctgttgccgatgcaacaaccttctttactgacctacatcacatacttcgagttatagcagcagggaatatcagaactttatgccatcatcgactgaatcttctggaacaaaaattcaatcttcatttaatgcttaatgcggatagggaatttctggctcagaaaagtgctccgcatcgtgacttttataatgtcagaaaagttgatacacatgttcatcattcggcatgcatgaaccagaaacatcttttgaggtttataaaatcaaagttgaggaaagagcctgatgaggttgtgatatttcgagatggaacctatttgaccttgaaagaggtttttgagagtttggatttgactgggtacgacctaaatgttgaccttttggatgttcatgcagacaagagcacatttcatcgttttgataagtttaatctcaagtacaacccctgtggtcaaagtaggcttcgtgagattttccttaagcaggataatcttattcaaggtcgtttccttgctgagctgaccaagcaagtgttttctgatctgtctgccagtaaatatcagatggctgagtacagagtatcaatatatggtaggaagcaaagtgagtgggaccaaatggctagttggatagtgaacaatgaattatacagtgagaatgttgtttggttgattcagttgccacggttgtacaatatatacaaggaaatgggaatagtaacatcatttcagaacattcttgacaatatctttattccactatttgaggttaccatagatccagattctcatccacaactgcatgttttcctgaaacaggttgtggggttagatttggtggatgacgaaagcaaacctgaaagacgccccacaaaacacatgccaacaccagcacaatggaccaatgtattcaatcctgcattttcatactacgtgtactactgttatgctaatctctacacattaaacaagcttcgtgaatcaaaaggcatgacaacaatcaaatttcgtccgcattctggggaggctggtgacattgaccaccttgctgcaacctttcttaccgcaaataatattgcacatggaatcaatttgagaaaatctcccgtgcttcaatatctgtattatttagcccagattggcttggctatgtcacccctgagcaacaattctctgtttttggactaccatcggaacccttttcctatgtttttcttacgaggtcttaatgtttctctttctactgatgatcctctccaaatccacttaacaaaagaacctttggtggaagaatatagtatagctgcttctgtatggaaattgagttcatgtgacctatgtgaaattgcccgtaattctgtctaccaatctggtttttcacacgcacttaagtcacactggattggcagagagtactataagagagggccagatggaaatgacatccacaaaacaaacgtgcctcatatccgggtggaatttcgtgaaacgatctggagagaagagatgcaacaggtttatctcggaaaggccatgatccctaaagaagttgagaggtgatgtcgaaaggcatgcgcaactttaagccatacttgaagagtaatctgataag

SEQ ID NO: 3262 - DNA, 1766 bp, Silene vulgaris
taatgcggatagggagttccttgcgcaaaagagtgcccctcatcgtgacttttacaatgtcagaaaagttgatacacatgttcaccactcagcatgcatgaaccagaagcatcttttgaggtttattaagtcaaagctgagaaaggaaccggatgaggttgttatatttcgtgatgggacctatttaactttaaaagaagtctttgagagcctggatttgactggatatgatttaaatgttgatctattagatgttcatgctgacaagagcaccttccatcgttttgataagtttaacctcaagtacaatccctgtggtcaaagtaggctccgggaaattttccttaaacaggataatctcatccaaggacggtttcttggggaattgacaaagcaagttttctctgacctcgaggccagcaaatatcagatggccgagtacagaatatctatatatggtagaaagcaaagtgagtgggaccaactggccagttggattgttaacaatgatttgtacagtgagaatgttgtttggttgattcagattccaagactatataacatatacaaggaaatggggatagtgacatcatttcagaacttgcttgacaacatcttccttcctttgttcgaggttactgtcgatccagattcacatcctcatttgcacctattcctgaagcaggtggttggactagatctggtggatgatgaaagcaaacccgaaagacgccccacaaagcatatgcctacgccagaccagtggaccaatatcttcaatccagcgtattcgtactacgtgtactactgttatgcaaatctctatacgctaaataagcttcgtgagtccaagggtatgacaacgataaaattcaggccgcattgtggagaggctggcgacgttgatcatcttgcagcatctttcctcacatgtcataatattgctcatggaattaatttgaggaaatctcctgtactccagtatctctattatttagcgcagattgggctggcaatgtctcctcttagcaacaactctctatttttagactatcatcgcaacccttttcctgtcttcttcttgcgtggtttgaatgtatccctatccacagatgaccccttacaaattcatttaaccaaggagcctttagtggaagaatacagcattgctgcctcagtgtggaagctaagttcatgtgatctgtgtgagattgcccgtaattctgtccttcaatctggattttctcatgctctgaagactcattggatcggacaacagtactacataagaggaccagaagggaacgacattcacaagacaaatgtacctcacatacgagtagagttccgtcaaatgatatggagggaggagatgcagcaagtgtatctgggaaaggctaatatccctgaagaagtggacaagtgatgcctgaagtacagatatttcttgattcactaaattctcgagctgctttattggatgatggaagtttcatacttcacctgttttgaagcgccaccacaattgtgtacacgagattggctccagaccctcatcggaggggtttgcagaaatgaaattatgtcttggaatgttatagcatacggcaatatgcccaataaactcagaaggattagagttgtaataatgcctacaatgtgagaacagattgtataattttctattatttggaggaatcaaggcgatatgttcttcctcaagttttgcccatgtatgctacagggtatatagtttatctggtttt

SEQ ID NO: 3263 - DNA, 3042 bp, Glycine max
cgattgatcatacatggatacgcacgcggtgcatttggccctggcggcgctcgtcggagcctccgtcgtggccgtgtcggcgtactacatgcaccgcaagacgctggcgcagctgctggagttcgcgcgtacggtcgagagggaggctgacgccggcggctccgacgctgaatcgccgccggcccacgcgaagaagcgccggggcagctccaggaagcgccgcaacggcggataccgccggggctccgcgtcgctgccggacgtcacggcgatctctggcgggttcgacggggacgagaagcggaacgggccggtgcacgtcgaggggattccggcggggctgccaaggttgcacacgctccgggaaggtatggctgcggtggaaatttccagagaagtcttttaagaccaacttctcccaagtcccctgttgcaagtgccagtgcctttgaaagtgtagaaggatcagatgatgaagataacatgacagacaaagttaaacttgatactacatatctgcatgcaaatgggactgttggtccagaaggtaaaatcccatttgagactttacctaatcatgttaatgccaatggagagcagatggcaattacaccgagtatgatccgctctcatagtgtttctggtgacctgcatggtgtgcagcctgatccaatagcagctgacattctgaggaaagagccagagcatgaaactttcacaagattgagaataactcctcttgaggctccgtcacctgatgaaattgaagcttatgtggttctgcaagaatgccttgaaatgagaaaaagatatgtttttagagaagctgttgctccgtgggataaagaagttatatccgaccccagcacacccaagcctaacccagatccatttttatacattcctgaaggaaattctgatcattattttgaaatgcaagatggggttattcgtgtatatccagatagagatgcaaaagaagagctttttcctgtagctgatgcaactacatttttcactgatcttcatcacttacttcgagtcatagcagcagggaatataagaactttatgccatcataggctcaatcttctagaacaaaaattcaatcttcatttgatgctaaatgcggatagagaatttcttgctcagaagagtgctccacatcgagacttctataatgttagaaaagttgatactcatgtccaccactcagcatgcatgaatcagaaacatcttttaaggttcataaagtcaaagctgagaaaagagcctgatgaggttgtaatatttcgagatgggacatatctaacgttggaagaggttttcaagagtttagatttgtctggatatgacctcaatgttgaccttttggacgttcacgcagacaagagtacttttcatcgctttgataagttcaatcttaaatacaatccttgcggtcaaagtaggctcagggagatatttcttaagcaggataatctcattcaaggtcgttttcttggtgagttaactaagcaagtgttttcagatcttgctgccagtaaatatcagatggctgaatatagaatatcaatatatggtaggaagcaaagtgagtgggaccaactagccagttggatagtgaataatgatttgtacagcgagaatgtcgtttggttgattcagcttccacggttgtacaatgtgtacaaagaaatgggaattgtgacatcattccagaacatgctcgacaatattttcattccactttttgaggtcactgtcaacccagattcacatcctcagctgcatgttttcctgaaacaggttgttgggttggatttggttgatgatgaaagcaaacctgaaagacggccaacaaaacacatgcctacacctgagcaatggactaatgttttcaatccggcattttcatactatgtctattactgttatgcaaatctttacaccttaaacaagcttcgagaatcaaagggaatgacaacaatcaaattccgtccacattctggagaggctggtgatattgaccaccttgcagcaacctttctcacggctcacaacattgcacatggaatcaatttgaaaaaatctcctgtgcttcaatatttatattatttagcccagattgggctggcaatgtctcctttgagcaataactccctattcttagactaccatcggaatccttttccaatgttcttcttacggggtctgaatgtgtcactttctactgatgatcctctccaaattcacttaacaaaggaaccattggttgaagaatatagcatagctgcttctgtgtggaagttgagctcatgtgatttatgtgagattgcccgtaattcagtttatcaatcaggtttctcacatgctttaaagtcacattggattggtaaggagtactacaagagtgggccacgcggaaatgacattcagagaacaaacgttcctcacatccggttggaattccgtgatacgatttggagagaggagatgcaacaggtttatttgggcaaagccatcattcctgaagtagtagacaaataagatgccagggggcattcctttcatacacatgaggtagatagtatcctcaaacccttgcagcgtcagagatgcagggctgaagacatacaatgctggtctgatgatatgagccaggtacatactatagagaatcaacaagatcgatgagcttgagcatcgaacaaggttttacagctacaaatcgacgtacccgtggggttttttctatccttgggttagagttaaaattattagggttagcaattagttcatgcttcaagcaaaatgatgcctgtcggtgttagaaatgtatgttagtaatgtaagttatgatcctttgaagggagagagatattcatctcccaaaattttgattcccattgtttatcgataataatatatcgtgaacgacagttgagacttgaaaaacggtggctctattagttttaccgtaatggtatacgatgccataatgaggcttatcctgtttaacgtaatatgagtaaaggtggc

SEQ ID NO: 3264 - DNA, 3417 bp, Populus trichocarpa
cctcttctcgcctgcccctctctctagtctctactattcagccagaccatccacaactctcaccatttccctgcagaaatcctcctttcctgagagagaaagaaagagatattttttagagagagaaagtaatggatgcgtacgcgctgcatctagcgatggcggctctagtaggagcatcatttgtggcagtatccgcttattatatgcaccgcaaaaccctaactcaactcctcgagttcgcgaagacggtagagagagaacgagaacgagacgacaactccgacggcggaggatcgtcgccgcagaatttgaaaaagagtaggagtcacggacggaggaaagggagtaatggtcactacaacaagcgtggctcagcttcgttaccggatgtgacggcaatttctggtggtggaattgatggagaggagaaacgtaacggtcaggtgctttatgtcgaagggattcctgctggattgcctaggcttcatactttgcttgaagggaaatctgctggacatgtcaagagacctgcaagttttatcagaccaacttctccaaagtctcctggtgccagtgcgagtgcctttgacagcgtggaaggatcagatgatgaagataatatgactggcaattctaaactagacactacatatctgcatatcaatggaaatgctgatataaaggatgttttaccacaacacattaatgcaaatggagaccaaatgcctatacctgcttcaagcatgattcgatcccatagcgtgtctggtgacctgcatggtgttcagccagatccttttgcagctgatattctaaggaaagagccagaacaagaaacttttgctcgacttaaaatttctcctatggcagaggtgccatcaccagatgaagtggattcctatatagttcttcaagaatgccttgaaatgcgaaaaagatatgtattcaaggaagctattgctccatgggagaaagaaattatttctgaccctagtacaccaaagcctaatcctgacccgttctcctataccccagagggaaaatctgatcattattttgagatgcaagatggggtcatccatgtctatccaaataaagattctaaggaagaactttttcctgttgctgatgcaacaatgtttttcactgatttgcatcacatacttcgagttattgcgattggaaatatcaggactctatgtcatcatcggctgaatctcctagaacaaaaattcaaccttcatctgatgcttaatgcggatagagagtttctcgctcagaaaagtgctccacatcgtgacttctataatgtcaggaaagttgatacacatgttcatcattctgcgtgcatgaaccagaaacatcttttaaggtttataaagtcaaaattgaggaaagagcctgacgaggttgtaatttttcgagatggaacatacttgacattgaaagaagtgtttgagagtttggatttgactgggcaaggaacttttattgctgttctcatttttatattgttgtatagagaatggtggtatcttatcgacatttgtttgcacaggtatgatctcaatgttgaccttttagatgttcatgcggacaagagcacgtttcatcgctttgataagttcaacctgaagtacaatccttgtggtcagagtaggctcagggagattttccttaaacaagataaccttatccaaggccgtttccttggtgaactgacaaaacaagtcttttctgatctcgttgctagtaaatatcagatggctgaatatagaatatcaatatatggtagaaagcaaagtgaatgggaccaattggctagttggatagtgaataatgaattgtacagcgaaaatgttgtttggttaatccagcttccaagactgtataatatctacaaggaaatggggattgtgacatcatttcagaatattcttgataatatcttcatgccgctttttgaggttacagttgatccagattcgcatcctcagctgcatgttttcttaaaacaggttgttgggttggacttggttgatgatgaaagcaaacctgaaagacgcccgacgaagcacatgcctacaccagttcaatggaccaatgtgttcaatcctgcgttttcatattatgtttattactgttatgccaacctctacacattaaacaagcttcgtgagtcaaagggcatgacaactatcaaattccgtccccattctggagaggctggtgatattgatcatcttgctgccacatttcttacatgtcataatattgcccatgggatcaatttgaggaaatctccagtacttcaatatttgtattatctggcacagattggcttggctatgtctcctctgagcaacaattccttatttttagactaccataggaaccctttccctatgtttttcttaaggggtctcaatgtttccctttcaaccgatgatccgctccaaatccatttaacaaaagagcccttggtggaagaatatagcatagctgcttctgtgtggaagttgagttcatgcgatctgtgtgagattgcccgaaattcagtctaccaatcaggtttctcgcatgctttgaagtcgcactggattggtaaagagtactacaatagaggaccagatggaaatgatattcacaagacaaatgtgcctcatatccgggtggaatttcgagacacgatatggagagatgagatgcagcaggtttatcttggcaaggccattatccccaaagaagtggacaagtaaatagtggagagctgccttagcccattcttacgtgcttacttgaattacaaagtgggtcaacagaattccgcttgctcgttaaacatgagataagctgtatactatgatcgtgcatttgagatgatcattcacagcctccataaaaaaaagggaatggctttgtgcagagcaacaaagctaacaaatgcttacaaggtttgagaacgagggctatgcaaatgatgcagttgttgacttggtggtctgctgttatcaataagatgccaatcttgagccaaaacaaatatattaggtagaggtttaagaataaaattatgaggcatagtaagagttttgtatggttcactcgttgcaatgtcagatgatagtgtagccaatagcaagaaggaaaaggatagtctcttgctttaattttgtttctagataaatgccccctcaaattttggttgagtttcatgccatgcagatgtttatcatgaatttggccagcggcgtgtaacccaaaattctctggtaagttaaattctctttttttaccgggtcgaattcttttcttatttgcatcttgttttgttggggcccgccattttttgctatgctagtgtagtagtgactggtgagatagggtcgggacatgttgaaccgttgaaagttc

SEQ ID NO: 3265 - DNA, 1203 bp, Euphorbia esula
  misc_feature (4)..(4): n is a, c, g, or t
  misc_feature (6)..(8): n is a, c, g, or t
  misc_feature (299)..(299): n is a, c, g, or t
tttnannnttcaatctgaagtacaatccatgtggacagagtaggctcatggagatttttcttaagcaggataatcttatccaagggcgtttccttgctgagttaacccaacaagtattttctgatcttgatgcaagtaaataccagatggctgaatatagaatatcgatatatggtcggaagcaaagtgaatgggatcaattggctagctggattgtcaataatgagttatacagtgagaatgttgtttggttaattcagcttccacgactgtacaatatctacaaggagatggggatngtgacatctttccagaacattctagacaatatctttattccgctgtttgaggttactgtagacccggattctcatcctcagctgcatgttttcttgaaacaggttgttggattggatttggttgatgatgaaagcaagcccgaaaggcgccctacaaagcacatgcctactccagctcaatggaccaatgtcttcaatcctgccttttcatattattcctactactgttatgctaatctctacactttaaacaagcttcgtgaatcaaagggcatgacaactatcaaattcagaccacattctggggaggctggtgatattgatcaccttgctgcaacatttctcacggctcaaaacatagcccacgggatcaacttgagaaaatctcccgtgcttcaatatttgtactatctagctcagattggtctggcaatgtctccactgagcaacaattccttatttttggattaccatcggaacccttttcctatgtttttcctacgtggtctcaatgtttccctttcaacagatgatcctctccaaatccacttaactaaagaacctttggtggaagaatatagcattgctgcttctgtgtggaagttgagttcatgtgatctgtgtgagatagcccggaattcagtctaccaatccggtttctctcatgctttaaagtcacactggattgggaaagagtactacaagagaggaccagatgggaatgatattcacagaacaaatgtgcctcatattcgggtggaatttcgtgaaacgatatggagagaggaaatgcaacaggtatacctaggcaaggctataatccctagagaagtagacaagtaatgggcaagtaatcacttcttctggaggtccattcttaatgtgatgatatacaacattataa

SEQ ID NO: 3266 - DNA, 1386 bp, Arnica chamissonis
tgacctcaatgttgatctgttagacgtgcatgcagacaagagcacctttcatcgttttagacaaatttaatctcaagtataatccctgtggtcaaagtaggcttagggagatttcttgaagcaagataatttaatccagggccgcttccttgctgagttgaccaaacaagtatttacggatcttgatgcaagtaaatatcaaatggctgaatacagaatatccatatatgggagaaagcaaagtgagtgggacaatttggcaagttggattgtgaataatgatctctacagtgataacgttgtctggctgattcagctgcctcgactttacaatatatataaggaaatgggtattgtgacatcatttcagactattcttgacaatatattccttcctcttttcgaggttacagtagacccaggatcacatccacagttgcatgtttcttgaaacaggttgtggggttggatttggtggatgatgaaagcaagcctgaaagacgccctacaaaacacatgccaacacctgcccaatggaccaatatattcaatcctgcattctcatattatgtatactattgctatgctaacctctataccctaaacaagcttcgtgaatcaaaaggcatgactaccatcagattccgcccccattgtggtgaggctggtgacatagaccatcttgctgctgcgtttcttacaactcataacattgcacatgggattaatctgagaaagtctcctgtacttcaatacctgtactaccttgcacagattggtcttgcaatgtctcctttgagcaataactccttattctggattatcaccggaacccttttccaacatttttcctcagaggccttaatgtttctttatctactgatgacccgttacaaatccatctaacaaaggagccgttagtggaggagtacagtattgctgcttctgtatggaaattaagttcttgtgatctctgtgagattgcccgtaattcagtataccaatcaggtttctcacatgtcctgaagtcgcattggatcggccaacagtactataagagaggaccagatggaaatgacattcacaagacgaacgtgccacatatccgacttgaattccgtgacatgatctggagagaggagattcaacggatttatctagggaaagccgaattgcccgagtacatcgagacctagcttcttccctgtcattccaccatttgtggtttctagagttccaggggccaatttttggtgatatcatggcactctagggagctgagacttcgcatccctgaagcttaagagctaatgtggatcaactccagaattcagtgaaagctttaggtcattcggatctaaaacatgttatgtagcacgagatgaa

SEQ ID NO: 3267 - DNA, 3177 bp, Gossypium hirsutum
atttaataaaagagagctcatctctctctctcccaacccacatttgccaaaagctattcagtttcatcgctttgttttgttttgtgtttttgtgttttttttttatcctttgctggcagcagtagattgggagagaggaaaaaagagtgagttttctttttagatggacacgtctacagttcatctagcgatggcggctctggtcggagcttcgttggtggcagtgtcggcgtattatatgcataggaaaaccttaaatcagttgctggagtttgccaagacggtggagagggaaagggaggacatttccgagggagaagagtcgccacagccgcagcactccaagaaacggcgcggccaacacttccgctggaaggggaacggatactaccgccgcggttcggcgtctttgccggatgttactgtgatatccggcggatttgatggagaagagaaacgcaatggtcctgtcaatgtcgatgggattcctcccggtttgccgaggctccatactctgcctgaagctaagagatctggaagtcttatccgacccacttctccaaagtcccctagtgcaagtgcctttgagagcatagaagggtcggacgatgaagataatatcaccgacagttctaagttagacattacatatctgcatactaatggaaatgccggcccaaatttgcctgatcacatcaatgctaatggagaggcaatgcagatagctgcttctagtatgattcggtcccatagtatagccggtgacctccatggtgttcaacctgatcctattgcagctgatattctaaggaaagagccagagcaagaaacttttgcacgacttaaaatttccccttctgaggtaccatcgccggatgaagttgaggtctatgtagttctgcaagaatgcctggaaatgcggaaaagatatgtattcaaggaggcagttgctccttgggaaaaagaagttatatcagacccaagcacaccaaaacctaatccagagccctttttttatgctcctgaaggaaaatctgatcattattttgagatgcaagatggagtaatacatgtctatgacaataaagatactagaagggagctctttcctgtagctgatgcgacaacctttttcactgacttgcaccacatacttcgcgttatagcggcaggcaatatcagaactttgtgttttcaccggctaaatcttctagaacaaaaattcaatcttcatttgatgctaaatgcggatagagaatttctggctcagaaaagtgcaccacatagggacttctataacgtaaggaaagttgatacacatgtgcatcattcagcgtgcatgaaccagaaacaccttttgaggtttatcaagtcgaagttgaggaaagaaccggatgaggttgtaatatttcgagatgggacatatttgaccttgaaagaagtttttgagagcttagatttaactgggtatgatttaaatgtggaccttcttgatgttcatgctgacaaaagtacctttcatcggtttgataaatttaacctcaagtataatccttgcggtcaaagtaggctcagggagattttcctcaagcaagacaatcttatccaaggtcgattccttggtgagttgacaaaggaagtgttttctgatcttgctgcaagcaaatatcaaatggctgaatacagaatatcaatatatggtaggaagcaaagtgagtgggaccaactggctagttggattgttaacaatgatttgtacagtgagaatgttgtttggttaattcagatccctcgactctacaatgtttacaaagagatggggattgttacttcatttcagaacattcttgacaacatttttatacctctgtttgaggttactgtggatccagattcacatcctcagttacatgttttcttgaagcaggttgtagggctggatttggtagatgatgagagtaagcctgaaagacgccccaccaaacacatgccaacaccagatcaatggactaatgtatttaatcctgcattctcctactatgcgtattattgctacgcaaacctctataccttaaacaagcttcgtgaatccaagggcatgacaaccatcaaattccgaccacattctggggaggctggtgatattgaccaccttgctgcaacatttctaactgctcataatattgcacatggaatcaatttaaggaaatctcctgtactacagtatctttattatttggcacagattggcttggctatgtctcctctgagcaacaattccttgtttctggactatcatcggaatccttttccaatgtttttcctacgtggtctgaatgtttccttgtctacggatgatccacttcaaatacacttaacaaaggaacctttggtggaagaatatagcatagctgcttctgtgtggaagctgagtgcatgtgatttatgtgagattgcccgtaattcagtctaccagtctggtttttcacatgctttgaagtcacactggattggaaaggagtattacaagagagggcctaatggaaatgagatacagaggacaaatgtacctcatatccggctggaatttcgtgacaggatctggagagaggagatgcagctggtgtacctgggtaaggccattatccctgaagaagtggagaagtaatgtgcaaccatactgcacaaaattccattgtttaacactacacatcacatatactgaggaggaggcggcaaagaagagaagctggcctttggacctgaatcctgcatgaaagaagggatatgacgatcaacatgggaagctgatggatggtatttacaaggccactggttgggcaaagcaaaagcaaaagcaaagcttagcttgtaggtggtggtggtggagggaaacatctgcaaagatgacaaacacaggaggaagcataattctcaaacaagaccatttcagatgacaatcaaagatgatatcttctattgttaggtaggttaaagctatcatagaatactactacttactgttatatatagttactacgataatatatatttatttatcaaggtaggaagtctgctctcttctcttgtcttctcatgcattatcaattttgaccagacttctaatttcaatgttattcgaaaataataatttataaaattaatataactttggaa

SEQ ID NO: 3268 - DNA, 1857 bp, Gossypium hirsutum
aaagtccaagttgaggaaggaaccagatgaggttgtaatatttcgagatgggacgtacctaaccctgacagaagtttttgagagcctggatttaactgggtatgatttaaatgtggaccttcttgatgttcatgcagacaaaagtaccttccatcgttttgataaatttaaccttaagtataatccttgtggtcaaagtaggctcagggaaattttcctcaagcaggataatcttatccaaggtcgattccttggggagctgacaaagcaggtcttttctgatcttgccgcaagcaaataccagatggctgaatacagaatatctatatatggcaggaagcaaagtgagtgggatcaactggctagttggatcgttaacaacgaattgtacagtgagaatgttgtttggttaattcagatccctcgactttacaacgtatacaaggagatggggattgttacatcatttcagaacattcttgacaacatctttattcctctttttgaggttactgtggatcctgattcacatcctcagttgcatgttttcttgaaacaggttgtagggttggatttggtagatgatgaaagcaaacctgaaagacgccccacaaaacacatgccaagaccagatgaatggactaatgtatttaaccctgcattctcctactatgcatattactgctatgcgaacctctacaccttaaacaagcttcgtgagtccaaaggcatgtcaaccatcaaattccgaccacattccggggaggctggtgatattgaccatcttgcggcaacatttctaactgctcataatattgcacatggaatcaatttgaggaaatcccctgtactacagtatctttattatttggcacagattggcttggctatgtctcctctgagcaacaattccttgtttttggactatcatcggaacccttttccaatgttcttcttgcggggtctgaatgtttccctttctacggatgatcctcttcaaatacacttaacaaaggaacctttggtggaagagtatagcatagctgcttctgtgtggaagctgagttcatgtgatctatgtgagattgcccgtaattcagtctaccagtcaggtttttctcatgctttgaagtcccactggattgggaagcactactacaagagagggcccggtgggaatgatatacacaagacaaatgtacctcatatccggctggaatttcgtgatacgatctggagagaggagatgcagctggtttacttgggtaaggctgatatccctacagatgttgacaagtaatgttgaacatacggcacaaggatccattcttgaatgttaccagtatatttagacgtaggcaaacctgcgttctaccttcatcctgcataaagggaccatgagccatacgaactgagaaattgcagggagcaagcaacagtctgaagaggaagttaacatggtttgaggccactggttaaatcatgtacgcagtggagattgttgaaatggaaacatctgcaatgtcttagttcttagactcagggcatggtgtatccaaaaatgaatcaaatacagcctatgacacgaggaagcaaattatagacttcccatagagataataaccaaaaataatgtttcccgttacatttgctacagtgtatgccattatcaaatagtgttggcaagaagtgaataaatgccttcttgcataataaattttgacctacttttacccggagcattgcatgcatgcgccatggatcattcttcggctctcccctccatctgcttctattatatattcaaatctatttataagcatctgaatcttttgcttttagttgtgatgaacggtt

SEQ ID NO: 3269 - DNA, 3139 bp, Euphorbia peplus
atctgagtttcccttctcattagctaccctccactctttccaatcaacctatacatatacatacacacatatatatacatatctgaatagagagagctatattgctctgttgcagaggaacatagctatggatgcttatacagtacatctagctatggcggcgctagtcggagcttccttagtggctgtttcggcgtattatatgcaccgtaaaaccctaactcagttgttggagttcgctaagacggtggagggagggagagatgctgattctgatgtcgactcgcctcagcatttcaagaagcgcggcggcggaaggaagaaagggagagggtattatcggcgtggctcggggtctcttcccgatgtcacggctgtggagggagatgagaaacggaatggtcccgtgtatgttgatgggattccggctggtttgcctaggcttcatactcttgctgaaggaaaagctgctggtcttcctaagagaagtggaagtataattagaccgacttctccaaagtctcctgttgcgagtgcgagtgcctttgaaagtattgagggatcagatgaagaagataatatgacggacaattctaagcttgatactgcatatttgcgtactaacggaactgttggaggcgaacacattaattccattcccaatggggagcagtttcctatacctgcctcgagcatgattcgatcccatagtgtatctggggacttgcatggtgttcagcctgatccaattgcagctgatattctcaggaaagagccagagcatgaaacttttgcaagacttaagattgctcctctagaggtaccatctcctgatgaagtggaggcctatgtagtacttcaagaatgccttgaattgagaaaaaggtatgtattcaaggaggcaatagctccatgggagaaagaaattatttctgaacctggcacgccaaagcctaatacagatccattcttctatgcaccagaagggaagtctgaccattacttcgagatgcaagacggggttattcatgtttatccaaacaaagattctaaggaagaactatttcctgtggctgatgcaacaactttcttcactgatttgcaccacatacttagagttattgcggctggaaatatcagaactttatgccatcatcggttgaatctcctagaacaaaagttcaaccttcatttgatgcttaatgccgatagggagtttcttgctcagaaaagtgctcctcatcgtgacttctacaatgttcgaaaagttgatacacatgtgcatcattcagcatgcatgaatcagaaacatcttttaaggtttatcaagtcaaagttgaggaaagaacccgatgaggttgtgatatttcgggatgggacatacttgactttaaaggaagtttttgagagtttagatttgactggttatgacctaaatgtcgaccttttggacgttcacgctgacaagagcacgtttcatcgtttcgataagttcaatctaaagtacaatccatgtggacagagtaggctcagggagatttttctcaagcaagataatcttatccaagggcgtttccttgctgagttaacccaacaagtattttcagaccttgatgcaagtaaataccagatggctgaatatcgaatatcaatatatggtcggaagcaaagtgaatgggatcaattggctagctggattgtgaataatgagttgtacagtgagaatgttgtttggttaattcagcttccacgactgtacaatatctacaaggatatggggattgtgacatctttccagaacattctagacaatatctttattccactgtttgaggtcactgtagacccggattcacatcctcaattgcatgttttcttgaaacaggttgttggattggatttggttgatgatgaaagcaagcccgaaagacgccctacaaagcacatgcctactccagctcaatggaccaatgtcttcaatcctgccttttcatattattcctattactgttatgccaacctctacacattaaacaagcttcgtgaatcgaagggcatgacaactatcaaattcagaccacattctggggaggctggtgatattgatcaccttgctgcaacttttcttacggctcaaaacatagcccacgggatcaacttgagaaaatctcctgtgcttcaatatttgtactatctagctcagattggtctggcaatgtctccactgagcaacaattccttatttttggactaccatcggaacccttttcctatgtttttcctacgtggtctcaatgtttccctttcaacagatgatcctctccagatccacctaacaaaagaacctttggtggaagaatatagcattgctgcttctgtgtggaagttgagttcatgtgatctgtgtgagatagcccggaattcagtgtaccagtctggtttctctcatgctttaaagtcgcactggattgggaaagagtactacaagagaggaccagatggaaatgatattcacaggacaaatgtgcctcatattcgggtggaattccgtgaaacgatatggagagaggaaatgcagcaggtataccttggcaaggctatcatccctagagaagtagacaagtaatggcaaagaatcacttcttatggactccattcttaatgtgatgatatacaacattataaaggaagtgaattttcaggttggtagatgttaaaattttgcaaaaggtatactcaacctcggaccatcggatgagaaatggtatggttgaatcaaacacaacaccctaagggaagttgaacaaggttacgacaaaagactgcacatttcactcgcctaatacaccgaagaatgccaattgaaatatccggctgtggtgtgctgtgctctgtgatgaatcaatataaattataaggtgtagctttagtttagttatatatatcataccttaacatgaaataatgaattctctggtgttagtatgtaatctacagtcactcttgtgacatttactattttatattatatgaatgggggtaataaaatgtggtaatttagttattatttgatttagtcaagtatctgcagaaactgtgtaggaggtttcattttgtaatgttcttctcacagaataat

SEQ ID NO: 3270 - DNA, 2135 bp, Trigonella foenum-graecum
ggaaagtctgatcatacttgaaatgcaggatggagttattcatgtataatcccaaataaaaactccaacgaagagcttttttcctgttgccgatgcaactacatttttcaccgaccttcatcagatacttcgagttatagcagcagggatatcagaactttatgccaccacaggctaaatcttctagacaaaaattcaatcttcatttgatgctcaatgcggatagggaatttctcgcccagaaaagtgctccacatcgagacttctataatgttagaaaagtggatacacatgtccaccactcagcatgcatgaatcagaaacatcttttgagattcattaagtcaaagctgaggaaagagcctgatgaggttgtaatatttcgagatggaacatatctgacgttgaaagaggtttttgagagtctagatttaactggatacgatctcaatgttgaccttttggacgttcacgctgacaagagtacatttcaccgctttgacaagttcaatcttaaatacaatccttgtggtcaaagtaggctcagggagatatttttgaagcaggataatctcattcaaggtcgtttccttggagagctcacaaaacaagtgttttctgaccttgaagccagtaaatatcagatggctgaatatagaatatcaatatatggcaggaagcaaagtgagtgggaccaactagccagttggatagtgaataatgaattgtacagtgagaatgttgtttggttgattcagcttcctcgattgtataatatatacaaagatatgggaattgtgacctcattccagaacatgcttgacaatatcttcattccactgtttgaggttactgttgaccctgattcacatcctcagctgcatgttttcttgaaacaggttgttgggttggatttggtggatgatgaaagcaaacctgaaagacgaccaacaaaacacatgcctacgcctgctcaatggacgaatgtattcaatccggcatattcatactatgtgtattactgttacgcaaatctatacaccttaaacaagcttcgtgaatcgaagggaatgactacaatcaaattccgtcctcattctggagaggctggtgatattgaccaccttgctgctaccttccttactgctcataacatcgcgcatggaattaacttgagaaaatcccctgtgcttcaatatttatattatttagcccagattggactggcaatgtctcctctgagcaataactctctatttttagactaccatcgaaatcctctacctatattcttcttaaggggtttgaatgtatcactttctaccgatgatccactccaaatccatctaacaagggaacctttggttgaagagtatagtatagctgcttctgtgtggaagttgagctcatgtgatttatgtgagattgcgcgtaattcagtttatcaatcaggtttctcgcatgctttaaagtcacattggattggtaaggaatattacaagagagggccaaatggaaatgacattcacagaacaaacgttcctcacattcggttggaattccgtgacacgatttggagagaggagatgcaacaggtttatttgggaaaattcatcattcctgaagaaatagagaaataatgtggcagaggtctgtatttcatacatccgcaatggaggctgtgtcatagggagaaaatgagttcttcaaaacccattcaacatcagagatatccttaggctaaagatgttattacagtgggtcagtgatatgaaccagatgtataatataaataattaaagatcactgagcttgagcactaagcaaggtttacagctgaattgagcttgagcaatagagcttggggaagtgttttctttaatttaggctagagttaaaaatgagggttggtaataattgcagcaattgttgatgcatgtggctgttagaaatacaagttaatatgatcctttgaagagggagattctctcaaaattttgattctgtatgttagttgaaagctgacgggcctgtagtacaaattttattctcagtggttgtattggttatgaaggtttgagtaaaaaactgttttacgatcttcgaaattagaatgacaagagtttgtcttggtg

SEQ ID NO: 3271 - DNA, 2492 bp, Triticum aestivum
ccgagggcaataaacaaatcattcgttctggttcaagcagacgggttggattgatcagaccaaattcacccaagtccccttttgctagtgcaagtactttagagagtgcagaggggtcagatgaggatgccgcgacgaaagtcaacggcaaacttgataatggccatgcaaacacaaacagaaatctcgagggagaacacaaaggaaattcagttgtggagaatggggctggaacaccattagatgcaaaaaacatgactcggtctcatagtatatccaatgatcttcatgcggctcaacctgatccagttgccgcagatattcttcgaaaagaacctcagcaagaatcatttatcaagctgttaactgcacctcatgagattccatctcctgatgaaatagaggtctacaaaatccttcagaagtgtctcgagttaagagattgttacctttttagagaagaggtcgctccatgggagaaggaggtcataaatgacccctgtacaccaaaacctaatcctaacccattcacttttgtgcctgaaccaaaatcagagcatgttttccaaatggtcgatggtgttgtccaagtctatgcggataaagaccgtacggaaaggatttatcctgttgctgatgctacaacctttttcaccgacttacattatgttctccggatgactgccgcggggaacacaagaactgtctgccataaccgattgaatcttctagaacataagttcaaatttcatctgatgttaaacgcggacagggagtttcttgcccaaaaaactgcaccacatcgtgatttttacaatgttaggaaggtcgacactcatgttcaccactcagcatgcatgaatcagaaacatttgctgagattcatcaagtccaaactgagaaaagaacctgatgaggttgtcattttcagagatggtacatatatgactttgaaggaggtttttgaaagcttggacttaactgggtatgacttgaatgttgatttgctagatgtccatgcggacaaaagtacgtttcatcgttttgacaaattcaaccttaaatacaatccatgtggccaaagtaggctacgggagattttccttaaacaggacaatcttattcaaggacgatttcttgctgagctgacgatgcaagttttttctgaccttaatgcaagcaagtatcagatggctgaatataggatttcaatctatgggaggaagcaaagtgagtgggaccaacttgcgagttggatagtaaacaatgaattgtacagtgaaaatgttgtttggttgattcagattccacgcttatataacgtgtaccagcaaatgggcattgttacatcatttcaaaatcttcttgacaacattttccttcctctgtttgaggttactattgatccagcttcgcacccgcagcttcatgtcttcctaaagcaggtcgtagggttagatttggttgatgatgagagtaaacctgaaaggcgtccaactaagcacatgcctacacctgaagaatggacgaatgtcttcaacccagcattttcatattatgcatactactgctatgctaacttgtacacactgaacaagctgcgtgagtcaaaggggatgaatactatcaaattccgtccacatgccggtgaggctggagacgttgatcacttggcagcaacatttcttctttgtcacagtatatcacatggaatcaatttaaggaagtctcctgtgcttcaatatctgtactaccttggtcagattggtctggcaatgtcccctctcagcaacaactccttgtttcttgattaccatcggaacccttttcctatgtttttccaacgaggactgaatgtctcgctgtccacggatgatccattgcaaattcatctgacaaaagagccattggtggaagaatacagcattgctgcctcgctatggaagctcagttcttgtgatctatgtgaaattgcgagaaattctgtgtatcaatcagggttttcacatgctctcaaggcacattggattggcaagaactactacaagagaggcccttcagggaacgatatccacagaacgaatgtgcccaccatcaggatcgaattcagggacctgatctggagagacgaaatgcagctcgtctacctcaacaacgtcatcttgcctgacgaggtggaccagtaagaggcacctaggtgtataagctgtagccgtcgtgggggatgaatcatacttcctccagctgaataccatctcaccaaacaaccaccaccaaagtggaagaagaagacctacaaaataatttcagatcgcaggtgcggagcgactgagcggctcaccattgtgctagactagcattacagggaggcaagtgtgcaagtgctcggtgtaaaactgtcgcccttctcgtctgtaaaggattgtaattaacaaaggatgctgtgactgttataacaatatattgctaataaagtgatgccgcactgtttc

SEQ ID NO: 3272 - DNA, 3021 bp, Gossypium hirsutum
atggacacgtctacagttcatctagcgatggcggctctggtcggagcttcgttggtggcagtgtcggcgtattatatgcataggaaaccttaaatcagttgctggagttgccaagacggtggagagggaaagggaggacattccgagggagaagagtcgccacagccgcagcactccaagaaacggcgcggccaacacttccgctggaaggggaacggatactaccgccgcggttcggcgtctttgccggatgttactgtgatatccggcggatttgatggagaagagaaacgcaatggtcctgtcaatgtcgatgggattcctcccggtttgcccaggctccatactctgcctgaagctaagagatctggaagtcttatccgacccacttctccaaagtcccctagtgcaagtgcctttgagagtatagaagggtcggacgatgaagataatatcaccgacagttctaagttagacattacatatctgcatactaatggaaatgccggcccaaatttgcctgatcacatcaatgctaatggagaggcaatgcagatagctgcttctagtatgattcggtcccatagtatagccggtgacctccatggtgttcaacctgatcctattgcagctgatattctaaggaaagagccagagcaagaaacttttgcacgacttaaaatttccccttctgaggtaccattgccggatgaagttgaggtctatgtagttctgcaagaatgcctggaaatgcggaaaagatatgtattcaaggaggcagttgctccttgggaaaaagaagttatatcagacccaagcacaccaaaacctaatccagatccctttttttatgctcctgaaggaaactctgatcattattttgagatgcaagatggagtaatacatgtctatgacaataaagatactagaaggagctctttcctgtagctgatgcgacaacctttttcactgacttgcaccacatacttcgcgttatagcggcaggcaatatcagaactttgtgttttcaccggctaaatcttctagaacaaaaattcaatcttcatttgatgctaaatgcggatagagaatttctggctcagaaaagtgcaccacatagggacttctataacgtaaggaaagttgatacacatgtgcatcattcagcgtgcatgaaccagaaacacctttttgaggtttatcaagtcgaagttgaggaaagaaccggatgaggttgtaatatttcgagatgggacatatttgaccttgaaagaagtttttgagagcttagatttaactgggtatgatttaaatgtggaccttcttgatgttcatgctgacaaaagtacctttcatcggtttgataaatttaacctcaagtataatccttgcggtcaaagtaggctcagggagattttcctcaagcaagacaatcttatccaaggtcgattccttggtgagttgacaaaggaagtgttttctgatcttgctgcaagcaaatatcaaatggctgaatacagaatatcaatatatggtaggaagcaaagtgagtgggaccaactggctagttggattgttaacaatgatttgtacagtgagaatgttgtttggttaattcagatccctcgactctacaatgtttacaagagatggggattgttacttcatttcagaacattcttgacaacatttttatacctctgtttgaggttactgtggatccagattcacatcctcagttacatgtttctgaagcaggttgtagggctggatttggtagatgatgagagtaagcctgaaagacgccccaccaacacatgccaacaccagatcaatggactaatgtatttaatcctgcattctcctactatgcgtattattgctacgcaaacctctataccttaaacaagcttcgtgaatccaagggcatgacaaccatcaaattccgaccacattctggggaggctggtgatattgaccaccttgctgcaacatttctaactgctcataatattgcacatggaatcaatttaaggaaatctcctgtactacagtatctttattatttggcacagattggtttggctatgtctcctctgagcaacaattccttgtttctggactatcatcggaatccttttccaatgtttttccttcgtggtctgaatgtttccttgtctacggatgatccacttcaaatacacttaacaaaggaacctttggtggaagaatatagcatagctgcttctgtgtggaagctgagtgcatgtgatttatgtgagattgcccgtaattcagtctaccagtctggtttttcacatgctttgaagtcacactggattggaaaggagtattacaagagagggcctaatggaaatgagatacagaggacaaatgtacctcatatccggctggaatttcgtgacaggatctggagagaggagatgcagctggtgtacctgggcaatgccattatccctgaagaagtggacaagtaatgtgcaaccatactgcacaaaattccattgtttaacactacacatcacatatactgaggagtggcatttatttattacaacagcaggaggcggcaaagaaaagaagctggcctttggacatgaatcctgcataaaaaaagggatatgacgatcaacatgggaagctaatggatggtatttacaaggccactggttgggcaaagcaaaagcaaagcttagcttgtaggtggtggtggtggagggaaacttctgcaaacatgacaaacacaagaggaagcagaatccttaaacaataccatttcagatgacaatcaaagatgatatcttctattgttaggtaggttaaagctatcatagaatactactacttactgttttatatagttactacaataatatatatttatttatcaaggtaggaagtttgctctcttctcttgtcttctcatgcattatcaattttgaccagacttctaatttcaatgttattcgaaaataatcatttataaaattaatataactt

SEQ ID NO: 3273 - DNA, 3101 bp, Manihot esculenta
aaaaacacacaggaaaaaaaaagagagagagagagaactctttcctcttccctctatagctctctctactgttattcaggagctttctaatttggcttctcatttcgacctctactgttttccagtactctactgtaaaagtgtctatacataaacacagagagagagagagagagagagagagagagagagattgttctagagagagaaagtgatggatacaaattatacagtgcatctagcgatggcggcgctagtaggagcttcactagtggcagtatcggcatattatatgcatcgtaaaaccctaactcagttgttagaatttgcaaagactgttgagagagatagagatgataataactcggatttagactcgcctctgcatttaaagcagaagcgccgtagccatcacggtggtggtggtcggagaaaggggaacggttattaccgtcggggctctgcttctctgccggatgtaactgtcatttctgctggcgatggagaggagaaacggaatggaaaagctgctagtcatccaaagagatctggaaatcttattagaccaacttctccaaaatctcctgttgccagtgccagtgcctttgaaagtatggatggatcagatgaagatgataatatgaatgacaatgctaagctagacacgacctatctccataccaatggaattgctggtcctgagtctaaaggcctatttgagaatttgccagaacacgctaatgccaatggggagcaaattcctatacctgcttcaagcatgattcgatcccacagtatctctggtgacttgcatggggtacagcctgatcctattgcagctgatattcttagaaaagagccagaacaagaaacttttgctaggcttaaaatttcccctaccgaggtaccatctcctgatgaagtggagtcctatatagttcttcaagaatgccttgaaatgcgaaaaagatatttatttaaggaagcaattgctccatgggaaaaagaagttatttctgaccccagtacaccaaaacctaatccagagccattcttctatgctccggagggaaagtctgatcattattttgagatgcaagatggagtcatccatgtgtatgcaaataaagactctaaggaagaactctttcctgttgctgatgcaacaaacttcttcactgatttgcatcacatacttcgagttattgcggctgggaatatcagaactttatgccatcatcggcttaatcttctagaacaaaaattcaaccttcatttgatgcttaatgcggatagggagtttcttgctcagaaaagtgctcctcatcgtgacttctataatgtcaggaaagtggatacacatgttcatcattcagcgtgcatgaaccaaaaacatcttttaaggtttattaagtcaaaattgaggaaagagcctgatgaggttgtgatatttcgggatgggacttacctgactttaaaggaagtgtttgagagcttggatttgactgggtctgaccttaatgttgaccttttggatgttcatgctgacaagagcacatttcatcgctttgataaattcaaccttaagtacaatccttgtggtcagagtaggctaagggagattttccttaaacaggacaatcttatccaaggtcgtttcttggctgagctgacaaaagaagtgttttctgatcttgctgcaagtaaatatcagatggctgaatatcgattatcaatatatggccggaagcaaagtgaatgggaccaattagctagctggatagtgaacaatgaattgtacagtgagaatgtggtttggttaattcagcttccaagactgtacaatgtgtacaaggaaatggggattgtgacctcattccagaacattcttgacaatatctttattccactctttgaagttactgtggatcccgattcacatccacagctgcatgttttcttaaaacaggttgttggattggatttggttgatgatgaaagcaagcctgaaagacgccccacaaagcacatgcctacaccagctcaatggaccaatgtgttcaatcctgcatattcatattatgtgtactattgttatgccaacctatacacattaaacaagcttcgtgaatcaaaaggcatgacaacaatcaaattccgtccacattctggagaggctggtgatattgaccatcttgctgctacatttctgacggctcataacattgcacatggaatcaatctgagaaagtctcctgtacttcaatatttatactatctagcacagattggtctggcaatgtctcctctgagcaacaattctctatttttagactaccatcggaatccatttcctatgttcttcctctgtggtctcaatgtttccctttcaacagatgatccactccaaattcacctaacaaaggaacctttggtggaagaatatagcatagctgcttctgtatggaagttgagttcttgtgatctatgtgaaatagcccggaattcagtataccaatcaggtttctcacatgttctgaagtcacactggattgggaaagagtactacaagagagagccagatggaaatgacattcgcaggacaaatgtgcctcacatccgggtggaatttcgtgatacgatatggagagaggagatgcaacaggtttatcttggcaaggccattttctccgagtggacaagtaaatagcggggaatcacctgcagccccatccttaacgtgtgattgtaaaggttctctaggaaatcatcatttcctgctggcatgataaatttttaaaggagggcaatatggccccctaatcatgcaaagtgagaagtagcaaatcttggatcaaacatgccaagaggggttgatcgagattggagaaccaagaccaattatgatgacaaaatgaaattgttaagactttgagtttgagagctgaaatctgtaggaccgcaacaaggggcgatcttgtggcagctgaaataactgtgtaatctatattattacatgtagcttagtaaaatcatgtcatacatcaaaggatgaattttgtggtgtttttagaatataataaagacgatgtattccaaga

SEQ ID NO: 3274 - DNA, 1849 bp, Arachis hypogaea
agtctggatttgactggatatgatctcaatgttgaccttttggacgttcatgcagacaagagcacatttcatcgctttgacaaatttaatcttaaatacaatccttgtgggcaaagtaggctgagggagatattccttaagcaagataatctcattcaaggtcgtttccttggtgaggtgacaaagcaagtgtttgctgatcttgcggccagtaaatatcagatggcagagtacagaatatcaatatatgggaggaaacaaagtgagtgggaccaactagcaagttggatagtcaataatgaactgtatagcgagaatgttgtttggctgatccagcttccaaggttgtacaacgtgtacaaagagatgggaattgtgacctcattccagaacatccttgacaatatctttattccactttttgaggttactgtggaccctgattcgcatcctcaactgcatgttttcttgaaacaggttgttgggttggatttggtggatgatgaaagcaaacctgaaagacggccaacaaaacacatgcctacacctgctcaatggactaacgtattcaatccagcattttcatactatgcctattactgttatgccaatctttacaccttaaacaagctacgtgagtcgaagggaatgacaacaattaaattccgtccacattctggagaggctggtgatattgaccacctagctgcaacctttcttacggcccacaacattgcgcatggaatcaatttgagaaaatctcctgttcttcagtatttatattatttagctcaaattgggctggcaatgtctcctctcagcaataactccctattcttagactaccatcgaaatccttttccaatgttcttctcacggggattgaatgtttcactttctaccgatgatccactccaaattcacttgacaaaggaaccattggttgaagaatatagcatagcagcttctgtatggaagctgagtgcatgtgatttgtgtgagattgcccgcaattctgtttatcaatcaggtttttcacatgcattgaagtcacattggataggtcaggagtactataagagggggccagatggaaatgatattcaaaaaacaaatgttccacatatacgattggaattccgagacatgatttggagagatgagatgcaacaggtttatctgggcaaagccgtcattcctgaagtagtggacagatagataatatgccggaggcacatagcatttgtatttggctctttctcacttgctgaatgattgaacctgttgcccttagcccacattacccacccggcaatccagcataaggttttaggcttttggcacgcacaaacttaggccgaaggcattttggttcgaagagttggacctgagacagagtatatatgtatcccacatgatgtcctagctgcgccatggatcaaatcaatttggtgctgtaaaagtgctttttcttttgttcatttgggggctagagtgaaaagagtggggttgccaataattgcaggtgcattgatcagtgatgcttgttgcagttagtaatatatgtgacataacaacgcagttgaaagagaggcatccagtctcaaattttgattccaatttgtttatagggtgttctttcattgttggtgtatgactataagagggcctcagttttggcattgtgaagtactgaagtgtatcaaaattacttaacaatatagctagataacccaatgaaacctaaaatcacaacaaaactttttttttcctactcaatccttcccttcaaattcaaattggttctcatctaattcaatccaattaaaattgattaaaattatactaa

SEQ ID NO: 3275 - DNA, 2183 bp, Oryza sativa
tcagaagtgccttgagttaagagactgttatctttttagagaagaggttgctccatgggagaaggaggtcataaatgatccctgtactccaaaacctgaccccaatccgttcacctatgtgcctgaaccaaaatcagagcatgttttccaaatggtcgatggtgttgtccatgtctatgcagataaagactatacggaaatactttatcctgttgctgatgcgacaaccttctttactgacttgcattatatgctccgtgtgatttctgctggaaacacaagaaccgtgtgccataaccggttaaatcttttagagcataaattcaaatttcatttgatgttaaacgcggatagggagtttcttgcccagaagactgcaccacatcgtgatttttacaatgtcaggaaggttgatactcatgtacaccactcagcgtgcatgaatcaaaaacacttgctgagatttataaaatccaaactaaggaaagaacctgatgaggttgtcattttcagagacggcacttatatgactctgaaggaggtttttgagagcttggacttaactgggtatgacttgaatgttgatttactagatgtccatgcggacaaaagtacatttcatcgttttgacaaattcaaccttaagtacaatccgtgtggccaaagtaggctcagagagattttcctcaaacaggacaatcttatccaaggtcgttttcttgccgagctaacaaagcaagttttctccgaccttacagcaagtaaataccagatggctgaatataggatttcaatctatgggaggaagcaaagtgaatgggacaaccttgcaagctggatagtgaacaatgaattgtccagtgaaaatgttgtctggctggttcagatcccacgcttatataatgtgtacaaggaaatgggtattgttacatcattccaaactcttctggacaacattttccttcctctgtttgaggtcaccattgatccagcttctcatccgcagcttcacgtcttcctaaagcaggttgtagggttagatttggttgatgatgagagtaaacctgaaaggcgtccaacaaagcatatgcctacacctgaacaatggaccaatgtcttcaacccagcattttcatattatgcatattactgctatgctaacttatacacactcaataagttgcgtgaatcaaaagggatgaccacaatcaaattccgtccacatgctggcgaggctggagacatcgatcacttggcagcaacatttcttctttgtcacaatatatcgcatggaatcaacttaaggaaatctcctgtgcttcaatatctatactatcttggccagattggtctggcaatgtccccattaagcaacaactccttgtttcttgattaccaccggaatcctttcccaatgtttttccaacgaggcctgaatgtttccctgtcaacggatgatccattgcaaattcacctgacaaaagagccattggtggaagaatacagcattgctgcttcactctggaagctcagttcttgtgatttatgtgaaatagctagaaactctgtctatcaatcagggttttcacatgctctcaaggcacactggattggcaagaactattacaaaagaggacctacagggaacgatattcataaaactaatgtgcctcacatcagggttcagtttagggacttgatttggagagatgagatgcgtcttgtatacctaaacaatgtcatcttacctgacgaggtggaccagtaacatgtacctggtgtatatggcgcggttgccatgggagttacatttcatgtttggttattggaagtcagcatgagaagtgttgtgatacacatcgtgtccgggttccaagccgacgagagagaaacttcaaaccaagtagtgcccccaaaaagcacaaccaaaagtacaacaagatatacacaataaaattggatcttactagattaggaaggatgaagcggctcagctgggtgctggattttggggtgtagtgtaggggaggcaggcaaacaattgcttcggcgtgattgtaattgtgcagcctctcgtttgtgaaggatgctataccaacattgcatgtactttaactggtcttacacagttatactcctgcgaataaagtggcgccgcttgttttgctccccagaaggaaaaa

SEQ ID NO: 3276 - DNA, 3164 bp, Glycine max
aacacagagcgaactcagagacagagagtgcttacgcagttttcactcactgtttcagtagtagggtttttctttatccccttttttcttctctcttctctctttcgttcaccacttcgacgctaagctaatatttcattcgttttcgtgaacgcgctaacggagaacgatttcggttatagagagagaaactaggagagatagagagcgattgatcatatatggatacgcacgcggtgcatttggccttggcggcgatcgtcggagcctccgtcgtggccgtgtcggcgtattacatgcaccgcaagacgctcgcgcagctgctggagttcgcgcgcacggtcgagagggaggctgacggcggcggcggttccgacaccgaaccgcctacggcgcatttgaagaagcgccttggcagctccaggatgcgtggcaacggcggataccggcgtggctccgcgtcgctgccggacgtcacggcgatctccggcgggttcgacggggaagagaagcggaacgggccagtgcacgtcgacgggattcctgtggggttgccaaggttgcacacgcttcgtgaaggaaaatcatctcaatctggttcctttaagagaagtcttttaagaccaacttctcccaagtcccctgttgcaagtgccagtgcctttgaaagtgtagaaggatcagacgatgaagataacatggcaggcgaagttaaactggatactacgtatctgcacacaaatgggactgttgtgccagaaggtaaaatcccatttgagactttacccaatcatgttaatgctaacggagagcagatggctattactccaagtatgatccgctctcatagtgtttccggtgacctgcatggtgtgcagcctgacccaatagctgctgacattctgaggaaagagccagagcatgaaactttcacaagattgagaataactcctcttgaggctccgtcacctgatgaagtagaagcttatgtggttctgcaagaatgccttgaaatgagaaaaagatacgtttttagtgaagctgttgctccatgggataaagaagttatatctgaccccagtacacccaagcctaatccagatccatttttatacattcttgaaggaaagtctgatcattactttgaaatgcgagatggggttattcatgtatatccagatagggatgcaaaagaagagctttttcctgttgctgatgcaactacatttttcactgatcttcatcacatacttcgagtcatagcagcagggaatataagaactttatgccatcatagactcaatcttctagaacaaaaattcaatcttcatttgatgttaaatgcggatagagaatttcttgctcagaaaagtgctccacatcgagacttctataatgttagaaaagttgacactcatgtccaccattcggcatgcatgaatcagaaacatcttttaaggttcataaagtcaaagctgagaaaagagcctgatgaggttgtaatatttcgagatgggacatatctaacattggaagaggttttcaagagtttagatttaactggatatgatctcaatgttgaccttttggacgttcacgcagacaagagtacttttcatcgctttgataagttcaatcttaaatacaatccttgtggtcaaagtaggctgagggagatatttctgaagcaggataatctcatacaaggtcgttttcttggtgagttgactaagcaagtgttttcagatcttgctgccagtaaatatcagatggctgaatatagaatatcaatatatggtaggaagcaaagtgagtgggaccaactagccagttggatagtgaataatgatttgtacagtgagaatgttgtatggttgattcagcttccacggttgtacaatgtgtacaaagaaatgggaattgtgacatcattccagaacatgcttgacaatatttttattccactttttgaggtcactgtcaacccagattcacatcctcagctgcatgttttcctgaaacaggttgttgggttggatttggtggatgatgaaagcaaacctgaaagacggccaacaaaacacatgcctacaccggagcaatggactaatgtattcaatccagcattttcatactatgtctattactgttatgcaaatctttataccttaaacaagcttcgagaatcaaagggaatgacgacaatcaaattccgtccacattctggagaggctggtgatattgaccaccttgcagcaaccttcctcacggctcacaacattgcacatggaatcaatttgaaaaaatctcccgtgcttcaatatttatattatttagcccagattgggctggcaatgtctcctttgagcaataactccctattcttagactaccatcggaatccttttccaatgttcttcttacggggtctgaatgtgtcactttctactgatgatcctctccaaattcacttaacaaaggaaccattggttgaagaatatagcatagctgcttctgtgtggaagttgagctcatgtgatttatgtgagattgcccgtaattcagtttatcaatcaggtttctcacatgctttgaagtcacattggattggtaaggagtacttcaagagtgggccacgtggaaatgacattcagagaacaaacgttcctcacattcggttggaattccgtgatacgatttggagagaggagatgcaacaagtttatttgggcaaagccatcattcctgaagtagtagacaaataagatgccagtggcattcgtttcatacacaatgaggtagaaagtatatttcctcaaacccatgcagcatcagagatgttctaaggctgaagacattacaacactggtctgatgatatgaaccagatacatactatagagaatcagcaagatcgctgagcttgagtatcgaacaacgtttacagctacaaatcgacgtaccgtgggaatttttttccttgtactattttgtgttattttaaaattattacgaataagttcatgcttaaagcaaaatgatgcctgttggtgttagaaatgtaagttatgatcctttgaagggagagatgttcatctcccaaaattttgattcccattgtttatcgataatattatatatagtgaacaacagttgagacttgaa

SEQ ID NO: 3277 - DNA, 3154 bp, Glycine max
gcgaactcagagacagagagtgcttacgcagttttcactcactgtttcagtagtagggtttttctttatccccttttttcttctctcttctctctttcgttcaccacttcgacgctaagctaatatttcattcgttttcgtgaacgcgctaacggagaacgatttcggttatagagagagaaactaggagagatagagagcgattgatcatatatggatacgcacgcggtgcatttggccttggcggcgatcgtcggagcctccgtcgtggccgtgtcggcgtattacatgcaccgcaagacgctcgcgcagctgctggagttcgcgcgcacggtcgagagggaggctgacggcggcggcagttccgacaccgaaccgcctacggcgcatttgaagaagcgccttggcagctccaggatgcgtggcaacggcggataccggcgtggctccgcgtcgctgccggacgtcacggcgatctccggcgggttcgacggggaagagaagcggaacgggccagtgcacgtcgacgggattcctgtggggttgccaaggttgcacacgcttcgtgaaggaaaatcatctcaatctggttcctttaagagaagtcttttaagaccaacttctcccaagtcccctgttgcaagtgccagtgcctttgaaagtgtagaaggatcagacgatgaagataacatggcaggcgaagttaaactggatactacgtatctgcacacaaatgggactgttgtgccagaaggtaaaatcccatttgagactttacccaatcatgttaatgctaacggagagcagatggctattactccaagtatgatccgctctcatagtgtttccggtgacctgcatggtgtgcagcctgacccaatagctgctgacattctgaggaaagagccagagcatgaaactttcacaagattgagaataactcctcttgaggctccgtcacctgatgaagtagaagcttatgtggttctgcaagaatgccttgaaatgagaaaaagatacgtttttagtgaagctgttgctccatgggataaagaagttatatctgaccccagtacacccaagcctaatccagatccatttttatacattcttgaaggaaagtctgatcattactttgaaatgcgagatggggttattcatgtatatccagatagggatgcaaaagaagagctttttcctgttgctgatgcaactacatttttcactgatcttcatcacatacttcgagtcatagcagcagggaatataagaactttatgccatcatagactcaatcttctagaacaaaaattcaatcttcatttgatgttaaatgcggatagagaatttcttgctcagaaaagtgctccacatcgagacttctataatgttagaaaagttgacactcatgtccaccattcggcatgcatgaatcagaaacatcttttaaggttcataaagtcaaagctgagaaaagagcctgatgaggttgtaatatttcgagatgggacatatctaacattggaagaggttttcaagagtttagatttaactggatatgatctcaatgttgaccttttggacgttcacgcagacaagagtacttttcatcgctttgataagttcaatcttaaatacaatccttgtggtcaaagtaggctgagggagatatttctgaagcaggataatctcatacaaggtcgttttcttggtgagttgactaagcaagtgttttcagatcttgctgccagtaaatatcagatggctgaatatagaatatcaatatatggtaggaagcaaagtgagtgggaccaactagccagttggatagtgaataatgatttgtacagtgagaatgttgtatggttgattcagcttccacggttgtacaatgtgtacaaagaaatgggaattgtgacatcattccagaacatgcttgacaatatttttattccactttttgaggtcactgtcaacccagattcacatcctcagctgcatgttttcctgaaacaggttgttgggttggatttggtggatgatgaaagcaaacctgaaagacggccaacaaaacacatgcctacaccggagcaatggactaatgtattcaatccagcattttcatactatgtctattactgttatgcaaatctttataccttaaacaagcttcgagaatcaaagggaatgacgacaatcaaattccgtccacattctggagaggctggtgatattgaccaccttgcagcaaccttcctcacggctcacaacattgcacatggaatcaatttgaaaaaatctcccgtgcttcaatatttatattatttagcccagattgggctggcaatgtctcctttgagcaataactccctattcttagactaccatcggaatccttttccaatgttcttcttacggggtctgaatgtgtcactttctactgatgatcctctccaaattcacttaacaaaggaaccattggttgaagaatatagcatagctgcttctgtgtggaagttgagctcatgtgatttatgtgagattgcccgtaattcagtttatcaatcaggtttctcacatgctttgaagtcacattggattggtaaggagtacttcaagagtgggccacgtggaaatgacattcagagaacaaacgttcctcacattcggttggaattccgtgatacgatttggagagaggagatgcaacaagtttatttgggcaaagccatcattcctgaagtagtagacaaataagatgccagtggcattcgtttcatacacaatgaggtagaaagtatatttcctcaaacccatgcagcatcagagatgttctaaggctgaagacattacaacactggtctgatgatatgaaccagatacatactatagagaatcagcaagatcgctgagcttgagtatcgaacaacgtttacagctacaaatcgacgtaccgtgggaatttttttccttgtactattttgtgttattttaaaattattacgaataagttcatgcttaaagcaaaatgatgcctgttggtgttagaaatgtaagttatgatcctttgaagggagagatgttcatctcccaaaattttgattcccattgtttatcgataatattatatatagtgaacaacagttgagacttg

SEQ ID NO: 3278 - DNA, 3037 bp, Solanum lycopersicum
actcttctctttcaaaataacacattttgtctttcttatacatgtctctctctagctctactattgagtagggtttctcagtttcattagatatcagctgttgttacttttacctgagcaaacaaaatggatgcacatactgttcatctagcgatggcggcactagttggagcatcgattgtagcggtatccgcttactatatgcaccggaaaaccctaaatcagttactagagttagcgaaaaccatagaaaagggtaaggaccttgatggcgtggaaacggaggaagacggcggcggatactcgaggaactatgcagtgaggaggcggaaccgtagccggagtaatggatattatcgcggttcttctgcttcatttccggatgtgacgatggccaattcaggtgaggttgaagaaaggaggaatggtccgatacatgtggaatctattccagccggtttacccaggcttcatactcttcctgaagggaaatcaagatctacacattcgcttagaccaacttctccgaagtctccagttgcaagtgcaagtgcatttgaaagtatagaaggatcagatgaggaagacaatattacggacactactaaacttgacactgcctatctacaaactaatgggaatgcgggcccagatgctgacggggaacaaatagctctggctgcagcagcaagtatgattcgctcacacagtgtctctggtgacttgcatggtgttcaacctgatccaatagctgcagatattctacggaaagagccagagcaagaaacatttgtacgactgaagatatcccctggagagacaccatctgccgatgaagcggaggtctaccgaaacttgcaagtttgtcttgaaatgagacagagttatgtattcaaggaggctgttgctccttgggtgaaagaagtaatctctgatccatgcaccccaaagccaaatccaaatccatttgaattcactcctgaaggaaaatctgatcattattttcagatggaagatggagttgttcatgtatatgcaaatgaagattctacggagaaactttttcctgttgctgatgctactacctttttcaccgacttccatcacatcctcaaagtaatagcagctggaaacatccgaactttatgccaccatcgcctagtgcttctggaacaaaaattcaatctacatttgatgctcaatgcggatcgagagttccttgctcagaaaagtgcacctcatcgtgacttctacaatgtgaggaaggttgatacgcatgttcatcactcagcatgcatgaatcagaagcatttgttgagattcatcaagtcaaagttaaggaaggagcctgatgaggttgtgatatttcgcgatggaacttatatgaccttaaaggaagtctttgagagcttagatttgactgggtatgacctcaatgttgacctcttagatgttcatgctgacaagagcacctttcatcgttttgacaaatttaatctgaagtacaatccctgcggtcaaagtaggctgagggaaattttccttaagcaggataatcttatacaaggtcgttttcttgctgagctaactaagcaagtgttttctgatctttctgcaagcaaatatcaaatggcagaatacaggatatcaatatacggccgaaagatgagcgagtgggaccaacttgctagctggatagtgaacaatgaactctacagcgagaatgttgtttggttgattcagcttccgagactgtataacatatacaaagaaatggggattgtgacatcatttcagaatatccttgacaacatctttctgcccttgtttgaggttactgttgacccagattcacatccccacctgcacatcttcttgaagcaggttgttggattggatttggtggatgatgaaagcaaaccagaaagaaggcctaccaaacacatgcctacacctgctcaatggactaacgtattcaatcctgcattctcatactatgtctactattgttatgctaatctctacaccctgaacaagttgcgtgagtcaaaaggcatgacgaccatcaaattccggccacatgctggggaggctggagatattgaccaccttgcagcaacatttttaacatcccataatattgctcatggtatcaatttgaggaagtctccggtacttcagtacttatattacttggctcagattggtttggcaatgtctcctcttagtaacaattctttatttttggactaccatcggaatcctttgcccatgttcttcttgaggggcctgaatgtttctctttcaacggatgatcccttgcaaattcacttaacaaaagaagccctggttgaagagtatagtatagctgcgtcagtttggaagttgagttcgtgcgatttatgtgagattgcccgcaattcagtttaccagtctggtttctcacatgcactaaagtcccactggattgggaaggagtattacaagagaggaccagatggaaatgatattcataggacaaatgtgcctcatatcaggcttgaattccgtgatatgatatggagggaggagatgcaacaggtttatctaggcaaggctgtatttccttcatttgttgacccatgatgtgcattggtaatgcatttatatcagttacaagagtacagattcagaatatctggaggcttggccatctagcgactctagaaaggttctccactatgagatatatctagaatttggatgttgaggggaaaataaggttggatgagtgctagaccttatcatttgatgatgtggtagtaacattcaataagagtgatctatgaagaccggtaattgaggaagcaactggagctctagcataaatagcacaactgcaaagcaatccactatctcaataaggaattatgtataatatatccgaatggtaggttaacaaacatcagatagatgcatcgtaagatatattctgaatgttgcatggtcccattgtactatattgacgtgttggctaaataaaaagatcgattgcacc

SEQ ID NO: 3279 - DNA, 3042 bp, Solanum lycopersicum
actcttctctttcaaaataacacattttgtctttcttatacatgtctctctctagctctactattgagtagggtttctcagtttcattagatatcagctgttgttacttttacctgagcaaacaaaatggatgcacatactgttcatctagcgatggcggcactagttggagcatcgattgtagcggtatccgcttactatatgcaccggaaaaccctaaatcagttactagagttagcgaaaaccatagaaaagggtaaggaccttgatggcgtggaaacggaggaagacggcggcggatactcgaggaactatgcagtgaggaggcggaaccgtagccggagtaatggatattatcgcggttcttctgcttcatttccggatgtgacgatggccaattcaggtgaggttgaagaaaggaggaatggtccgatacatgtggaatctattccagccggtttacccaggcttcatactcttcctgaagggaaatcaagatctacacattcgcttagaccaacttctccgaagtctccagttgcaagtgcaagtgcatttgaaagtatagaaggatcagatgaggaagacaatattacggacactactaaacttgacactgcctatctacaaactaatgggaatgcgggcccagatgctgacggggaacaaatagctctggctgcagcagcaagtatgattcgctcacacagtgtctctggtgacttgcatggtgttcaacctgatccaatagctgcagatattctacggaaagagccagagcaagaaacatttgtacgactgaagatatcccctggagagacaccatctgccgatgaagcggaggtctaccgaaacttgcaagtttgtcttgaaatgagacagagttatgtattcaaggaggctgttgctccttgggtgaaagaagtaatctctgatccatgcaccccaaagccaaatccaaatccatttgaattcactcctgaaggaaaatctgatcattattttcagatggaagatggagttgttcatgtatatgcaaatgaagattctacggagaaactttttcctgttgctgatgctactacctttttcaccgacttccatcacatcctcaaagtaatagcagctggaaacatccgaactttatgccaccatcgcctagtgcttctggaacaaaaattcaatctacatttgatgctcaatgcggatcgagagttccttgctcagaaaagtgcacctcatcgtgacttctacaatgtgaggaaggttgatacgcatgttcatcactcagcatgcatgaatcagaagcatttgttgagattcatcaagtcaaagttaaggaaggagcctgatgaggttgtgatatttcgcgatggaacttatatgaccttaaaggaagtctttgagagcttagatttgactgggtatgacctcaatgttgacctcttagatgttcatgctgacaagagcacctttcatcgttttgacaaatttaatctgaagtacaatccctgcggtcaaagtaggctgagggaaattttccttaagcaggataatcttatacaaggtcgttttcttgctgagctaactaagcaagtgttttctgatctttctgcaagcaaatatcaaatggcagaatacaggatatcaatatacggccgaaagatgagcgagtgggaccaacttgctagctggatagtgaacaatgaactctacagcgagaatgttgtttggttgattcagcttccgagactgtataacatatacaaagaaatggggattgtgacatcatttcagaatatccttgacaacatctttctgcccttgtttgaggttactgttgacccagattcacatccccacctgcacatcttcttgaagcaggttgttggattggatttggtggatgatgaaagcaaaccagaaagaaggcctaccaaacacatgcctacacctgctcaatggactaacgtattcaatcctgcattctcatactatgtctactattgttatgctaatctctacaccctgaacaagttgcgtgagtcaaaaggcatgacgaccatcaaattccggccacatgctggggaggctggagatattgaccaccttgcagcaacatttttaacatcccataatattgctcatggtatcaatttgaggaagtctccggtacttcagtacttatattacttggctcagattggtttggcaatgtctcctcttagtaacaattctttatttttggactaccatcggaatcctttgcccatgttcttcttgaggggcctgaatgtttctctttcaacggatgatcccttgcaaattcacttaacaaaagaagccctggttgaagagtatagtatagctgcgtcagtttggaagttgagttcgtgcgatttatgtgagattgcccgcaattcagtttaccagtctggtttctcacatgcactaaagtcccactggattgggaaggagtattacaagagaggaccagatggaaatgatattcataggacaaatgtgcctcatatcaggcttgaattccgtgatatgatatggagggaggagatgcaacaggtttatctaggcaaggctgtatttccttcatttgttgacccatgatgtgcattggtaatgcatttatatcagttacaagagtacagattcagaatatctggaggcttggccatctagcgactctagaaaggttctccactatgagatatatctagaatttggatgttgaggggaaaataaggttggatgagtgctagaccttatcatttgatgatgtggtagtaacattcaataagagtgatctatgaagaccggtaattgaggaagcaactggagctctagcataaatagcacaactgcaaagcaatccactatctcaataaggaattatgtataatatatccgaatggtaggttaacaaacatcagatagatgcatcgtaagatatattctgaatgttgcatggtcccattgtactatattgacgtgttggctaaataaaaagatcgattgcacctattt

SEQ ID NO: 3280 - DNA, 2997 bp, Triticum aestivum
  misc_feature (96)..(96): n is a, c, g, or t
  misc_feature (104)..(104): n is a, c, g, or t
  misc_feature (128)..(128): n is a, c, g, or t
  misc_feature (370)..(370): n is a, c, g, or t
  misc_feature (389)..(389): n is a, c, g, or t
  misc_feature (687)..(687): n is a, c, g, or t
  misc_feature (2687)..(2688): n is a, c, g, or t
gggtggacgaggcgctcctcgccgccgccgcctacatgcagatccccacgggcttgccgaggctgcaagtggggcccgagggcaataaacaaatcnttcgttcnggttcaagcagacgggttggattnatcagaccaaattcacccaagtccccttttgctagtgcaagtactttagagagtgcagaggggtcagatgaggatgccgcgacgaaagtcaacggcaaacttgataatggccatgcgagcacaaatggaaatcttgagggagaacacaaaggaaattcagttgtggagaatggggctggaacaccattagatgcaaaaaacatgactcggtctcatagtatatccaatgatcttcatgcggntcaacctgatccagttgcngcagatattcttcgaaaagaacctcagcaagaatcatttatcaagctgttaactgcacctcatgagattccatctcctgatgaaatagaggtctacaaaatccttcagaagtgtctcgagttaagagattgttacctttttagagaagaggtcgctccatgggagaaggaggtcataaatgacccctgtacaccaaaacctaatcctaacccattcacttttgtgcctgaaccaaaatcagagcatgttttccaaatggtcgatggtgttgtccaagtctatgcggataaagaccgtncggaaaggatttatcctgttgctgatgctacaacctttttcaccgacttacattatgttctccggatgactgccgcggggaacacaagaactgtctgccataaccgattgaatcttctagaacataagttcaaatttcatctgatgttaaacgcggacagggagtttcttgcccaaaaaactgcaccacatcgtgatttttacaatgttaggaaggtcgacactcatgttcaccactcagcatgcatgaatcagaaacatttgctgagattcatcaagtccaaactgagaaaagaacctgatgaggttgtcattttcagagatggtacatatatgactttgaaggaggtttttgaaagcttggacttaactgggtatgacttgaatgttgatttgctagatgtccatgcggacaaaagtacgtttcatcgttttgacaaattcaaccttaaatacaatccatgtggccaaagtaggctacgggagattttccttaaacaggacaatcttattcaaggacgatttcttgctgagctgacgatgcaagttttttctgaccttaatgcaagcaagtatcagatggctgaatataggatttcaatctatgggaggaagcaaagtgagtgggaccaacttgcgagttggatagtaaacaatgaattgtacagtgaaaatgttgtttggttgattcagattccacgcttatataacgtgtaccagcaaatgggcattgttacatcatttcaaaatcttcttgacaacattttccttcctctgtttgaggttactattgatccagcttcgcacccgcagcttcatgtcttcctaaagcaggtcgtagggttagatttggttgatgatgagagtaaacctgaaaggcgtccaactaagcacatgcctacacctgaagaatggacgaatgtcttcaacccagcattttcatattatgcatactactgctatgctaacttgtacacactgaacaagctgcgtgagtcaaaggggatgaatactatcaaattccgtccacatgccggtgaggctggagacgttgatcacttggcagcaacatttcttctttgtcacagtatatcacatggaatcaatttaaggaagtctcctgtgcttcaatatctgtactaccttggtcagattggtctggcaatgtcccctctcagcaacaactccttgtttcttgattaccatcggaacccttttcctatgtttttccaacgaggactgaatgtctcgctgtccacggatgatccattgcaaattcatctgacaaaagagccattggtggaagaatacagcattgctgcctcgctatggaagctcagttcttgtgatctatgtgaaattgcgagaaattctgtgtatcaatcagggttttcacatgctctcaaggcacattggattggcaagaactactacaagagaggcccttcagggaatgatatccacagaacgaatgtgcccaccatcaggattgaattcagggacctgatctggagagacgaaatgcagctcgtctacctcaacaacgtcatcttgcctgacgaggtggaccagtaagaggcacctaggtgtataagctgtagccgtcgtgggggatgaatcatacttcctccagatgaataccatctcaccaaacaaccaccaccaaagtggaagaagaagacctacaaaataatttcagatcgcaggtgcggctcaccattgtgctagactagcattacagggaggcaagtgctcggtgtgaaactgtcgcccttttcgcctgtaaaggattgtaattaacaaaggatgctgtgactgttataacaatatattgctaataaagtgatgccgcactgtttcgctctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanncctccgggggggggggggggaaaaaaatccccaaaaaaaggtttataaaaaacccccaaaaagggggttttttaaaaaacggggaagaaaaaaaacccgggggtaacaaaaaaaaaacgggtgaaaaaaaaaacccctttttaaaaggggggtaaaaaaaaaaaaaagggcacaaaatatttcccccaaaaaaaaagttccccccctcaaaagggaaaaaggtgccccccctttttgggaaaaaaaaacaggggggggggtgtggtggttaacacaaaattgggacaaaaaaatttaaaacccccttag

SEQ ID NO: 3281 - DNA, 3114 bp, Populus trichocarpa
gaaacaaaacacaaacctcctctctattcacttagctctctccctgtctctgtgtcctttcagctcactatcaacacagctcactacaatccttcaaaaatccacctgaacagattattttagagagagaaacagttttttagaaagagaaagtaatggaagcgtactcgctgcatctagcgatggcggctctagtaggagcatcatttgtggctgtatccgcttattatatgcaccgcaaaaccctaaatcaacttctcgagttcgccaagacgcgtggctcggcttcgttaccggacgtgacggcgatatacggtggtggaattgatggagaggagaaacgtaatggtcaggtggtttatgtcgaagggattccggctggattgccgaggcttcatactttgcctgaagggaaatcttctgggcatatcaagaggcctggaagttttatcagaccaacttctccaaagtctcctggtgctagtgctagtgcctttgacagcgtggaaggatcagatgatgaagataacatgactgacaattctaaactagacactacatatctgcatgttaatggaaatgctgtgaaccaagtccctatacctgcttcaagcatgattcgatcccatagtgtgtctggtgacttgcatggtgttcagcctgatcctattgctgctgatattctaaggaaagaaccagaacaggaaacttttgcacgacttaaaatttctcctatggcagaggtgccatcaccagatgaagtggattcctatatagttcttcaagaatgtcttgaaatgcgaaaaagatatgtattcaaggaagcaatcgcaccatgggagaaagaaattatttctgaccccagtacaccaaagcctaatcctgaccctttctcctttacaccagagggaaaatctgatcattattttgagatgcaagatggggtaatccatgtctatccaaataaagactctaaggaagaactttttcctgttgctgatgcgacaacgtttttcactgatttgcatcacatacttcgagttattgcaattggaaatatcagaactctatgtcatcatcggttgaatctcctagaacaaaaattcaaccttcatttgatgcttaatgcggatagagagtttcttgctcagaaaagtgctccacaccgtgacttttataatgtcaggaaagttgatacgcatgttcatcattctgcatgcatgaaccagaaacatcttttaaggtttataaagtcaaaactgaggaaagagcctgatgaggttgtaatttttcgagatggaacatacttgacattgaaagaagtgtttgagagtttggatttgactgggtatgatctcaatgttgaccttttagatgttcacgcggacaagagcacatttcatcgctttgataagttcaacctgaagtacaatccttgtggtcagagtagacttagggagattttccttaaacaagacaatcttatccaaggccgtttccttggtgaactgacaaaacaagtcttttctgatctttctgcaagtaaatatcagatggctgaatacagaatatcaatatacggtagaaaacagagtgaatgggaccaattggctagttggatagtgaataatgaattgtacagtgaaaatgttgtttggttaatccagcttcctcgactgtacaatatctacaaggaaatggggattgttacatcatttcagaatattcttgataatatcttcattccgcttttcgaggtcacaattgatccagattcgcatcctcagttgcatgttttcttgaaacaggttgttgggctggacctggttgatgatgaaagcaaacctgaaagacgaccgacaaagcacatgcctacaccaactcaatggaccaatgtgttcaatcctgcattttcatattatgtttattactgttatgccaacctccacacattaaacaagcttcgtgagtcaaagggcatgacaactatcaaattccgtccccattctggagaggctggcgatactgaccatcttgctgcaacatttcttacatctcataatattgcccatgggatcaatttgaggaaatctccagttcttcaatatttgtattatctagcacaaattggcttagctatgtctcctctgagcaacaattccttatttttagactaccataggaatccttttcctatgtttttccaaaggggtctcaatgtttccctttctactgatgatccgctccaaattcacttaacaaaagagcccttggtggaagaatatagcatagctgcttctgtgtggaagttgagttcatgtgatctgtgtgagattgctcgaaattcggtctaccaatcaggtttctcacatgctttaaagtcgcactggattggtaaagagtactacaagagaggaccagacggaaacgatattcacaggacaaatgtgcctcatatccgggtggaatttcgagatgcgatatggagagatgagatgcaacaagtttatcttggcaaggccgttatccctaaagaagtggacaagtaaatagcgggagtttccttagcccatccttacgtgtttacttaaattataaaggtcaacagaattcaactttctcatcaaacatgagatggctgtacacttctgatcatgcacctgataatggcaagaaaaaataaaaatgggggaatggcttcatgcacagcaacagcaaagctgatagaagcttgtgagttttgagaacgaaggccatgcataagacgcaattgttgacatggtgatctgcagtgtcttggaagaaatgccgatctcgtgacagaacaaataactagaattaagtatattaggtcaatattaagagtagcattacggggtatagtatgagttatgcatggttcactcattgcaatgtcagatgttagtgtgaccaataatagcaaggacaggacaggacaatctcgtactttaattttgtttccagatgaatatgcctcatcaaattttggttcggttttatactatgcagatgtctgtaaccaaaacatttccctggagtaaattcctctgttgctcccggttgattttttttctaattcgcgacattttctaa

SEQ ID NO: 3282 - DNA, 3005 bp, Solanum phureja
acatattttgtcattcttatacataatctctctctagctctactagtgagtagggtttctcagtttcattagctatcagctgttgttgctttacctgaacaaacaaaatggatgcacatacggttcatctagcgatggcggcactagttggagcatcgattgtagcggtatccgcctactatatgcacagaaaaaccctaaatcagttactagagtttgcaaaagccatagaaaaggatagggaccctgatgacgtggaaacggaggatggcggcggcggatactcgaggaactacgctgtgaagaggcggaaccgtagcgggagtaaagggagtaatggatattatcgcggttcttctgcttcatttccggatgtgatgatggcaaaatcaggtgaggttgaggaaaggaggaatggtccgatacatgtggattctattccagccggtttacccaggcttcatactcttcctgaagggaaatcaagatctacacattcgcttagaccaacttctccgaagtctccagttgcaagtgcaagtgcatttgaaagtatagaaggatcagatgaggaagacaatattacggggactactaaacttgacactgcgtatctacacactaatgggaatgcgggcccagatgctgacggggaacaaatagctgtggctgcagcagcaagtatgattcgctcacacagtgtctctggtgacttgcatggtgttcaacctgatccaatagctgcagatattctacggaaagagccagagcaagaaacatttgtacgactgaagatatcccctggtgagacaccatctgccgatgaagcggaggtctaccgaaacttgcaagtttgtcttgaaatgagacagagttatgtattcaaggaggctgttgctccttgggtgaaggaagtaatctctgatccatgcaccccaaagccaaatccaaatccatttgaatttactcctgaagggaaatctgatcattattttcagatggaagatggagttgttcatgtatatgcaaatgaagattctacggagaagctttttcctgttgctgatgctactacctttttcaccgacttccatcacatcctcaaagtaatagcagctgggaacatccgaactttatgccaccatcgcctagtgcttctggaacaaaaattcaatctacatttgatgcttaatgcggatcgagagttccttgctcagaaaagtgcacctcatcgtgacttctacaatgtgaggaaggttgatacacatgttcatcactcagcatgcatgaatcagaaacatttgttgagatttatcaagtcaaagttgaggaaggagcctgatgaggttgtgatatttcgcgatggaacttatatgaccttaaaggaagtctttgagagcttagatttgactgggtatgacctcaatgttgacctgttagatgttcatgctgacaaaagcacctttcatcgttttgacaaatttaatctgaagtacaatccctgcggtcaaagtaggctgagggaaattttccttaagcaggataatcttatacaaggtcgttttcttgctgagctgactaagcaagtattttctgatctttctgcgagcaaatatcaaatggcagaatacaggatatcaatatacggccgaaagatgagcgagtgggaccaacttgctagctggatagtgaacaatgaactgtacagcgagaatgttgtctggttgattcagcttccgagactgtataacatatacaaagaaatggggattgtgacatcatttcaaaatatccttgacaacatctttctgcccttgtttgaggtcactgttgacccagattcacatccccacctgcacatcttcttgaagcaggttgttggattggatttggtggatgatgaaagcaaaccagaaagaaggcctaccaaacacatgcctacacctgctcaatggactaacgtattcaatcctgcattctcatactatgtctactattgttatgctaatctctacaccctgaacaagttgcgtgagtcaaaaggcatgacgaccatcaaattccggccacattctggggaggctggagatattgaccaccttgccgcaacatttttaacatcccataatattgctcatggtatcaatttgagaaagtctccggttcttcaatacttatattacttggctcagattggtttggcaatgtctcctcttagtaacaattctttatttttggactaccatcggaatcctttgcccatgttcttcttgaggggcctgaatgtttctctttcaacggatgatcctttgcaaattcacttaacaaaagaagccctggttgaagagtatagtatagctgcgtcagtttggaagttgagtgcatgtgatttatgtgagatcgcccgcaattcagtttaccagtccggtttctcacatgcgctaaagtcccactggattgggaaggagtattacaagagaggaccagatggaaatgatattcataggacaaatgtgcctcatatcaggcttgaattccgcgatatgatatggagggaggagatgcaacaggtttatctaggcaaggctgtatttccttcatttgttgacccatgatctgcattgctaatgcatttatatcacagacaagagtatacgttcagaatatctgggggcttggccatccagagactctagaaagcttctccaccatgagatatatctagaatttggatgttgaggggaaaataagatttgatgaatgctagaccttattattcaataagagtgatctatgaagactggtaattgaggaagcaactggagctctagcatatatatagcacaactgcaaagcagtccactatctgaataaggaattatgtataatatatcctagtggtaggttaacaaactttagatgcattgtaagatgaattctgaatgttgcatggtcccgttgtaccatattttgacatgttggctaaaataaagagattgattgcg

SEQ ID NO: 3283 - DNA, 2066 bp, Pennisetum glaucum
tccatgggagaaggaagtcataaatgacccatgtactccaaaacctaaccccaacccattcacttatgtgcctgaacaaaagtcagagcatgtcttccaaatggttgatggtgttgtccatgtttatgagaacaaggattatacagagagcatttatcccgtggctgatgcgaccgccttcttcactgacctgcattatattctccgagtgacagctgcagggaacacaagaactgtctgccataatcggttgaatcttcttgagcataaattcaaatttcatctgatgttaaatgcggatagggaatttcttgcccagaagactgcaccacatcgtgatttttacaatgtcaggaaggttgacactcatgttcaccactcagcctgcatgaaccaaaagcatctgctgaggttcattaaatccaaactaagaaaagaacctgatgaggtggtcattttcagagatggtacttatatgactttaaaagaggtttttgagagcttggatttaacagggtatgatttgaatgttgatttgctagacgtccatgccgacaaaagtacatttcatcgttttgacaaattcaacctaaaatacaatccatgtggccaaagtaggctgagagagattttcctcaaacaagacaatctcattcaaggtcgtttccttgctgagttgacaaagcaagttttctcagacctttctgctagcaaatatcagatggctgaatataggatttcaatctatggaaggaagcaaagtgagtgggaccaacttgcaagttggatagtgaacaatgaattgtacagtgaaaatgttgtctggctggttcagattccacgcttatataatgtgtacaaggaaatgggtattgttacttcattccaaaatcttcttgacaacattttccttcctctgtttgaggttactatcgatccagcttcacacccacagctccatgtcttcctaaagcaggttgtagggttggatctggttgatgatgaaagcaaaccagaaaggcggccaactaagcacatgcccacacctgaacaatggactaatgttttcaaccctgcattttcatattatgcgtactactgctatgctaacttatacacattaaataagctgcgtgagtcaaaggggatgactactataaaattccgtccacatgctggggaggctggagatgttgatcacttagctgcgacatttcttctttgtcacaacatatcacatggaatcaatttaaggaagtctcctgtgcttcagtacttgtactaccttggtcagattggtctagcaatgtccccattgagcaacaactccttgtttcttgattatcatcgcaaccctttcccaatgttcttccagcgaggtctgaatgtctcattgtctacggatgatccgttgcaaattcacctgacaaaagaaccactggtggaagaatacagcattgctgcttcgctgtggaaactcagttcttgtgatttatgtgaaattgcgaggaattctgtctatcaatctggattttcacatgctcttaaggcacactggattgggaagaactactacaagagaggccctgctggaaatgatattcacagaacgaatgtaccgcacatcagggtccaatttagagacatgatctggagaaatgaaatgaaactggtttacctgaacaacaacatcttaatatctgaagacttggaccagtaagatgcctgcgcttgtgtatatcccatatttgctatgggaatcatacttcatgtttggtcgctggaagtaggcatgaggaggtatgtgatctggagtggctgggccggcaaaacttccagaaatgccccaagcacaccaaacgatagaatacctataaaacaataatgaggcaaagtgatcaagtgaagcggcacacaggtgcgttatagagggtgcattgtgaggtgcaacttgtaaaggatgtaatcgacagtgtagtaccaactccggttagattttaccatgcgaataaagtggtgccgcttgcccggatgaaattggaaaactgggtcgcattcttcgaggc

SEQ ID NO: 3284 - DNA, 3501 bp, Theobroma cacao
cccgaataaaacagagcttctctctctgtgttttcttcctttgccgaagactgttgagttttagtaggttttttggattaacaattctctctgctctctgtttttcttttgtttgagagtgggaaggacagtgaggagaaaattttgtggagagttctagatggacacgtacactgtccatattgcgatggcggctctggtcggagcgtcgctggtggctgtgtcggcgtattatatgcacaggaaaacgctgagtcagctgctggagttcgccaagacggttgagagagagagggaggaggtttcggacggagagtctccgcagcactccaagaaacggcgcggacaccactcgcgccggaaggggaacggatactaccgccgtggctcggcttctctgccggatgttacggtgatatccggcgggattgatggagaagagaaacgcaacggtgctatccatgttgacgggattccccccgggttgccgaggctccatacgctgcctcaagggaagtctggtgcccatgcaacttcagctaagagatcttcaagtcttatccgacctacttctcccaagtcccctgttgctagtgcaagtgcctttgagagcatagaaggatcagatgatgaagataatatgactgacaattctaagatagacactacttatctgcatactaatggaaaagccggcccgaatttgcctgaccacattaatgccaatggagagacaatccaaatagctgcttcaagcatgattcgatcccatagtgtatccggtgacctccatggcgttcagcctgatcctattgcagctgatatcctaaggaaagagccagagcaagaaacttttgcacgacttagaattgcccctactgaggtaccatcagcagatgaagttgaggcctatgtggttctgcaagaatgccttgaaatgcggaaaagatatgtattcaaggaaccagttgctccttgggagaaagaagttatatcagaccccagtacaccaaaacctaatccagagccatttttttatgctcctgaggaaaaatctgatcattattttgagatgcaggatggagtaattcatgtctatgcaaataaagactcaaaagaggagctctttcctgtagctgatgcgacaacctttttcactgacttgcatcacatacttcgtgttatagcggcagggaatattagaactctatgtcatcaccggctaaatcttctagaacagaaattcaatcttcatttgatgctcaatgcggatagagaatttctagctcagaaaagtgcaccacatcgggacttttataatgtgaggaaagttgatactcacgttcatcactcagcttgcatgaaccagaaacatcttttaaggtttataaagtcaaagttgaggaaggagccagatgaggttgtaatatttcgagatgggacatatttgaccctgaaagaagtttttgagagcttggatttaactgggtatgatctaaatgtggaccttcttgatgttcatgcagacaagagtacctttcatcgctttgataaattcaatcttaagtataatccctgtggtcaaagtagactcagggagattttcctcaagcaagacaatcttatccaaggtcgattccttggtgagctgacaaagcaagtgttttctgatcttgctgcaagcaaatatcagatggctgaatacagaatatcaatatatggcaggaagcaaagtgagtgggaccaactggctagttggatcgttaataatgacttgtacagtgagaatgttgtttggttaattcagatccctcgactttacaatatttacaaggagatgggaattgttacgtcatttcagaacattcttgacaacatctttattcctttatttgaggttactgtggatcctgattcacatcctcatttacatgttttcttgaagcaggttgtagggttggatttggtggatgatgaaagtaagcctgaaagacgccccacaaaacacatgcctacaccggatcaatggactaatgtatttaatcctgcatactcctactatgtgtattactgctatgctaacctctacaccttaaacaagcttcgtgagtccaaaggcatgacaaccataaaattcaggccacattctggggaggctggtgacattgaccacctggcggcaacatttctaacagctcataatattgctcatggaatcaatttaaggaaatctcctgtgctacagtatctttattatttggcacagattggcctggctatgtctcctttgagcaacaattcattgtttttggactatcatcggaacccttttccaatgtttttcctacggggtctgaatgtttccctttctacggatgatccacttcaaatacacctaacaaaggagcctttggtggaagagtatagcatagctgcttctgtgtggaagctgagttcatgtgatctatgtgagattgcccgtaattcagtctaccagtcaggtttttcacatgctctgaaggcaagtgctctttttcttctcactggatcggaaaggagtactacaagagaggacctgatggaaatgatatacacaggacaaatgtacctcatatccggctggaatttcgtgacactatctggaaagaggagatgcagcaggtttatctgggcaaggccattatccctcaagaagtggacaagtaacgtgcatcatactgcacagggtccattcttgaacatcacacttattttaggaggaggcaaagaacctgccttctacctacaccctggataaaagggatgacgacttcgatgagaacagagaaatggtagggacaagcaacaagatggatcattgaatttaacaaaggtctacagcctgtgttcaaccctgttatacgtgatgcaattgtcagagagttgtgcagtatcccagttctcagagcatggtgtattaataaccaaatcaaatacaagcctagaacacggggtagcaaattacaagcatgaaacattcaactgagacaaaataaccaaaataatgatgtccagtgtaaggctatataatactctgttacagtttactacggtgtatgctattttactcatcgcaagatgggaagaatgctctcttgcatcaacaaaattttgacccaaatttatttgaaggggtgcggacatctcatggaacacttcacacgtcatgaataaatttacttttctttcatctcatttttcgagtgaatgtctgtacattgatagtgcattaattacgagcaaaacatgcttgccataaccctttcttgtttttgtgtttcttccttccaagtgaaaaggtaaattaacccaacaaggtctttgtggcctcgacattttaaaggttactagagttttgctggcatcattttccccaaatatttctaagcatccaccagggtggatggaacccacaaatttgaacctgtttagattttttggtaagaaaagagtgtaaaatcc

SEQ ID NO: 3285 - DNA, 1833 bp, Cichorium intybus
agtggttatgtttatgcgataagattcaaagagaagctttttccagttgctgatgcaacaacatttttcactgatttgcatcacattcttaagataatagctgctggaaatgcaagaacagtttgtcatcatcgccttggtcttcttgaacagaaattcaaccttcatttgatgctgaatgctgacaaagaattcctagctcaaaaaagcgcaccgcatcgtgacttttataatgtccgtaaagttgacactcatgttcatcactctgcatgcatgaatcaaaagcatcttttgaggttcataaagtcaaagttaagaaaagaaccggatgaggttgtaatatttcgtgatggtacatatctgaccttaaaagaggtctttgagagcttggatttaacagggtatgacttgaatgttgatttattagacgtgcatgcagacaaaagcacttttcatcggtttgataaattcaatctgaaatacaatccatgtggtcaaagtaggcttcgtgaaattttcttgaagcaagataatctaattcagggtcgtttccttgctgaggtaacaagccaagtgtttgcagaccttgaagcaagtaaatatcaaatggctgaatacagaatatcaatatacggaagaaaacaaagcgagtgggacaatttagcaagttggattgtaaacaacgaattatacagtgaaaacgttgtctggttaattcagctaccccgactttacaacatatacaaagaaatgggaattgtgacatcattccagactattctagacaatgtctttcttccactctttgaggtcaccgtggaccccgaatcacaccctcagttgcatgttttcttaaaacaggtggtgggattggatttggtggatgatgaaagcaagccagaaaggcgtccaacaaagcacatgccaacaccttcacaatggacaaatatattcaatcccgctttctcatattacgtctattattgttatgcaaatctctataccctaaataaacttcgcgagtcaaaaggcatgaccaccatcagattccgtcctcattgcggcgaggcgggtgacatcgaccacttagctgcctcgtttctcacaactcacaacattgcacacggaatcaatctcagaaaatcccctgttcttcaatatctttactaccttgcccagattggtcttgcgatgtcacctttaagcaacaactcgttatttttggattaccatcggaatccatttccgatgttttttctaagagggcttaatgtttctctttctactgatgacccgttacaaatccatctcactaaggaaccgttagtggaagaatacagtattgctgcttctgtatggaagttgagttcgtgtgatctttgtgagattgctcgtaactccgtgtaccaatcaggtttctcgcatgttctcaagtctcattggattggacaggagtactttaaaagaggaccagatggaaacgatattcacaagacaaatgtaccacatattcgacttgaatttagagacgtgatatggagagaggagatgcaacaggtttatctggggaaggctaatttccctcaatacattgagacctaattactaaattgcccatgtttgttcatacaatcttaataattatagcaatagcgagttggtacctggtctaggctttttagtatatttaataccataaaatgaataataagtgttatttgtttaggttgcctcaattttggttttcataatcagatgctgaatgggttgggttggttaaatttggtgaagttgaaaaggatttaatggtaattgaaacccagctgttttgat

SEQ ID NO: 3286 - DNA, 1593 bp, Coffea canephora
cgaggttgtcatatttcgtgatggtacctatttgacattgaaagaagtttttgagagcttggatttatctgggtatgatctgaatgttgacctactggatgttcatgctgacaagagcacctttcatcgatttgacaagtttaatcttaagtacaacccttgtggtcaaagtaggctaagggagatttttctgaagcaggaaaaccttatacagggtcgtttccttggtgagctgactaagcaagttttttctgatcttgaagcaagcaaatatcaaatggctgaatacagggtatccatatatggcagaaagcagagtgagtgggaccagctggctagttggatagtaaacaatgacttgtatagcgagaatgttgtctggttgattcagcttccaagactctacaatgtctacaaggaaatgggaattgtgacatcttttcagaacattcttgataatgttttccttcctttgtttgaggttactgtggatccagattcacatcctcagttgcatgttttcttgaagcaggtggttggatttgatttggtggatgatgaaagtaagccagaaagacgtcctacgaaacacatgccgacacctgctcagtggaccaacatattcaatcctgcatactcatactacatttactattgttatgctaacttatacaccttaaataagcttcgcgagtcaaaaggaatgaccactatcaaactccgtccacattctggagaggctggtgatgttgaccaccttgcagcgacatttcttactgctcacaatattgcgcatggaatcaacttgagaaaatctcctgtacttcagtatttgtactacctggcccagattggccttgccatgtctccactgagcaacaactcattgtttttggactaccatcggaatccatttcccatgtttttcctgcgtggcctcaatgtgtcgctttcaactgatgatcctttgcagattcacctaacaaaagagcccctcgtggaagaatacagcattgcagcttctgtttggaagttaagttcatgtgatatatgtgaaattgcacggaattcagtttatcaatctggtttctctcatgcactgaagtctcattgggtcgggaaggaatactacaagagaggaccagacgggaatgatattcacaagacaaacgtacctcatatccgccttgaatttcgtgatatgatttggagagaggagatgcaacaggtttatttgggaaattctatatttgctgaacatattgacccataataagcttggctggctttcttttgcgagctggaatttttacattctatgtggaggaaaagtgcaaaaaagccaaggacctgcggaatagaactttagaacagagtagtatatgcatctcaggaaaaattaaagaaaagaaataaagcaaaagccaaacaggacatatccatgtaatagagaatagtacaaggtaactttgtattttactttgtataaacatgtataatgtgatccgtcacccacggcaactgaatgttgaagcttatttgaaaacacaataatgagttcttgagttgcgactcagttgttgccaaggttat

SEQ ID NO: 3287 - DNA, 3335 bp, Gossypium hirsutum
acgagcggccagtatcaacgcagagtacatgggcccgtaaaacagagcttctctctctgttctcttcattcgcccaagagtgttgtagtagtttctacttagggtctttttgggttttttttttttctatttttccttcttgctttctatctttttttggctgtagatttggaaagtttggaacgaaaaaaaaaagagttttagagagttctaaatggacacgtacactgtccatcttgcgatggcggctctggttggagcttcgctggtggccgtgtcggcgtattacatgcacaggaaaaccctaaatcagttgctggagttcgccaaaacggtggagagggaggatatctcggagggagagtcgccgctgccctccaagaaaaggcgcgcccaccactctcgccggaagggcagcggatattaccgccgtagctcctcttctttgccggatgtttggatgatgtacggcgggattgatggagaagagaaacgtaacggcactatccatgttgacgggattccccccgggttgccgaggctccatatgctgccggaagggaagtctggtggccatgcaacaccaactaagaaatctggaagtgttatgcgacctacttctcccaagtcccctgttgctagtgcaagtgcgtttgagagcatggaaggatcagaggatgaagataatatgactgacaattctaagattgaccttacatatcttcatactaatggaaatgctggcccaaatttgccggaccacattaatgctaatggagaggcgattcagatagctgcttcaagcatgattcgatctcatagtgtatcaggtgacctccatggtgttccacctgatcctattgcagctgatatcctaaggaaagagccagagcacgagacctttgcacgacttaatatttcccctactgaggtaccatcaccggatgaagttgatgtctatgtagttctgcaagaatgcctagaaatgcggaaaagatatgtattcaaggaggcagttgctccttgggagaaagaagttatatcagacccaagcacaccaaaacctaatccagcaccctttttttatgctcctgagggaaaatctgatcattattttgagatgcaagatggagtaatacatgtttatgcaaataaagattcaaaagaagagctctttcctgtagccgatgctacaacctttttcactgacttgcatcacatacttcgagttatagcagcaggcaatatcagaactttatgtcatcatcggctaaatcttctagaacaaaaattcaatcttcatttgatgcttaattcggatagagaatttctagctcagaaaagtgcaccacatagggacttctataatgtgaggaaggttgatactcacgttcatcactcagcatgcatgaaccagaaacaccttttgaggtttataaagtccaagttgaggaaggaaccagatgaggttgtaatatttcgagatgggacgtacctaaccctgacagaagtttttgagagcctggatttaactggatatgatttaaatgtggaccttcttgatgttcatgcagacaaaagtaccttccatcgttttgataaatttaaccttaagtataatccttgtggtcaaagtaggctgagggaaattttcctcaagcaggataatcttatccaaggtcgattccttggggagctgacaaagcaggtcttttctgatcttgctgcaagcaaataccagatggctgaatacagaatatctatatatggcaggaagcaaagtgagtgggatcaactggctagttggatcgttaacaacgaattgtacagtgaaaatgttgtttggttaattcagatccctcgactttacaatgtatacaaggagatggggattgttacatcatttcagaacattcttgacaacatctttattcctctttttgaggttactgtggatcctgattcacatcctcagttgcatgttttcttgaaacaggttgtagggttggatttggtagatgatgaaagcaaacctgaaagacgccccacaaaacacatgccaagaccagatgagtggactagtgtatttaatcctgcattctcctactatgcatattactgctatgcgaacctctacgccttaaacaagcttcgtgagtccaagggcatgtcaaccatcaaattccgaccacattctggggaggctggtgatattgaccatcttgcggcaacatttctaactgctcataatattgcacatggaatcaatttgaggaaatcgcctgtgctacagtatctttattatttggcacagattggcttggctatgtctcctctgagcaacaattccttgtttttggactatcatcggaacccttttccaatgtttttcttgcggggtctgaatgtttccctttctacggatgatcctcttcaaatacacttaacaaaggaacctttggtggaagagtatagcatagctgcttctgtgtggaagctgagttcatgtgatctatgtgagattgcccgtaattcagtctaccagtcaggtttttctcatgctttgaagtcccactggattgggaagcactactacaagagagggcctgatgggaatgatatacacaagacaaatgtacctcatatccgggtggaatttcgtgacacgatctggagagaggagatgcagctggtttacttgggcaaggctgatatccgtacagatgttgacaagtaatgttgaacatacggcacaaggatcctttcttgaatgttacaagtatatttagacgtaggcaaacctgccttctaccttctaccttcatcctgcataaagggaccatgagccatacgaactgagaaattgcaggggacaagcaacagtctgaagaggaagttaacatggtttgaggcccactggttaaaccatgtacacgcagtggagattgttgaaatgggaacatctgcaatgtcttagttcttagactcagggcatggtgtatccaaaaatgaatcaaatacagcctatgacacgaggaagcaaattatagacttcccatagagataataaccaaaaataatgtttcccgttacggttgctacagtgtatgccattatcaatagtgttggcaagaagtgaattaatgccttcttgcataataaattttgacctacttttacccggagcattgcatgcatgcgccatggatcattcttcggctctcccctccatctgcttctattatatattcaaatctatttataagcatctgaatcttttgcttttagttgtgatgaacggttggttttgagaaggttcagatctgattatcatc

SEQ ID NO: 3288 - DNA, 3200 bp, Gossypium hirsutum
tcaacgcagagtacatgggggtctcccgtaaaacagagcttctctctctgttctcttcattcgcccaagagtgttgagtagtttctacttagggtctttttgggttttttttttttctatttttccttcttgctttctatctttttttggctgtagatttggaaagtttggaacgaaaagaaaaaagagttttagagagttctaaatggacacgtacactgtccatcttgcgatggcggctctggttggagcttcgctggtggccgtgtccgcgtattacatgcacaggaaaaccctaaatcagttgctggagttcgccaaaacggtggagagggaggatatctcggagggagagtcgccgctgccctccaagaaaaggcgcgcccaccactctcgccggaagggcagcggatattaccgccgtagctcctcttctttgccggatgtttggatgatgtacggcgggattgatggagaagagaaacgtaacggcactatccatgttgacgggattccccccgggttgccgaggctccatatgctgccggaagggaagtctggtggccatgcaacaccaactaagaaatctggaagtgttatgcgacctacttctcccaagtcccctgttgctagtgcaagtgcgtttgagagcatggaaggatcagaggatgaagataatatgactgacaattctaagattgaccttacatatcttcatactaatggaaatgctggcccaaatttgccggaccacattaatgctaatggagaggcgattcagatagctgcttcaagcatgattcgatctcatagtgtatcaggtgacctccatggtgttccacctgatcctattgcagctgatatcctaaggaaagagccagagcacgagacctttgcacgacttaatatttcccctactgaggtaccatcaccggatgaagttgatgtctatgtagttctgcaagaatgcctagaaatgcggaaaagatatgtattcaaggaggcagttgctccttgggagaaagaagttatatcagacccaagcacaccaaaacctaatccagcaccctttttttatgctcctgagggaaaatctgatcattattttgagatgcaagatggagtaatacatgtttatgcaaataaagattcaaaagaagagctctttcctgtagccgatgctacaacctttttcaccgacttgcatcacatacttcgagttatagcagcaggcaatatcagaactttatgtcatcatcggctaaatcttctagaacaaaaattcaatcttcacttgatgcttaattcggatagagaatttctagctcagaaaagtgcaccacatagggacttctataatgtgaggaaagttgatactcacgttcatcactcagcatgcatgaaccagaaacaccttttgaggtttataaagtccaagttgaggaaggaaccagatgaggttgtaatatttcgagatgggacgtacctaaccctgaaagaagtttttgagagcctggatttaactggatatgatttaaatgtggaccttcttgatgttcatgcagacaaaagtaccttccatcgttttgataaatttaacctcaagtataatccttgtggtcaaagtaggctgagggaaattttcctcaagcaggataatcttatccaaggtcgattccttggggagctgacaaagcaggtgttttctgatcttgctgcaagcaaataccagatggctgaatacagaatatctatatatggcaggaagcaaagtgagtgggatcaactggctagttggatcgttaacaacgaattgtacagtgaaaatgttgtttggttaattcagatccctcgactttacaatgtatacaaggagatggggattgttacatcatttcagaacattcttgacaacatctttattcctctttttgaggttactgtggatcctgattcacatcctcagttgcatgttttcttgaaacaggttgtagggttggatttggtagatgatgaaagcaaacctgaaagacgccccacaaaacacatgccaagaccagatgagtggactagtgtatttaatcctgcattctcctactatgcatattactgctatgcgaacctctacgccttaaacaagcttcgtgagtccaagggcatgtcaaccatcaaattccgaccacattctggggaggctggtgatattgaccatcttgcggcaacatttctaactgctcataatattgcacatggaatcaatttgaggaaatcgcctgtgctacagtatctttattatttggcacagattggcttggctatgtctcctctgagcaacaattccttgtttttggactatcatcggaacccttttccaatgtttttcttgcggggtctgaatgtttccctttctacggatgatcctcttcaaatacacttaacaaaggaacctttggtggaagagtatagcatagctgcttctgtgtggaagctgagttcatgtgatctatgtgagattgcccgtaattcagtctaccagtcaggtttttctcatgctttgaagtcccactggattgggaagcactactacaagagagggcctgatgggaatgatatacacaagacaaatgtacctcatatccgggtggaatttcgtgacacgatctggagagaggagatgcagctggtttacttgggcaaggctgatatccgtacagatgttgacaagtaatgttgaacatacggcacaaggatcctttcttgaatgttacaagtatatttagacgtaggcaaacctgccttctaccttctaccttcatcctgcataaagggaccatgagccatacgaactgagaaattgcaggggacaagcaacagtctgaagaggaagttaacatggtttgaggcccactggttaaaccatgtacacgcagtggagattgttgaaatgggaacatctgcaatgtcttagttcttagactcagggcatggtgtatccaaaaatgaatcaaatacagcctatgacacgaggaagcaaattatagacttcccatagagataataaccaaaaataatgtttcccgttacggttgctaaagtgtatgccattatcaatagtgttggcaagaagtgaattaatgccttcttgcataataaattttgacctacgtttacctggaacattgcatgcatgcgccatggat

SEQ ID NO: 3289 - DNA, 2634 bp, Cucumis sativus
ttccttccttaatcttcttgcctctttgcttctaacgattcacagctttgcatcgttttctcgtaccaaactccaatggatgcttatcctttgcacatggccgtggcggctctgataggagcctccgtcgttgctgtttccgcctattatatgcaccggaaaaccctaactcagctgctggagtttgccaagactgttgagagagacagagagcgagatgataataatttcgatgctgagtcacccaggcattccaagaagcagcgtggaaactatgtgcgccggaaggggactggttataatcggagagcatccgcttcgttgcccgatgttactgctatttccggtggtgctgatggtgatgataaacgaaatggacaggttctgttggacgtgattcctgctgggctcccgaggttacatacactccctgaaggtaaaaattctaccaagagatcaatgaggcctacttcaccgaagtcccccattgcaagtacgagcgcatttgagagcgttgaagggtcagatgatgaagatgataatatgactgaggatactaaactaggttcaggatatctgcttgctaatggaaatgcaggtccagaatgtaagggtatatttgaaaatcttcctgatcacattaatgccaatggagagcagattgctttggctgcttcaagtatgattcgatcacatagtatatctggcgatctacatggtgttcagcccgatccaattgcagctgatattttgaggaaagagcctgagcaagaaacttttgtacggctcaacattaccccatctgaggtaccgttacctgatgaagtagaatcatatctggttcttcaagagtgccttgagatgcggaaaagatatgtattcagcgaagctgttgctccatgggagaaagaaatcatatctgaccccagtacaccaaaacctaatcctgatccatttcaatacacttctgagggaaagtctgatcattattttgagatgcaagatggggtcattcacgtctatgcagacaaagattcaaaggaagaactgtttcctgttgctgatgcaaccaccttctttaccgatcttcatcacatacttagagtcactgcagcaggaaacattagaactctgtgccatcgtcgactgaatcttcttgaacagaaattcaatctccatttgatgcttaatgcggacaaggaatttctggctcaaaaaagtgctccacaccgtgacttttacaatgtcaggaaagttgatactcatgtccatcactctgcttgcatgaatcagaaacatctcttaagatttataaagtctaaattgaggaaagagcctgatgaggttgtgatatttcgggatggtacatatttgaccttgaaagaagtttttgagagcttggacttatctgggtatgacttaaatgttgacctcttggatgttcatgctgacaagagcacatttcaccgcttcgataagtttaatcttaagtacaacccctgtggtcaaagtagactaagggagatcttcctaaagcaggacaatctaattcaaggccgtttccttggtgagctgaccaaacaagtattttctgatcttgctgcaagtaaatatcagatggctgaatatcggatatctatatatggaaggaagcaaagtgaatgggatcaacttgcaagttggataattaacaatgatttgtacagtgagaacgtcgtatggttgatccagctgccaagactttacaatgtgtacaaggaaatggggattgtgacatcatttcaaaacatacttgacaacatcttccttccattatttgaggccacggtggatccagattcacacccgcagttgcatgttttcttgaaacaggttgttggtttggatttggttgatgatgagagcaaatctgaacgacgccctaccaagcacatgccaacgcctgctcagtggacaaacgtcttcaatcctgcattctcatactatgtctattactgctatgccaatctctacactctaaacaagcttcgtgaatcgaagggcatgaccactataaaccttcgtccacattctggggaggctggcgatattgaccaccttgctgcaactttcctaactgcgcatagcattgctcatggaattaatttgagaaaatccccagtgcttcaatatttgtattatctagcacagatcggtttggccatgtctccgcttagcaataactccctctttttggactatcaccggaatccatttcccgtgttcttttctcgtggtctaaatgtctctctttctactgacgatcctcttcaaatccactttacaaaagagcctctggtcgaagaatatagcatagctgcttcgctctggaagctaagttcttgtgatctatgtgaaatagctcgcaattctgtctaccaatcaggtttctctcatgctctgaagtcacattggattggaaaagaatattacaagagaggacctgcaggaaatgatattcacagaacgaatgtgccacacattagggtcgaattccgtgacacgatctggaaagaggaaatgcagctggtttatctaggaaaggccgacatttcagacgagattgaaaagtgatgagcagtggagaaaaacttc

SEQ ID NO: 3290 - DNA, 3226 bp, Medicago truncatula
aactcgctctcactcacccagcaacaatactttcactgagtcaacaactcgttcttcatttttcagtagggtttttctctatcccctcttctctctctaaattcagttatagagagagagacctttctagagagagaaaatggacgcacacgcagtgcatttggctatggcggcactgttcggagcttcaatcgtcgccgtatcggcgtactacatgcaccgcaagacgttgacagagttacttgagttcgcgcgtacggttgagcctgaaggcgactccgatggtggtgagaggcggcgcggtggttctaagagaaggaacggtggtggtggtggttatcggcgtggttcaggttcgttgccggatgttacggcgattgctggtggtgttgagggaaatggattgatgcatgatgaagggattccggttgggttgccaaggttgcaaacactccgaaaatctgcaaacaatggttcatttaagagaaatattataagaccaacttctcccaagtctcctgttgcaagtgccagtgcctttgaaagtgtagagggatcagacgatgaagataatttgacagacaccaaacatgatacaacatatctgcatacaaatggaaatgtaggtggagaaggtaaaaatccatacgagactttgcccaatcatgtcaatactaatggagagcagatggcaatcactgcttcaagtatgatccgttctcatagtatttctggtgatctgcatggtgtgcagcctgatccaatagcagctgacattctgaggaaagagccagaacaagaaatttttgctcgattgagaattactcctatggaggctccatcacccgatgaaattgaatcctatgtgattcttcaagaatgccttgaaatgaggaaaagatatatttttaaagaagcagttgctccgtgggagaaagaagttatatctgatcccagtactccaaaacctaacctagagccattcttttacgcacctgaaggaaagtctgatcattattttgaaatgcaggatggagttattcatgtatatccaaacaaaaactccaatgaagagctttttcctgttgccgatgcaactacatttttcaccgaccttcatcagatacttcgagttatagcagcaggaaatatcagaactttatgccaccacaggctaaatcttctagaacaaaaattcaatcttcatttgatgctcaatgcggatagggaatttctcgcccagaaaagtgctccacatcgagacttctataatgttagaaaagtggatacacatgtccaccactcagcatgcatgaatcagaaacatcttttgagattcataaagtcaaagctgaggaaagagcccgatgaggttgtaatatttcgagacggaacatatctgacgttgagagaggtttttgagagtctagatttaactggctacgatctcaacgttgaccttttggacgttcacgctgacaagagtacatttcaccgctttgataagttcaatcttaaatacaatccctgtggtcaaagtaggcttagggagatattcttgaagcaggataatctcattcaaggtcgtttccttggtgagcttacaaagcaagtattttctgatcttgaagccagtaaatatcagatggctgaatatagaatatcaatatatggtaggaagcaaagtgagtgggaccagctagccagttggatagtgaataatgatttgtacagtgagaatgttgtttggttgattcagcttccaagattgtataatatatacaaagacatgggaattgtgacctcattccagaacatgcttgacaatatcttcattccactttttgaggttactgttgaccctgattcacatcctcagctgcatgttttcttgaaacaggttgttggcttggatttggtggatgatgaaagcaaacctgaaagacgaccaacaaaacacatgcctacacctgctcaatggacgaatgtattcaatccggcattttcatactatgtgtattactgttacgcaaatctgtacaccttaaacaagcttcgtgaatcaaagggaatgactacaatcaaattccgtcctcatgctggagaggctggtgatattgaccaccttgctgctaccttccttactgctcataacatcgcgcatggaattaacttgagaaaatcacccgtgcttcaatatttatattatttggcccagattggacttgcaatgtctcccctgagcaataactctctatttttagactaccatcgaaatcctctacctgtgttcttcttaaggggattgaatgtatcactttctactgatgatccactccaaatccacctaacaaaggaaccgttggttgaagagtatagtatagctgcttctgtgtggaagttgagctcatgtgatttatgcgagattgcgcgtaattcagtttatcaatcaggtttctcgcatgctttaaagtcacattggattggtaaggaatactacaagagagggccaaatggaaatgacattcacagaacaaacgttcctcacattcggttggaattccgtgacacgatttggagagaggagatgcaacaggtttatttgggaaaattcattattccttacgaaatagagaaataatgtggcagaggtctgtgtttcatacatgcgcaatggaggctgtgtcatagggagaaagtgaattcttcaaaacccattcaacatcaagagatatccttaggctgaagatgttattacagtgggtcagtgatatgaaccagatatataatataaataataactgaagatcactgagcaaggtttacagctgaatatcattgagcttgagcaatagagcttgagaaggtgcttctttaatttaggctagagttaaagatgagggttggtaataattgcagcaattgttaatgcatgtggatgttagaaataaaagtcaatataatcctttgaagggggagattctctcacaattttgattcctaatgcttgttagttggaagcagatggatcttgtaagaaattttatttattttattgtgtacttcagtacttgttcgtagatgtgagagactgttttacgatcttcgaaattagaatgccgaaaaaacatggcttgttgtggaattaaaagttgtctcaattcatttgatcatttaaatgaccaacatgtaatgatttgatcttcgaactttgaataaaactaaa

SEQ ID NO: 3291 - DNA, 2223 bp, Cucumis melo
accgtgacttttacaatgtcaggaaagtcgatactcatgttcaccactctgcttgcatgaatcagaaacatctcttaagatttataaagtccaaattgagaaaagagcctgatgaggttgtaatatttcgggatggtacatatttgaccttgaaagaagtttttgagagcttggacttatctgggtatgacttaaatgttgacctcttggatgttcatgctgacaagagcacatttcaccgcttcgataagtttaatcttaagtacaacccctgtggtcaaagtagactaagggaaatcttcctaaagcaggacaatctaattcaagggcgtttccttggtgagctgaccaaacaagtattttctgatcttgctgcaagtaaatatcagatggctgaatatcggatatctatatatggaaggaagcaaagtgaatgggatcaacttgcaagttggataattaacaatgatttgtacagtgagaacgttgtatggttgatccagctgccaagactttacaatgtgtacaaggaaatggggatcgtgacttcatttcaaaacattcttgacaacatcttccttccattatttgaggtcacggtggatccagattcacatccgcagttgcatgttttcttgaaacaggttgttggtttggatttggttgatgatgagagcaaatctgaacgacgccctaccaagcacatgccaacgcctgctcagtggacaaacgtcttcaatcctgcattctcatactatgtctattactgctatgccaatctctacactctaaacaagcttcgtgaatcaaagggcatgaccactataaaccttcgtccacattctggggaggctggcgatattgaccaccttgctgcaactttcctaactgctcatagcattgcacatggaatcaatttgagaaaatccccagtgcttcaatatttgtattatctagcacagatcggtctggctatgtctccacttagcaacaactccctatttttggactatcaccggaatccatttcctgtgttttttctcgtggtctaaatgtttctctttccactgacgatcctcttcaaatccactttacaaaagagcctctggtcgaagaatatagcatagctgcttcgctctggaagctaagttcttgtgatctatgtgaaatagctcgcaattctgtctaccaatcaggtttctctcatgctctgaagtcacattggattggaaaagaatattacaagagaggacctgcaggaaacgatattcacagaacgaatgtgccacacattagggtcgagttccgtgacacgatctggagagaggaaatgcagctggtttatctaggaaaggccgacatttcagacgagatagaaaagtgatgagcactggagaagcacttcagaagaccacactggaataggtgtgatatttcaggtggtagttcgtcgattatttggattagtcatttgattgcctcaacaaagaaaggtggatttcgataaatgatgtggttgcgcaactcaaacgaagaactctgaagttgggggaaggaaaagtacatacaaattaaattggaaatggtagcctgagtgagggtatgtctagccgaagctttgatgtggacataattttaacgttggtcgtatgacaaaataacacttattaggcagagatggggcagtttagatccctaagacaatctactaagatatatgaatatatatatacatacgtagtaatcctaaataatcaattatggtggggaataataagagaacgtgacaataaggttaaaatgtttttccttagttggaagggacaaagggcggccccgtctctaaatccaattttgacttatcattggatttatataaatctataagttatgattttgtgataatgtacaatggcattgctggatgaacaactttctataatggaattctctaatttcatttaccaatttggttgatctaaaacgtaaagagggatgagtttgccttggatgtaaatgtgaaggtattcaagagttatcttataacagttaaatgttatttgaccatgtgtctttataaagttgggatggatactcaaagtcaggatttagtatttatgataacctcaaaatggtagtctttgtagtttggtaacgcagtggagaatttattttactacagaaattatttgagttctataaaatcgtgagggttagattttg

SEQ ID NO: 3292 - DNA, 2536 bp, Mimulus guttatus
taaaatggacgcttatccgctgcatctagcaatggcggcacttgttggagcgtcctttgttgccgtttcggcgtactatatgcacaggaaaaccctaaaccagttgctagagttcgcaaaggcggaggacggcgacggtgatgtggccgagcaggttaacaagtacccctcccgacggcgtagcaaggggaccgctggttacagtcgtcgcggttcggacgtgaccaatgtttctggcggcggcggagatgctggtgactcggaggagagaaggaatggtccggtgcacttggattatattccggccggattgccgaagcttcacacgcttcctgaaggcaaatttggtagtgtgagttcaaacaccagagcggtacatcttattcgacctacttctcctaaatcacctgttggtagtgcaagtgcaagtgcatttgagagtatagaatgttcagacgacgaagataacatgactgacaatgcaatgctagacactacatatattcattctaatggaaacgcgaacttacctgaccatacaaatgtaactggtgaaccaatgccctccgccacatcaaatatggttcactcacacagtgtaactggtgacctgcatggtgtccaacccgatcctgtagctgctaattttttaaggaaagaaccagaacaagagacctttgtacgattaagaatttccccccttgagataccatctctggaggaagtagatgtctaccgatcactgcaaggttgccttgaaatgaggagacgttatgtatttagagaagtcgttgccccatgggaaaaggaaattatatctgatcctagtactccaaagccaattcagaacccatttcatcatattccagagggaaaatctgatcactattttcagatggaagatggcgtcgttcatgtttatgcaaataaagattcaaaagagaaacttttccctgtagctgatgccacagcttttttcaccgacctgcatcatattctcaaggttatagcagctgggaataatcgaactttatgccatcacaggctagttcttctagaacagaaattcaaccttcatctgatgcttaatgcggacagggagttcctagctcagaaaagtgcaccacatcgagatttttataacgtcaggaaggtcgacactcatgttcaccactcggcttgcatgaaccagaaacatcttttaaggtttatcaaatcgaagttgaggaaggaaccaggcgaggttgttatattcagagacgggacatatctgaccttgaaagaggtgtttgagagcttggatttaactggatatgatctgaatgttgacctattagatgttcatgctgacaaaagcacatttcatcgctttgacaaatttaatttgaagtataatccctgtggccagagtagattgagagagatatttctgaagcaagataatctcatacagggccgtttccttgctgaattgactaagcaagttttttcagatctggaagcaagtaaatatcagatggctgaataccgaatatcaatttatggcagaaagaagagtgagtgggaccaactagcaagttggatagtaaataatgacctgtacagtgagaacgttgtatggcttattcagctaccaagactttacaatgtgtacaaggagatgggaattgtcacctcgtttcagaatattcttgataacatctttctgccgttgtttgaagttaccgtcgatccggattcgcatccacagttgcatgttttcttaaagcaggttgttgggctggatcttgtagatgatgaaagcaagcctgaaaggcgtcctactaaacatatgcctacgccggctcagtggaccaatatatttaatccagcattttcgtactacgcatactattgctatgctaacctatatactctaaacaagcttcgcgagtctaaaggtatgacgactattaagttccggccccattctggagaggctggtgacatagaccatctagctgcaacatttctgacagctcataacattgcacatggaatcaatcttagaaaatctcctgttcttcaatatctatactacctagcccaggcaagtaaaaaaattggtcttgctatgtcccctttgagcaacaactctttattcttggactaccatcgtaatcctcttccgatgtttttccttcgcggcctcaatgtttccttgtcgaccgacgatccgttacaaattcacttaacaaaagaacccctggtggaagaatacagtatagctgcttcggtgtggaaattaagttcatgcgatttatgtgagattgctcgtaattcagtgtatcagtctggtttctcgcatgctttaaagtctcactggattggtgaggggtacttcaagcacggaccagatggaaatgacattcacaagactaatgtacctcatataaggctcgaatttcgtgatatgatatggagagaagaaatgcaacatgtttatctgggcaatgcaaactttcccaagtttattgacccataatctgcttcctaa

SEQ ID NO: 3293 - DNA, 2488 bp, Mimulus guttatus
ttgttgagctttcgtaaattcctctattgacattcgtatattctaccgacgaatacgtactgtttgcgtatttatacgcgtacagtgaaatggacgcttattcgctgcatctggcgatggcggcgctcgtcggagcgtcgtttgtcgcgttgctggagttcgccaagtcgatagagagggacagagaagacgccgccgcgggggaaggcggcgccgacgacgacgcggaggagcagagaagaggaacgctcccgtgcgtgtggattcgattccggcgggtttgccgaggcttcatacgcttcccgaaggacatcttattcgacccacttcacccaaatcaccggtcgctagtgcaagtgcatttgaaagtctagaaggttcagacgacgaggatattatgaccgataacatcgactctacatatcttcatacaaatggaaatgagaatgcgacagatcatatcaacgcaaacggtgaacaagcaccgttggctacgccaagcatgattcggtcccatagcgtctcgggtgacctgcacggggttcaacctgatcccgtagctgctgatattctgagaaaagaaccggagcacgagtcttttgttcaattaaaaatatccccctctgagataccgtctccggatgaagtagaggtttaccgtactctgcaagattgccttgaaatgcggaaaaaatacgtatttagagaagctgttgccccatgggaaaaggaaattttatccgatcctagtactccaaaaccaatcctgaacccatttgatcattaccctgtggcaaaatctgatcattattttcggatggaagatggagttgttcatgtttattcaaataaagactcaaaagagaaactttttccggtcgctgatgctacaacgtttttcactgacctgcatcatattctcaaggttatagcagccgggaacatccgaaccctatgccaccacaggctagttcttctagaacagaaattcaaccttcatctaatgctcaatgcggacagagaattcctggctcaaaaaagtgcaccacatcgagatttctataatgtgaggaaagtcgatacacatgttcaccactcagcttgcatgaaccagaaacatcttttgaggtttataaaatcgaagttgaggaaagaaccagatgaggttgttatattccgagatgggacatatctgaccttgaaagaagtctttgagagcttggatttaactgggtatgacctgaatgttgatctgttagacgtgcatgctgacaaaagcacctttcaccgctttgacaaatttaatttgaaatataatccctgcggtcagagtagattgagagagatctttctgaaacaggacaatcttatccagggtcgtttccttgctgaagtgactaagcaagttttttcggatctggaaacaagtaaatatcaaatggctgaatatcggatatcaatatatggtagaaagatgagtgagtgggaccaaatggcaagttggatagtgaataatgacttgtacagtgagaatgttgtatggttgattcagctgccaagactctacaatatctacaaggagatgggaattgtgacgtcctttcagaatatccttgataacatctttctgcctttatttgaggtcaccatcgatccagattcacatccgcagttgcatgttttcttaaagcaggttgttggattggatctcgtggatgacgaaagcaagcctgaaagacgtccaacaaaacacatgcctacgccggctcagtggaccaatatatttaatcctgcattctcatattacgcatactactgttatgctaatctctacaccctgaacaagcttcgggagtcaaaaggtatgaccactataaagttcaggccccattccggagaggccggtgatatagaccatctcgcgacaacatttctcacagctcataatattgcacacggaatcaatctgagaaaatcgccggtccttcaatatttgtattacctagcccaggcaaattggtcttgctatgtctcctctgagcaacaactccttattcctagactaccatcgcaatccgttacccatgtttttcttacggggcctcaatgtatccctctcaactgacgatccgttacaaatccacttaacaaaagagccactggtggaagaatacagtattgctgcttcagtttggaagttaagttcatgtgatttgtgtgagattgctcgtaattccgtgtatcagtctggtttttcacatgcattaaagtctcactggattggaaagcagtatttcaagcgaggaccagacgggaatgacattcacaagacaaatgtccctcatataaggctcgaatttcgtgagatgatatggagagaggaaatgcaacaggtttatctgggcagggcaaactttcccaagtttattgacccataactcgctcggctaacttgcataccaggcgtcatcggtacttgagcacagag

SEQ ID NO: 3294 - DNA, 2312 bp, Hordeum vulgare
aacaccattagctgcaaaaaacatgacccggtctcatagtatatccaatgatcttcatgcggttcaacctgatccagttgctgcagatattcttcgaaaagaacctgagcaagaatcatttatcaagctattaactgctccacatgagattccatctcctgatgaaatagaggtctataaaatccttcaaaagtgtctcgagttaagagattgttacctttttagagaagaggtcgctccatgggagaaggaggtcataaatgacccctgtacaccaaaacctaatcctaacccattcactttcgtgcctgaaccaaaatcggagcatgttttccaaatggtcgatggtgttgtccaggtctatgcggataaagactgtacggaaaggatttatcctgttgctgatgctacaacctttttcaccgacttgcattatgttctccgggtgactgccgcggggaatacaagaactgtctgtcataaccggttgaatcttctagagcataagttcaaatttcatctgatgttaaacgcggacagggagtttcttgcgcagaagactgcaccacatcgtgatttttacaatgttaggaaggtcgacactcatgttcaccactcagcatgcatgaatcagaaacatttgctgagattcatcaagtccaaactgaggaaagaacctgatgaggttgtcattttcagagatggtacatatatgactttgaaggaggtttttgagagcttggacttaactgggtatgacttgaatgttgatttgctagatgtccacgctgacaaaagtacatttcatcgttttgacaaattcaaccttaaatacaatccatgcggccaaagtaggttacgggagattttccttaaacaggacaatcttattcaaggacgatttcttgctgagctgacgatgcaagtttttttctgaccttaatgcaagcaagtatcagatggctgaatataggatttcaatctatgggaggaagcaaagtgagtgggaccaacttgcgagttggatagtaaacaatgaattgtacagtgaaaatgttgtttggctgattcagattccacgcttatataacgtgtacaagcaaatgggcattgttacatcatttcaaaatcttcttgacaacattttccggggtgtgtttgaggttactattgatccagcttcgcacccgcagcttcatgtcttcctaaagcaggttgtagggttggatttggttgatgatgagagtaaacctgaaaggcgtccaactaagcatatgcctacacctgaagaatggacaaatgtcttcaaccctgcattttcatattatgcgtactactgctatgctaacttgtacacactgaacaagctgcgtgagtcaaaggggatgaatactatcaaattccgtccacatgctggtgaggctggagatgttgatcacttggcagcaacatttcttctttgtcacagtatatcacatggaatcaatttaaggaagtctcctgtgcttcagtatctgtactatcttggtcagatcggtctagcaatgtccccattaagcaacaactccttgtttcttgattaccatcggaacccttttcctatgtttttccaacgaggactgaatgtctcattgtccacggatgatccattgcaaattcatctgacaaaagagccgttggtcgaggaatacagcattgccgcttcgctgtggaagctcagttcttgtgatttatgtgaaattgcaagaaattctgtgtatcaatcagggttttcacatgctctcaaggcacattggattggcaagaactactacaagagaggcccctcagggaacgatatccacagaacgaatgtgcccaccatcaggatcgaattcagggacctgatctggagagacgaaatgcagctcgtttaccttgataacgtcatcttacctgacgaggtggaccagtaagatgcatatagatatatatgccctagccgccgctgtgggggatgaatcataccttttgtgtacacttcatgatgcacatcacagttcaacatggcgctggagccccaaacggcaaacctccaactaaataccgtcccaagaaccaccatcaaagtggaagaagaagaagaagacctacagaataatttgagatcgcaggtgtggagcgacggagcggctcgccattgtgctagactagcattacagggaggcaagtgcctggtgtaaaactgtcgcccttctcgtctgtaaaggattgtaactgttataaacaataacaacattgctaataaagttatgccgcactgtttcgctctc

SEQ ID NO: 3295 - DNA, 2300 bp, Hordeum vulgare
aacaccattagctgcaaaaaacatgacccggtctcatagtatatccaatgatcttcatgcggttcaacctgatccagttgctgcagatattcttcgaaaagaacctgagcaagaatcatttatcaagctattaactgctccacatgagattccatctcctgatgaaatagaggtctataaaatccttcaaaagtgtctcgagttaagagattgttacctttttagagaagaggtcgctccatgggagaaggaggtcataaatgacccctgtacaccaaaacctaatcctaacccattcactttcgtgcctgaaccaaaatcggagcatgttttccaaatggtcgatggtgttgtccaggtctatgcggataaagactgtacggaaaggatttatcctgttgctgatgctacaacctttttcaccgacttgcattatgttctccgggtgactgccgcggggaatacaagaactgtctgtcataaccggttgaatcttctagagcataagttcaaatttcatctgatgttaaacgcggacagggagtttcttgcgcagaagactgcaccacatcgtgatttttacaatgttaggaaggtcgacactcatgttcaccactcagcatgcatgaatcagaaacatttgctgagattcatcaagtccaaactgaggaaagaacctgatgaggttgtcattttcagagatggtacatatatgactttgaaggaggtttttgagagcttggacttaactgggtatgacttgaatgttgatttgctagatgtccacgctgacaaaagtacatttcatcgttttgacaaattcaaccttaaatacaatccatgcggccaaagtaggttacgggagattttccttaaacaggacaatcttattcaaggacgatttcttgctgagctgacgatgcaagtttttttctgaccttaatgcaagcaagtatcagatggctgaatataggatttcaatctatgggaggaagcaaagtgagtgggaccaacttgcgagttggatagtaaacaatgaattgtacagtgaaaatgttgtttggctgattcagattccacgcttatataacgtgtacaagcaaatgggcattgttacatcatttcaaaatcttcttgacaacattttccggggtgtgtttgaggttactattgatccagcttcgcacccgcagcttcatgtcttcctaaagcaggttgtagggttggatttggttgatgatgagagtaaacctgaaaggcgtccaactaagcatatgcctacacctgaagaatggacaaatgtcttcaaccctgcattttcatattatgcgtactactgctatgctaacttgtacacactgaacaagctgcgtgagtcaaaggggatgaatactatcaaattccgtccacatgctggtgaggctggagatgttgatcacttggcagcaacatttcttctttgtcacagtatatcacatggaatcaatttaaggaagtctcctgtgcttcagtatctgtactatcttggtcagatcggtctagcaatgtccccattaagcaacaactccttgtttcttgattaccatcggaacccttttcctatgtttttccaacgaggactgaatgtctcattgtccacggatgatccattgcaaattcatctgacaaaagagccgttggtcgaggaatacagcattgccgcttcgctgtggaagctcagttcttgtgatttatgtgaaattgcaagaaattctgtgtatcaatcagggttttcacatgctctcaaggcacattggattggcaagaactactacaagagaggcccctcagggaacgatatccacagaacgaatgtgcccaccatcaggatcgaattcagggacctgatctggagagacgaaatgcagctcgtttaccttgataacgtcatcttacctgacgaggtggaccagtaagatgcatatagatatatatgccctagccgccgctgtgggggatgaatcataccttttgtgtacacttcatgatgcacatcacagttcaacatggcgctggagccccaaacggcaaacctccaactaaataccgtcccaagaaccaccatcaaagtggaagaagaagaagaagacctacagaataatttgagatcgcaggtgtggagcgacggagcggctcgccattgtgctagactagcattacagggaggcaagtgcctggtgtaaaactgtcgcccttctcgtctgtaaaggattgtaactgttataaacaataacaacattgctaataaagttatgccgcac

SEQ ID NO: 3296 - DNA, 2106 bp, Solanum tuberosum
gcttgtgtgaaggaagtcatctttgatccatgcaccccaaaggcaaatccaaatccattggaatttactcccgaagggaaatctgatcattattttcagatggaagatggagttgttcatgtatatgcaaatgaagattctacggagaacctttttcctgttgctgatgctactacctttttcaccgacttccatcacatcctcaaagttatagcagctgggaacatccgaactttatgccaccatcgcctagtgcttctggaacaaaaattcaatctacatttgatgcttaatgcggatcgagagttccttgctcagaaaagtgcacctcatcgtgacttctacaatgtgaggaaggttgatacacatgttcatcactcagcatgcatgaatcagaaacatttgttgagatttatcaagtcaaagttgaggaaggagcctgatgaggttgtgatatttcgcgatggaacttatatgaccttaaaggaagtctttgagagcttagatttgactgggtatgacctcaatgttgacctgttagatgttcatgctgacaaaagcacctttcatcgttttgacaaatttaatctgaagtacaatccctgcggtcaaagtaggctgagggaaattttccttaagcaggataatcttatacaaggtcgttttcttgctgagctgactaagcaagtattttctgatctttctgcgagcaaatatcaaatggcagaatacaggatatcaatatacggccgaaagatgagcgagtgggaccaacttgctagctggatagtgaacaatgaactgtacagcgagaatgttgtctggttgattcagcttccgagactgtataacatatacaaagaaatggggattgtgacatcatttcaaaatatccttgacaacatctttctgcccttgtttgaggtcactgttgacccagaatcacatccccacctgcacatcttcttgaagcaaggtgttggattggatttggtggatgatgaaagcaaaccagaaagaaggcctaccaaacacatgcctacacctgctcaatggactaacgtattcaatcctgcattctcatactatgtctactattgttatgctaatctctacaccctgaacaagttgcgtgagtcaaaaggcatgacgaccatcaaattccggccacattctggggaagctggagatattgaccaccttgccgcaacatttttaacatcccataatattgctcatggtatcaatttgagaaagtctccggttcttcaatacttatattacttggctcagattggtttggcaatgtctcctcttagtaacaattctttatttttggactaccatcggaatcctttgcccatgttcttcttgaggggcctgaatgtttctctttcaacggatgatcctttgcaaattcacttaacaaaagaagccctggttgaagagtatagtatagctgcgtcagtttggaagttgagtgcatgtgatttatgtgagatcgcccgcaattcagtttaccagtccggtttctcacatgcgctaaagtcccactggattgggaaggagtattacaagagaggaccagatggaaatgatattcataggacaaatgtgcctcatatcaggcttgaattccgcgatatgatatggagggaggagatgcaacaggtttatctagacaaggctgtatttccttcatttgttgacccatgatctgcattgctaatgcatttatatcacagacaagagtatacgttcagaatatctgggggcttggccatccagagactctagaaagcttctccaccatgagatatatctagaatttggatgttgaggggaaaataagatttgatgaatgctagaccttattattcaataagagtgatctatgaagactggtaattgaggaagcaactggagctctagcatatatatagcacaactgcaaagcagtccactatctgaataaggaattatgtataatatatcctagtggtaggttaacaaactttagatgcattgtaagataaattctgaatgttgcatggtcccattgtaccatattttgacatgttggctaaaataaagagattgattgcg

SEQ ID NO: 3297 - DNA, 1539 bp, Centaurea maculosa
  misc_feature (437)..(437): n is a, c, g, or t
gaacatctgttgaggtttataagtccaagttgagaaaagaacctgatgaggttgtaatatttcgggatgggacgtatctgacgttaaaagaagtttttgagagcttggatttaactgggtatgatctcaatgttgatctgttagatgtgcatgcagacaagagcacctttcaccgttttgacaaattcaatctcaaatacaatccctgtggccaaagtaggcttagggagattttcttgaacaagataatctgattcagggtcgcttccttgctgagctaacgaaacaagtatttacagatcttgatgcgagtaaatatcaaatggctgaatacagaatatccatatatgggagaaagcaaagcgagtgggacaatttggcaagttggattgtgaataacgagctatacagtgataatgttgtctggcttattcagntgcctcggctttacaacatatacaaggaaatgggtattgtgacatcattccagaccattcttgacaatatattccttcctctctttgaggttaccgtcgatccaggatcacatcctcagctgcatgtattcttgaaacaggttgtaggattggatttggtggatgatgagagcaagcctgaaagacgccctacaaagcacatgccaacacctgcacaatggaccaatatattcaaccctgccttctcatactatgtatactattgttatgcaaacctctataccctaaacaagcttcgtgaatcaaaaggaatgactaccatcagattccgccctcattgtggggaggctggtgacattgaccatcttgctgctgcgtttcttacaactcataacattgcccacgggatcaacttgagaaagtctcctgtacttcaatacttgtattacctttcccagattggtctttgtatgtctcctttgagcaacaactcgttatttctggattatcaccggaatcctttcccaatgtttttccttcgaggccttaacgtctccctatctaccgatgatccattacaaatccatctaacaaaggagccgctggtggaggagtacagtattgctgcttctgtatggaagttgagtgcctgtgatctctgtgagatcgcccgtaattcagtataccaatcaggtttctcgcatgtcctcaagtcccattggattggtcaggagtactacaagagaggccccgatggaaatgatattcgcaagacaaatgtgccacatatccgacttgaattccgtgacatgatctggagagaggagatgcaacaaatttatctagggaaggccattttgcctgaatacatcgagacttagcttccttcgtccacgtcattccactatttctggctttctggagctgcaactagttaccggtttccatctacagttccagaggccaacttttggtgtggtaagctgagacttggcgtagccctgaagcttaagagctaattgtgggtggtcaactccggagttcagtgatagctttaggtcaacttggattcacccttcatgtaaatgtaaattataagaga

SEQ ID NO: 3298 - DNA, 3194 bp, Citrus clementina
agctctctctgtctctggtttctctcctcagacctcccctccgctcagaaataacacataacaacgataatattcactcacccgtagtgactcttatttttcttttcgattgttttaatctttgttgccgaaacttctaggaaatggacgcgtatacactgcatctggcgatggcggcgttggtaggagcgtcggtggtggcggtatcggcgtattacatgcacaggaaaaccctaactcagttactggagtttgcgaaatcagtggagagagagcgagacgataactccgacgcagccgaatcgccgcacaatgttaagaggcacggctgcgcggcggctcggcgctgctcttccaggaggaagggaagcggatactaccggcgctgctcggcttcgttgccggacgtaacggccatttctggtcatgcggttgacggtgaggagaggcgcaacggtccgcttcacgttgatggaattcccgccgggcttcccaggcttcatacgttgcctgaagggaaatctgctgggcatgcaagttcaaccaaacgggctggaaaccttatcaggccaacttccccaaagtccccggttgctagtgcctttgagagtgtagaaggatcagatgaagaggataatatgactgatagttcaaaattggacaccacatatctgctcaccaatggaaatgctggcccaaatttaccagaccacatgaatgttaatgcagaggctatagctgcttcaagtatgattcgatctcatagtgtatccggtgacctgcatggggttcagcctgatcctattgctgcagatattctgaggaaagagccagagcaagaaacttttgcgcgacttcagattacccctaaagaggtgccatcacctgatgaaatggaggcctatgtggttcttcaagaatgccttgaaatgcggaaaagatatttattcagagaagcagttgctccatgggagaaagaaatgatttccgatcctagtactccaaagcctaatccagatccattttattatgctcctgtgggaaagtctgatcatcattttgagatgcaagatggagttattcatgtttatccaaacaaagattcaaaagaagagctataccctgttgcggatgctacaacctttttcactgacctgcatcacattcttcgagttattgcattgggaaatatgagaactttatgccatcatcggctgcttcttctggagcaaaaattcaatcttcatttgatgcttaatgcggataaggaatttcttgctcagaaaagtgcaccacaccgtgacttttataatgttaggaaggtggatacacatgtgcatcactctgcatgcatgaaccagaaacaccttcttaggtttataaagtcgaagttgaggaaagagcccgatgaggttgtaattttccgtgatgggacatacttgacactaaaagaagtttttgaaagtctggatctaacagggtacgacttgaatgttgatcttttggatgttcacgcagacaagagcacgtttcatcgctttgataagttcaatcttaagtataatccctgtggtcaaagtaggctaagggaaatttttcttaagcaggataatctaatccaaggtcgttttcttgctgagctgacaaagcaagttttttctgatctcgaagcaagtaaatatcagatggctgaatatcgaatatcaatatatggaaggaagcaaagtgaatgggatcaactggcaagttggattgtgaacaatgaattgtacagtgagaatgttgtttggttaattcagcttccacggctgtacaacatttacaaggacatggggattgtgacatctttccagaacattcttgacaatatttttattccactgtttgaggttactgtggatcccgattctcatcctcagttgcatgttttcttaaagcaggtggttgggttggatttggtggatgatgaaagcaagccagaaagacgccccacaaaacacatgcccacaccagctcagtggaccaatgtgttcaatcctgcattttcatactatgcgtattattgttatgctaatctctacacattaaacaagctccgtgaatcgaagggcatgacaactatcaaattccgcccgcatgcaggagaggctggtgacatcgaccaccttgctgcaacatttcttacagctcataatattgcacatggaatcaatttgaggaaatctcctgtactgcaatatctctattatttggcacagattggtctggctatgtctcctctaagcaacaactctttgtttttggactatcatcgaaatcctttacccatgtttttcttacgcggtctcaatgtttcactctcgactgatgatcctctccaaattcatctaactaaagaacctttggtggaagaatatagcattgctgcttctgtgtggaagttgagtgcatgtgatctttgtgagattgctcgtaattcagtctaccaatcaggtttctctcatgctttgaagtcgcattggatcggattacattactacaagagaggaccggatggaaatgatattcacaaaaccaatgtgcctcacatccggattgaattccgtgatacgatttggagagaggagttgcagcaggtttatttagggaaggccatcatccctgaagaattgctgtgaaaaaatgaccacaacttttgtctttagaggatgtgaagagcatacactcccaactccacattcaccatcaaacggagtttgatcatatgttgttgaccaagaaggttaagaaacagctagtagctaaacacaagtttgaggacataaggatgactatgtacacgataaatcatggggtggggatgtctgcatgatctatacgatagagcttcagtcaatacagcctatagcaaccagatgctggtctagtatctctgatcaaataactacattgatcatctgtattatttctaggtaggagtcaaaagagcaataatatcatatccgaggctgaatttttgtattattgcagctttatttcttatcaaagaaagacttacccagggcaataggaaaactgaaaagggtggccttgcccttgcaaattttgtcgtgcagtatctatcatcaaaagttttgtggttgtttctcatgaattataaataacatatttaacaccaagtgatgcttttcata

SEQ ID NO: 3299 - DNA, 3322 bp, Zostera marina
ccacggtaaatcttctcatagttccgattttgaaggagggagagaagaaagggaaggctagttattcagtttagatggatgagtacgcagttcatcttgcgatcgcagctatcgccggagcgtcggtggtggctatatccgcgtacttcatgcaccggaaaaccctagctcagatcctagagtttgcccgttcaatggagaaagagcgggatcgggttaaggagaaagacgcaaaggaaaacagcactttattggaggaatctgctggaaacgcaggtgggatgtatcactacaagagacggaatcatttgtctcggaggaggattgcgattggtaggacgtcagcttcgttgcccgatgtaactgtcgctaggaagatgaacggaactgagggggaggagagggggattggaagtgacgctgaggtggtttcgacggagatggtgttcaaggatgatgatgatgatgatgatgatgattactataaagggatgggggttcctcccggactacctaaggtgcagacgtttccgaaagtaagcaactctataaaaagaatcgtcggtcatgttacgaaagaatcctctcccaaatctcctgccacatgtactagtacatttgatagccttgaaggatcagacgatgaggataatgtggagaacaatgcagaaattcatggtagctatttggaggctgatgaaaatgctgaagatacagagtgcaataccttcatccaaactatgcctgatcatatcgatgctaatggaaatccaattcctttaggttctgctaacattatacgatcccacagtaaatccggtgacctgcatggtgttcaaccagatccaatagctgctgatattcttagaaaggaacctgaacatgaaactttcatacgattgaaaattactccaaatgaaatcccctcaatggatgaagctgaggcgtatatggttcttcaggaatgtcttcaattgcgagaagattatttgtttatggaagaggttgctccatgggaaaaggaagtcataactgatccaagtaccccaaaagctaatcctaatccattttcatatacatcagagaagaaaacagatcattattttcaaatggaagatggagttgttcaagtttacgctaacaaaagctcaaaagacaaactttttaatgtggtggacgctacgacttttttaccgatttgcatcgtattcttcgtataattgcttctggaaatattagatcagtttgccatcgcagattggttctgttagaacaaaaatttaacctgcatgtaatgcttaattcggatgcggaatttcttgctcagaaaagtgctccacatcgtgatttttataatgtgaggaaagttgatacccatgttcatcattcggcttgtatgaaccagaaacatctattgaggtttataaagtcaaagctgaggaaagaacctgatgaggtcgtgatatttcgagatgggacttatttgacattgaaagaagtttttgagagcttagatttgactgggtacgatctaaatgttgatttgttggatgtacatgctgacaagagtacattccatcgttttgataagttcaatcttaaatacaatccttgtggccagagcaggctaagagagatttttcttaagcaagacaatcttattcaagtcgttttcttggtgaggttaccaaacaagtattttctgatctgactgcaagtaaataccagatggctgaatatcgaatatcaatatacggcagaaaacaaagtgagtgggatcagcttgcaagctggatagtcataatgatctctacagcgaaaatgtagtttggctgattcagcttccacgattatacaatatatataagggaatgggaattgtgacatctttccaaaatatacttgataatattttcctacctctttttgaagtaactgtcgatccagattcacatcctcagttacatgtctttttgaagaaggtcgtagggtttgatttggtggacgatgagagtaagcctgaaaggcgtccaacaaaacacatgccaacaccagagcaatggaccaatgtgtttaatcctgcattctcatattatgtgtattattgttatgcaaacctgtacacacttaataagctccgtgaatcaaaaggcttgtcgaccatcaaattgcgtcctcataccggagaggctggtgatattgaccatctagcagcctcttttctaacatctcatgctattgctcatggaattaatctgagaaagtctccggtgcttcaatacctctattatcttgcacaaattggattggcaatgtctcctctgagcaacaactctttgtttctggattatcaacggaacccctttcaaacattttttcttcgaggtctcaatgtttccctatcaacagatgatcctctacagattcacttaactaaagagcctttagttgaagaatacagcattgcagcttctgtttggaaactcagttcttgcgacttatgtgagattgcacggaattctgtttaccaatcaggtttttcacatgctctcaagtcgcattggatcgggaaatcgtactacaaaagaggtcctgatggaaatgacattcacaagaccaatgttcctcatatccgtctcgagtttcgtgacatgttatggagagatgagatgcagcttgtgtacttaggaaatgctgatattcctgacgaaattcctacctaggatcgacaacctgaacctgatcacatcgcccttcaataagtgatcagaataataataatacttgcaactagcataatagctagtcgtctcacaactaagttacagtcctaactctgaatattaaataattcagattccaagggagaagaagaacatcatggcgaatcagggctgctgatgatgatccatgattttgttttcagactgtatttttttatttctagaattatgagttgtatttattttcttttctttaaacttgaataaaaaccgtatgatgtaaaacaacaatagttctcaaaatccaatattccaatttcaaatttacaacaataacgaaaaatccaaatgctcagaaagatcaagatatggtgcatctacccccacccttttgttctgcatcgttggtagaagacgcagaagtagtgccatcagcggaggaaactccaggccaatccttgcataggcagtggtttcccgatgggattttcttatgcacggaagctacgtgacggccacatcctccccacgagctctttccacatttggagcaggttacctggtaacacattttcctgatttctgtcgttaccaccgcg

SEQ ID NO: 3300 - DNA, 2927 bp, Panicum virgatum
cctccacccgccgccgccggccccgcgcccccgccggtgccgccggcggtaaaccccctcctacgcgccgcgccggcggcggctcagcttcgcttcctgacctctccgcgttctacgatggcgtcggtcgcggcggtggcggcggcgggctcgccggcggtgggtacctcgtggaggaggaggaggaggaggggctggttggcccgcacgccaacggtggcgcgctcgaccccgccgacttgctccagatcccccagggcttgcccaggctgcacgtgggcgcggacggcaataaacaacttgcacgctcaggttcaaacagacgagttgcagtaattaggcctaactcacccaaatcccctgctgccagtgcaagtgcgtttgagagtgtagatggatctgatgaggatgatgctacacaacatggtggtaaacttgacaatggctacattaacacaaatggaaaccttgaaggagaacgcaaaggaaatgcaagtgtggaaaatggaacatccaaaccgtcagtagcaaacttgatacgatcacatagtatatccaatgatcttcatgcagttcaacctgatccggttgctgctgatattctacgaagagaacctgagcaagaatcgttcatcaagctgttaactgctccaaaggagattccaactcctgatgaaattgaagttttcaaaatccttcagaagtgcctcgagttaagagactcttatctttatagagaagaggttgctccatgggagaaggaaatcataaatgacccgtgtactccaaaacctaaccccaacccattcacttatgtgcctgaaccaaagtcagagtatgtcttccaaatggttgacggtgtggtccatgtttatgaggataagaattacacggagagaatttatcctgtagctgatgctacaaccttcttcactgacttgcattatattctccgagtaacggctgcggggaacacaagaactgtctgccataatcgtttgaatcttcttgaacataaattcaaatttcatctgatgttaaatgcggatagggaatttcttgcccagaagactgcaccacatcgtgatttttacaatgtcaggaaggttgacactcatgttcaccactcagcatgcatgaatcaaaagcatttgctgaggttcataaagtccaaactaagaaaagaacctgatgaggtggtcattttcagggatggtacttatatgactttaaaagaggtttttgagagtttggatttaactgggtatgatttgaatgttgatttgctagatgtgcatgcagacaaaagtacatttcatcgttttgacaaattcaacctaaaatacaatccgtgcggccaaagtaggctcagagagatttttctcaaacaagacaatctcattcaaggccgtttccttgctgagttgacaaagcaagttttctcagatctttctgctagcaaatatcagatggctgaatataggatttcaatctatggaaggaagcaaagtgagtgggaccaacttgcaagttggatagtgaacaatgaattgtacagtgaaaatgttgtctggctggttcagattccacgcttatataatgtgtacaaggaaatgggtattgttacatcatttcaaaatcttcttgacaacattttccttcctctatttgaggttactatcgatccagcttcacacccacagctccatgtcttcctaaagcaggttgtagggttggatctggttgatgatgaaagtaaaccagaaaggcgtccgacaaaacacatgcccacacctgaacaatggaccaatgtgtttaaccctgcattttcgtattatgcatactactgctacgctaacttatacacactaaacaagctgcgtgaggctaaggggatgaccactatcaaattccgtccacatgctggggaggctggagacgttgaccacttggctgcgacatttcttctttgtcacaacatatcacatggaatcaatttaaaggaagtctccggtgcttcagtacttgtactatcttggtcagattggtctggcaatgtccccattgagcaacaactcattgtttcttgattatcatcggaatcctttcccaatgttcttccaacgtggtctgaatgtctcattgtctacggatgatccattgcaaattcacctgacaaaagaaccattggtggaagaatacagcatagctgcttcgctgtggaagctcggttcttgtgatttatgtgaaattgcgaggaattctgtctatcaatctggattttcacatgcgctcaaggcacactggattggcaagaactacttcaagagaggacctgctggaaatgatattcatagaacaaatgtaccgcatatcagggtccaatttagagacatgatctggagaaatgaaatgaaactggtttacctgaacaataacatcttaatatctgaagacctggaccagtaagatgtttgcccttgtgtatatcccatatttgctatggggatcatacgtcatatttggccactggaagtcggcatgaggggcaatgagatttggagtgtctcagccaggaaaacttccatgagtgtcccaagcacacaaaaggatagaataccttaataataatgagaagtgaagcggcacacaagtgtgctagggttccgttagagggtgcattgcaaggtgctacttgtaaagaatgtaatcggtagtggatgaactctggttagataatataccattcaaataaaagtgttgccgcttgctttgctcctaggatgaaattggaagcctggtgagctgctgtttcctgtttgttagtacccagatgaaaaggatgctgtcctgagtcatgacgctctgctcatctgctgctaccaacttcatctgcttaaaattgctcattgttttttgaaagctgc

SEQ ID NO: 3301 - DNA, 2588 bp, Aquilegia formosa
atggaatcttattacggaatccatatggcgatggcggcattagttggtgcatcatttgtagcagtttcagcttactacatgcatagaaaaaccctaactcaattacttgatttcgctaaaacaattgaacaacaacgacagagaagagaacgatatactggttttgatgatgatgatgatgatgaagaagaggaggaagtggaagaacaatatataaacataaacaactatattcaaaacagaagaagaaataatggtgaacggcgccaatatcattcaatttcaaattcattgactgattctagattgattactaattttgaagataaagaagatcggaatcttcctattccagttggattaccgcctttacgcaagtttcctgaagggcattcttttagaagcgcaagttcagttaaaagaggacatgttgttagaccaatttcacccagatctcctgttgctagtgctagtgcctttgggagtgtggaaggatcagatgatgaggatgatttcacagttgacaataatattgaaaccggtgaattgtatggtaatgggaacgaagggacagaatacaaaagcgtatatccacacgctgatacaaatgtggatcagaattctgctgatgcagctagaatgagcaattctcatagtgtatctggaaatattcatggcgttcaaccttaccctgtggcagctgatattcttagaaaagaacctgagcatgaaactgttgtacaacttagaattaatccaactgaggtaccatctccggaccaagtggaagcttatcagatgctccaggaatgtcttgagctgcggcaaagttatgtattcatggaagaggttgctccttgggagaaagaagttataaccgatcctagcaccccaaagcctaatttgaatccattttcatattctcatgaaggcaaaacagatcaccattttcagatggaagatggagttgttcatgtttatgcaaataagaattctacagaaaagctttttccagtagctgatgcgacaacattttttactgatctgcatcacatccttcgagtgactgctgcaggaaatattcgaagcttatgtcatcataggctggttctcttagagcaaaaattcaatcttcatttgatgcttaatgcggatagagaatttcttgctcaaaaaggtgcaccacatcgtgacttttataatgtcaggaaagttgatacacatgtccatcactcagcatgcatgaaccagaaacatcttctgcgatttatcaagtcgaagttgaggaaagagcctgacgaggttgttatattccgtgatgggacatatctgacactgaaggaagtgtttgaaagtttggatttaactgggtatgaccttaatgtggatcttctagatgttcatgcagacaaaagtacttttcatcgctttgataagttcaatctaaagtataatccatgtggtcaaagtaggcttcgggagatttttcttaaacaagataatcttatccagggtcgtttccttggtgaattgacaaagcaagtattctctgatctagatgctagtaaataccagatggctgagtataggatatctatatatggtcgaaagcagagtgagtgggaccaactggccagttggataattaacaatgatttatacagtgaaaatgttgtttggttgatacagcttccacgactttacaatgtatacaaaggaatggggatcgtcacatctttccagaacatgcttgataatattttcctccccctttttgaggttactgtcgatccagattcacaccctcagttgcatgttatcttgaaacaggtcgttggattggatttggtagacgatgagagtaagcctgaaagacgtccaacaaaacacatgccaactccagcccagtggacaaattttttcaaccccgcattttcgtattatgcatattactgttatgcaaacctgtacacattaaataagctccgagagtcaaagggtatgacaactattaagttccgtccgcatgcaggggaggcaggggacattgaccatcttgcagcaacttttcttactgctcagaatattgcacatggaatcaatttgagaaaatctccagtcctccaatacttgtattaccttgcacaaattggtctggctatgtctccgcttagtaacaactctttgtttctcgattatcatagaaaccctttcccaatgtttttccttcggggcctcaatgtttctctttctacggatgatcccttacaaatccacttgacaaaagaacctttggtggaagaatatagtgtagcagcttctgtttggaagttaagttcatgcgatatgtgtgagattgctcgtaattcagtatatcaatcaggcttttcccatgcgcttaaggcacattggatcggaaaatcatactataagagaggcccagaaggaaatgacatccataagacaaacgttccacatgtcagaattgaatttcgatatgcgatctggagagaagagatgcaacaagtttatttgggtaaagcaaatatccctgataacattgaccagtgaactggaagaaataaata

SEQ ID NO: 3302 - DNA, 1668 bp, Cichorium intybus
cggggatctcatgcggataagaatttttagctcaaaaagtgcaccacatcgtgacttctataatgctagaaaagtcgatactcatgttcatcattctgcatgcatgaatcaaaaacatctcttgaggttcataaaatccaaattgagaaaagaacctgatgaggttgtaatttttcgagatggaacttatctgacactaagagaggtttttgagagcttggatttaactggttatgacctcaatgttgatttgttagacgtgcatgcagacaaaagcacctttcatcgttttgacaaattcaatcttaaatacaatccatgtggtcaaagtagacttagagagattttcttgaaacaagataatttaatccaaggccgattccttgcggaattgacaaaacaagtatttgcagatcttgatgcaagtaaatatcaaatggctgaatatagaatatcaatatatggaagaaagcaaagtgagtgggacaatttggcaagttggattgtaaacaatgaactctatagtgataatgttgtctggctgattcagttacctcgactttataacatctacaaagaaatgggaattgtgacatcatttcaaacaattcttgataacatattccttcctctctttgaggttacagtcgaccctggatcacatcctcagttgcatgttttcttgaaacaagttgtaggtttggatttagtggatgatgaaagcaagcctgaaagacgtcctacaaaacacatgccaacaccttcacaatggaccaatattttcaaccctgctttctcatattatgtctactattgttatgcaaatctctataccttaaacaaacttcgtgaatcaaaaggcatgactaccatcagatttcgccctcattgtggggaggctggtgatattgaccatttagctgctgcgtttcttacaactcataatattgcacatggtaatctcagaaagtctcctgtacttcaatacctatactcctcgcacagattggtcttgccatgtcaccattgagcaacaactctttatttctggattaccccgcaacccttttccaatgtttttcctacgtggccttaatgtttctctctctactgacgacccgttacaaatccatctaacaaaagagcccttagtcgaggagtacagtattgcggcttctgtatggaaattaagcgcgtgtgatctttgtgagattgcgcgtaacgtataccagtccggtttttcccatgttcttaagtcacattggattgggccgaagtactataaaagaggccagatggaaatgatattcacaagacaaatgtgccacatattcgacttgaatttcgtgacatgatatggagagaggagatgcaacagattttcttgggaaggcccgtttgcctaaatacattgagacttgagctttcttcagttgtcttatttccaccctaaagcttaagagctaatgtgggtcaacccggagttcagtgaaagctttaggttgccacgtgtaactgtaaattgtaacgtgaagtttataggaccccccaaatattatagccagtagcagataataatcggaagatgttttgctactgaaagaataatgattaatgcctgctcgaaggtatgtttaataggtttttgagtgtgtgcatttggtgtgc

SEQ ID NO: 3303 - DNA, 3004 bp, Eucalyptus grandis
gggaaatggacgcgtacagccttcacctggccatggcggccctcgtcggggcgtcgttcgtggccgtctcggcctactacatgcaccggaagaccctgaaccagctgctggagttcgccaagaccgtggagcgggagcgggagcgcggggacgacgactcggaggaggagtccccgcagaacctgaggcggcgacgcggcggcggtggaggaggctcgcggcgcagggggggcgcgtaccgccgcgcctcggcttcgctgccggacgtcaccgccatgtccggcgacggcggcgggatggacggggacgagcggtgcaacggtccgatcgcgctggacgggattccggccgggctgccgaggctccagactctccatgaaggaaaatctgctccactttcttcttcagtgaagagagtcgggagtcttatcagaccaacttctcccaagtctcctgttgctagtgctagtgcctttgagagcttggaaggatcagatgatgaaaatgacatgactgataattctaaactagatccgacttatctccttacgaatggaaatgccggaccagatggtaaaacctcgctgccaaatggtgagcaaatacctatggcggcagcaagcatgattaggtctcatagtgtatctggagacctgcatggtgtgcagccagatcctattgccgctgatatattgaggaaggagccggagcatgagacttttgtacggcttaaaatcagtccaaatgaggtgccggcatctgatgaagttgaatcctatttgattcttcaagagtgccttgaattacgaagacggtatgtattcagggaatcgattgctccttgggaaaaggaagtcatatcagaccccagcacaccgaagcctaatcctgcaccattttcttacacttcagtgggaaaatctgatcatcatttcgaaatgcaagatggagtcgttcatgtctacccggataaagaatcaaaggaagagcttttccctgttgccgatgcaacaaccttcttcacagatctacacactatacttcgagttatagctttaggaaatgtcagaactttgtgccatcgtcggctagttcttctagagcaaaaatttaatcttcatttgatgcttaatgcggacggggaatttatcgctcagaaaagtgctccacaccgtgacttttataatgtcagaaaagttgatactcatgttcatcattcagcatgcatgaaccagaaacatcttttgagattcataaagtcaaagttgaggaaagaacctgatgaggttgtaattttccgtgatgggacatatcttaccttaaaagaagtttttgagagcttagatttgacagggtatgatctgaatgttgatcttctggatgttcatgctgacaagagcacattccatcgttttgataagtttaatctcaagtataacccttgtggtcaaagtaggctccgagagatattcctaaaacaggataacctcatccaaggccgtttccttgctgagctgacgcaacaagtattttctgaccttgaagcaagtaaatatcagatggccgagtacaggatatccatatacggtagaaaaatgagtgaatgggatcaattggctagctggatagtgaacaatgaattatacagcgagaatgttgtatggttaattcagcttccacggctgtacaacatatacaaagaaatgggaattgtgacatctttccagaacatccttgacaatatattcatacccctctttgaggtcacaattgatccagattcacatccacagctacatgttttccttaaacaggttgttggcttggatttggtggatgatgaaagcaagcctgaaagacgcccaacgaaacatatgcccacacctgctcaatggactaatgtattcaatccagcattttcatactatgcttactattgttacgctaatctctacaccttgaacaagcttcgagagttgaagggaatgacaactataagatttcgtccacattcgggagaggctggtgacattgatcaccttgctgcgacatttctcacttctcacaacattgcacatgggatcaatttgagaaagtctcccgtactccagtatctgtattttctttcacaaatcggtctggccatgtctcctctgagcaacaattctttatttctagactatcacagaaatccatttcaaatgtttttccaaaggggtttaaatgtgtctctttccacggatgatccgcttcagatccacctcactaaggaacctttggttgaagagtacagcatagctgcatcggtttggaaattgagttcatgtgatctatgtgaaattgctcgaaattctgtactgcagtcaggtttctcgcatgctttaaagtctcattggattgggaaagggtactacaagaggggagcagatggaaatgatattcgcaagacgaatgtgcctcatatcaggattgaatttcgtgatatgatctggagagaggagatgcagcaagtttatgcaggcagtgcaaatttccccgaagaacttgacattaagtgatcggaagggataagatgtatgtcttgcatgaatagttggcacaggatgcagtgcctataaggaaacaagcatcggattcctatattattagtagcccaatttctgcagaagttttgcttgctttgaaccaataaaccaagagaaattagctgaaatttgcggacaagctgggtcgcatagaggaggattaagcttcacgtggtgcacgtgccctatatatatagtttgtagtctgccctcgggaaagcatggccatcctggggaaagatcatgggctagagtttctgtaatttctggcatagaattcgtacaatttccgattttacacaggccaaattttgtcccctcaagttttcatgtaagatgctgacataaaacggcgagatgcaaaactgatgcttgatgatttcgggcatatttgcggtcctttctgctacaatttggcg

SEQ ID NO: 3304 - DNA, 2812 bp, Helianthus annuus
cggggacatacgacgcttgtgagtgaataatggacgcttatgcgttgcatctagctatgcgcggcactagtcggagcctcctttgtggcagtttcggcttactatatgcaccggaaaaccctaaatcagctgctggagtttgcaaaatctgttgagagagacagagaagatgtagaggatgagcattacaagaagcaggagaagccgtcgcagcggcggatccacggtggccggagaaatgttgtttaccgccgggcgtccgcttcgttgcctgacgtcacctccatctctcgtgctcatgatgatgatgatgctattattcctgctgggttgcatagactccatacgcttcctgaagggaaatctactagccatactggtttggcaaaaagagcttcactcatactaagaccaacttctccaaaatctccggttgcaagtgcaagtgctttcgaaagtgttgaagggtcagatgaagacgttgatgttgatgtcaatgacaatgacaatgttaatttagatgccacatatcttaacacaaacgggaatgcgggcccagagggcgcaagtgttaatgcaaatggcgaacaattgcccatagctgcagccgctttgatccggtcacatagcgtatctggtgatctacatggtgtacaaccgtatcctgtcgctgctgatattcttcgaaaggagccagagcaggaaacgtttgtacggcttagaatctctccatatgacacaccgtcacctgatgaagcagaggtttacaggactatacaagattgccttgaaatgaggaacagttatgtgtttagagaaagcattgcacatgggaaaaagaaatcatatcggaccctagtacccctaaacgcaatccaaatcctttttcttatgttcccgaaccaaaatctgatcattactttgaaatggaagatggtgtcgttcacgtttacgcaaataaagattcaaaagagaagctttttcccgttgttgacgcaacaaccttttttactgacctacatcacctccttaaagtgatagctgctgggaatacacgaacagtatgtcatcaccggctcggtcttctagaacagaaattcaaccttcatttaatgctaaacgcggataaagagtttttagctcagaaaagtgcaccacaccgcgacttctataatgttcggaaagtcgatacccatgttcatcattctgcatgcatgaatcaaaagcatttgttacggttcataaagtctaagttgaggaaagaacctgatgaggttgtaatatttagggatgggacgtacctgactttaagagaagtttttgagagcttggatttaactagttatgacctcaatgttgatctgttagatgtgcatgcagacaagagcacctttcatcgtttcgacaaatttaatctcaagtataatccctgtggtcagagtaggcttcgggagattttcttgaagcaagataatttaatccagggtcgcttccttgctgagttgaccaaacaagtattcacggatcttgacgcaagtaaatatcaaatggctgaatacagaatatcaatatacgggagaaagcaaagtgaatgggacaatttggcaagttggattgtgaataacgaactctacagtgataatgttgtctggctgattcagctgcctcgactttacaatatatacaaggaaatgggtattgtgacatcatttcagaccattctcgacatatattccttcctcttttcgaggttacagttgacccaggatcacatccgcagttgcatgttttcttgaaacaggttgtgggtttggatttagtagatgatgaaagcaagcctgaaagacgccctacaaagcacatgccaacacctgcacaatggaccaatatattcaaccctgcgttttcatattacgtttactattactacactaacctctataccctaaacaagcttcgtgaatcaaatggcatgactacaatcagattccgccctcattgtggtgaggctggtgacatcgaccatcttgctgctgcgtttcttacaacgcataacatcgcacacgggattaatctgagaaagtctcctgtacttcaatacctgtactaccttgcgcagattggtcttgcaatgtctcctttgagcaacaactcgttatttctagattatcatcggaacccctttccgatgtttttcctcagaggccttaatgtttctttatctactgatgacccgttacaaatccacctaacaaaggaaccattagtggaggagtacagtattgctgcttctgtgtggaagttgagtgcttgtgatctctgtgagattgcgcgtaactcagtttaccaatcaggtttctcacatgttttgaagtcgcattggatcggttcggagtactataagagaggaccagatggaaatgatattcacaggacaaacgtgccgcatatccggcttgaattccgtgacatgatctggagagaggagatgcaacaggtttatctagggagagccgaattgcctgaatacatcgagacttagcttctttcatgtcattccaccatttgtcggtttccggagttagttccgttggccaacttttggtgaattcctgaagctcaagagctaatgtgagagttcagtgaaagctttaggtcaatccatctaagtgtatataagaggacctgagatgtattctatatcacaagatgatgatgatctttttaaggcttttggacctttggtggtgtcttaatgaataaccagaacaattattgtaagatatgtttaataagcatttttatcagtcca

SEQ ID NO: 3305 - DNA, 3196 bp, Citrus sinensis
gctctctctgtctctggtttctctcctcagacctcccctccgctcagaaataacacataacaacgataatattcactcacccgtagtgactcttatttttcttttcgattgttttaatctttgttgccgaaacttctaggaaatggacgcgtatacactgcatctggcgatggcggcgttggtaggagcgtcggtggtggcggtatcggcgtattacatgcacaggaaaaccctaactcagttactggagtttgcgaaatcagtggagagagagcgagacgataactccgacgcagccgaatcgccgcacaatgttaagaggcacggctgcgcggcggctcggcgctgctcttccaggaggaagggaagcggatactaccggcgctgctcggcttcgttgccggacgtaacggccatttctggtcatgcggttgacggtgaggagaggcgcaacggtccgcttcacgttgatggaattcccgccgggcttcccaggcttcatacgttgcctgaagggaaatctgctgggcatgcaagttcaaccaaacgggctggaaaccttatcaggccaacttccccaaagtccccggttgctagtgcctttgagagtgtagaaggatcagatgaagaggataatatgactgatagttcaaaattggacaccacatatctgctcaccaatggaaatgctggcccaaatttaccagaccacatgaatgttaatgcagaggctatagctgcttcaagtatgattcgatctcatagtgtatccggtgacctgcatggggttcagcctgatcctattgctgcagatattctgaggaaagagccagagcaagaaacttttgcgcgacttcagattacccctaaagaggtgccatcacctgatgaaatggaggcctatgtggttcttcaagaatgccttgaaatgcggaaaagatatttattcagaagaagcagttgctccatgggagaaagaaatgatttccgatcctagtactccaaagcctaatccagatccattttattatgctcctgtgggaaagtctgatcatcattttgaagatgcaagatggagttattcatggtttatccaaacaaagattcaaaagaagagctataccctgttgcggatgctacaacctttttcactgacctgcatcacattcttcgagttattgcattgggaaatatgagaactttatgccatcatcggctgcttcttctggagcaaaaattcaatcttcatttgatgcttaatgcggataaggaatttcttgctcagaaaagtgcaccacaccgtgacttttataatgttaggaaggtggatacacatgtgcatcactctgcatgcatgaaccagaaacaccttcttaggtttataaagtcgaagttgaggaaagagcccgatgaggttgtaattttccgtgatgggacatacttgacactaaaagaagtttttgaaagtctggatctaacagggtacgacttgaatgttgatcttttggatgttcacgcagacaagagcacgtttcatcgctttgataagttcaatcttaagtataatccctgtggtcaaagtaggctaagggaaatttttcttaagcaggataatctaatccaaggtcgttttcttgctgagctgacaaagcaagttttttctgatctcgaagcaagtaaatatcagatggctgaatatcgaatatcaatatatggaaggaagcaaagtgaatgggatcaactggcaagttggattgtgaacaatgaattgtacagtgagaatgttgtttggttaattcagcttccacggctgtacaacatttacaaggacatggggattgtgacatctttccagaacattcttgacaatatttttattccactgtttgaggttactgtggatcccgattctcatcctcagttgcatgttttcttaaagcaggtggttgggttggatttggtggatgatgaaagcaagccagaaagacgccccacaaaacacatgcccacaccagctcagtggaccaatgtgttcaatcctgcattttcatactatgcgtattattgttatgctaatctctacacattaaacaagctccgtgaatcgaagggcttgacaactatcaaattccgcccgcatgcaggagaggctggtgacatcgaccaccttgctgcaacatttcttacagctcataatattgcacatggaatcaatttgaggaaatctcctgtactgcagtatctctattatttggcacagattggtctggctatgtctcctctaagcaacaactctttgtttttggactatcatcgaaatcctttacccatgtttttcttacgtggtctcaatgtctcactctcgaccgatgatcctctccaaattcatctaactaaagaacctttggtggaagaatatagcattgctgcttctgtgtggaagttgagtgcatgtgatctttgtgagattgctcgtaattcagtctaccaatcaggtttctctcatgctttgaagtcgcattggatcggattacattactacaagagaggaccggatggaaatgatattcacaaaaccaatgtgcctcacatccggattgaattccgtgatacgatttggagggaggagttgcagcaggtttatttagggaaggccatcatccctgaagaattgctgtgaaaaaatgaccataacttttgtctttagaggatgtgaagagcatacacttccaactccacattcaccatcaaatggagtttgatcatatgttgtcgaccaagaaggttaagaaacggctagtagctaaacacaagtttgaggacctaaggatgactatgtacacgataaaatcatggggtggggatgtctgcacgatctatacgatagagcttcagtcaatacagcctatagcaactagatgctggtctagtatctctgatcaaataactacattgatcatctgtgttatttctaggtaggagtcaaaagagcaataatatcatatccgaggctgaatttttgtattattgcagctttatttattatcaaagaaagacttacccagggcaataggaaaactgaaaagggtggccttgcccttgcaaattttgtcgtgcagtatctatcatcaaaagttttgtggttgtttctcatgaattataagtaacatatttaacaccaagtgatgcttttcat

SEQ ID NO: 3306 - DNA, 3194 bp, Zea mays
atgctactgctgctactgctaaaatccccctcacactcacacccctctcctaatcatccgcttaaacccacgagcccggcaggcaggcaggcagcccggtgccgatggactcctcgggctccgcctcgtcctacaagctgcagctcgccctcgcggcactcgttggtgcctccgccgccgcttcagcggcctactacctgcactgccgtgccgtcgcgcaggttgctcgctccgcctccacgagccgccgtaggccccgcgcccccgcctccgccgctagcggcggcggcggcggcggcgtgaagctccctccaccgcgccgcgctgccgtcggctcagcctcgcttcccgacctctctgcgttctatgatgtcggcagccgcggcggcggcgggctcgccgccggcgggtacctcgtggaggaggaggaggacgacgatgcggatggggtcgtgggcccgcacgtgaacggtggcgcgctcgaccccgcggagttccttcagataccccagggcttgcctagactgcacgtgggccccgacggcagtaaacaacttgcccggtcaggttcaaatagacgggttgaaataattagacctaagtcacccaagtctcctgctgccagtgcaagtgaagatggatcagatgaggatgattctatacaaagtagtggtaaacttgacaatggctacatggacacaagtggaaacctggaaggagaacacaaaggaaatgcaattgtggaaaatggggctgccaagccattagctgcagcaaacttgatacggtcacgcagtaaatccaataatcttcatgcagttcaacctgacccagttgctgcagatattctacgaaaagaacctcagcaagaatcatttgtcaagctgctaactactccaaaggagattccgactgctgatgaaattgaggtgttcaaaatccttcagaagtgcctcgagttaagagactcttatctctttagagaggaggttgctccatgggagaaggaggtcataaatgacccctgtactccaaaacctaaccccaacccgttcacttatgtgcctgaaccaaagtcagagcatgttttccaaactgttgatggcgttatccatgtttatgcggataaagattgtacggagagcatttatcctgtggctgatgctacaaccttcttcactgacttgcattatattctccgagtaacggctgcagggaacacaagaactgtctgccataatcggttaaatcttcttgagcataagtttaaattccatctgatgttaaatgcggatagggaatttcttgcccagaagactgccccacatcgtgatttttacaatgtcaggaaggttgacactcatgttcatcattcagcatgcatgaatcaaaaacatctgttgaggttcataaaatccaaactaagaaaagaacctgatgaggtggtcattttcagagatggtacttatatgactttaaaagaggtttttgagagcttggacttaactgggtatgatctgaatgttgatttgctagatgtccatgcagacaaaagcacatttcatcgttttgacaaattcaatctaaaatacaatccatgtggccaaagtaggctcagagaaattttcctcaaacaagataatcttattcaaggccgttttcttgctgagttgacaaagcaagttttctctgacctttctgctagcaaatatcagatggcagaatataggatttcaatctacggaaggaaacagagtgaatgggaccaacttgcaagttggatagtgaacaatgaattgcacagtggaaatgttgtctggctggttcagattccacgcttatataatgtgtacaaggaaatgggtatcgttacatcattccaaaatcttcttgacaacattttcgttcctctttttgaggttactattgatccagcttcacacccacagctccatgtcttcctgaagcaggttgtagggttggacctggttgatgatgaaagtaaaccagaaaggcgtccaacaaagcacatgcccacacctgaacagtggaccaatgtgttcaaccctgcattttcatattatgcgtactactgctatgctaacttattcaccctaaacaagctgcgtgagtcaaagggaatgaccactatcaaattccgtccacatgctggagaggctggagatgttgatcacttggcagcgacatttcttctctgtcacaacatatcacatggaattaatctaaggaagtctcctgtgcttcagtacttgtactatcttggtcagattggtctggcgatgtccccattgagcaacaactccttatttcttgactatcatcgcaacccttttccaacgttcttccaacgaggtctgaatgtctcattatctacggatgaccctttgcaaattcacctgacaaaagaaccattggtggaagaatacagcattgctgcttcgctgtggaagctcagttcttgtgatttatgcgaaattgcgaggaactctgtttaccaatctgggttttcacatgctctcaaggcgcactggattggtaagaactacttcaaaagaggacctgctggaaatgatattcacagaaccaatgtaccgcacatcagggttcaatttagagagatgatctggagaaatgaaatgaaactagtgtactctgacaatgagatcttaataccagacgagctggacctgtaagatgtccagcctcgtgtataccagacgagttgcgttgtagctgctatgggaattatacttcatgttttgttgctggaagtcggcaaagtgatcaagagtgtcaccaagcataccaactaccaagggatgcaatactacctccattctcgaatatttgccgtccgctagtttatttttgaactaaaacatgacaaataaaaaagaacggaggaagtaatacggcaaagtgaagcaacagatgcttgtgtaggagttgtgttactatcttcaaggcttgtgcaagagttgtgttaatgtctcttactcacccttatctcttatcttaaatcttactttataagtgttttttttttgcatgctcatagctagtattccctgaacaccccccctcccctcgaattgtaaccatgtactcgaagtgcttgcactctggttggatcctatacggtgagtaaggtgctatcggttgttatgctgccc

SEQ ID NO: 3307 - DNA, 3285 bp, Tabernaemontana elegans
acctcgcctccctctgtctactattcagtagggtttctcagctgttacagtcctcaattcatacaatatatatacagagaggtgtatatatataaagagataaagtttggggttagagcgtgtgaggaggaaacagagacagtgagtgatggacacgtatgcgttgcacttagccatggccgcactggtgggggcatcagtggtggcggtgtctgcgtactacatgcaccggaaaaccctaaaccagttgctggagttcgccaagactatagagagagaaagggagagggaggactttgcggaagaaggtggaggcggaggtggaggtgactcgccgcagcatttgaggaggtgcggcagcgtggagaagaggcggaaccatagtcgtaggaaggggaacgggtactaccgccgggggtccgcttcattgccggatgtcacggctatttctggtgcggcggatgttgttgaagagaagaggaatggtccggtccgtgttgattctattccagctgggttgcctaggctccatacgcttcctgaagggaaatctggtcatacgagttcaaccaagagagcaggacatcttattagacctacttctcccaagtctccagttgctagtgccagtgcatttgaaagcatggaaggatctgacgacgaagataatatgacggacagtgctaaactagacactgcatatattcacaccaatggaaatgtgggtccagagtgcgaaagcatgtttcagaacttaccaaaccacatgaatgccgataacggagagcaaatggcaatggctgcatcaagtatgattcggtcccatagtgtatcaggtgacctgcatagtgttcaacctgaccctgtagctgctgatattctcaggaaagaaccagagcaggaaacttttgtccggctgagaatttccccaatggaggtgccatctgctgatgaagcggaggtctatcgcaatctgcaagactgtcttgaactgaggcggagttatgtatttagggaagctgtttcaccatgggagaaagaaataatatctgatccaagcacaccaaagcccaatcctaatccatttgattttattccagagggaaaatctgatcatcactttcagatggaagatggtgtagttcaagtctatgcaaataaagactcaaaggagaaactttttcctgttgcggatgcaacaacatttttcactgatctgcatcacatcctcaaagttattgctgctgggaacatccggacattatgccatcatcgccttgttcttctggaacaaaaattcaatcttcatttaatgctcaatgcggatagggaattccttgctcaaaaaagtgcaccgcatcgtgacttttataatgtgcggaaagttgacacccatgttcatcactcagcatgcatgaatcaaaagcatctattgaggtttataaagtcgaagctgaggaaagaacctgatgaggtggttatatttcgagatgggacctatttgacattgaaagaggtttttgagagcttggacttatctgggtatgatctgaatgtcgacctgctcgatgttcatgctgacaagagtacctttcatcgttttgacaagttcaatctcaagtataatccctgtggacaaagtaggctgagggaaattttcttgaagcaggataatcttatacagggtcgtttccttggtgagctgactaagcaagtcttttctgatcttgtggcaagtaaataccaaatggctgaatacagggtatcgatatatggtagaaagcagagtgaatgggaccagctggctagttggatcgtaaataatgatttgtacagtgaaaatgttgtctggttgattcagcttccaaggctctacaatatctacaaggaaatgggaattgtgacatctttccaaaacattcttgataatgttttcattcctttgtttgaggttactgtcgatccagattcacatccacagttgcatgttttcttgaagcaggttgtaggttttgatttggtggatgatgaaagcaagcctgaaagacggccaacgaagcacatgccgacacctgctcaatggaccaatattttcaatcctgcattttcatattatgcttactattgttatgccaacctctacaccctgaataagctccgtgaatcaaaaggtatgacaacgatcaaattccgtccgcattctggagaggctggtgatattgatcaccttgcggcaacatttctgactgctcataatattgcacatggaatcaacttgagaaaatcccctgttcttcaatatttgtactacctagcccagattggtttggcaatgtcacctctgagcaacaattccctatttttagactaccatcggaatcctttccctgtgtttttcctacgtgggctcaatgtttccctttcgaccgatgatccattacaaatccacttaaccaaagagccccttgtggaagagtacagtattgctgcctctgtgtggaagttgagtgcatgtgatttgtgcgagattgctcgcaattcagtctatcagtctggtttctcacatgcactgaagtcgcactgggttgggaaggagtactacaagagaggaccagatgggaatgatatccacaagaccaacgtgcctcatatccggcttgaatttcgtgatatgatctggagagaggagatgcaacaagtttatttgggcaaggctatttttcccgaacacgttgatccctaatctgcacggcacattggttttgtgggcttgggtattctctttatcctggaggtgacaacttatttacttatacggcaaggaaggaaacctttaacttataagttcgaggataacagaatgctcgctttctttattaattttgctgaccatcagaagagtagcagagcctgctacattccttcatttgcagggacggacgtctgagctgcatgcatctggatgggatactaggtcagcgtaagctacagctaatagcttgaatgaagcagtgttcaaatcactgatgatgaaagtctgaataagatctccggtgtcttgggaagagcggacgcgaatatatggaataaagtttgcacaccatatagttatgtatcttacatatttaaaaatgacatatctatcctagcaatagaaaaaaaattagaagttaatctgcaaaatttggaataatcttttatattatgcatattgtaacatcaaattgatcatgtcatgtttcattgaatttttgggttatgtttttggagtgatcttctagtttc

SEQ ID NO: 3308 - DNA, 2344 bp, Brassica napus
ctagaacagaaatttaatctgcatttgatgcttaatgcggataaagagttcctcgcccaaaaaagtgcaccacaccgtgatttttataacgttaggaaagtggacactcatgttcatcactcagcttgcatgaaccagaagcacctcttgaggtttatcaagtcaaagctccggaaagaacctgatgaggttgtcatcttccgggatggaacttatttaaccttgaaagaagtttttgagagcttggatctaactggatatgacttgaacgtcgaccttatggatgttcatgcagacaagagtacattccatcgctttgataagttcaacctcaagtacaatccatgtggtcagagtaggcttagggaaattttccttaaacaggataatctcatccaaggtcgttttcttggtgagataacaaaacaagttttctccgaccttgaagctagcaaatatcagatggctgaatacagaatatctatatacggcagaaaaatgagcgagtgggaccaactggctagttggattgtgaacaatgatctatacagtgagaacgttgtctggttaatccagctcccacgcctgtacaacatctacaaggacatgggtattgtgacatcattccagaatatccttgacaatatattcattcctctgtttgaagccacggtggatccggattctcatccccagctccatgttttcttgaagcaggttgttggatttgatttggtcgatgatgaaagcaaacctgagagacgtcccacgaaacacatgcccactccagctcaatggacgaacgcatttaatcctgcattctcatactatgtgtactactgttacgctaacctctatgtgttaaacaagcttcgggagtcaaagggcatgacaacgatcacactacggccacattctggggaggctggtgacattgaccacttggctgctacattcctcacatgccacagcatcgctcatggaatcaatctacgaaagtctcctgtgcttcagtatctttactacctcgcccagattggtctggccatgtctccactgagcaacaactctctgtttctagactaccacagaaacccgtttcctgtgtttttcttaagaggtctcaatgtttccctgtccacggatgatccccttcagattcacttgaccaaagaacctctcgtggaagagtacagcattgctgcctcggtttggaagctgagttcgtgtgacctgtgcgagatagctcgtaactcagtgtatcagtcaggtttctcacatgccctcaagtcgcactggattggaaaagactactacaaaagaggacctgatggaaacgacattcacaaaacaaatgtacctcacatcagggtggagttccgtgacacgatatggaaagaggagatgcaacaggtttatttgggaaaggctgttatctctgatgaagttgttccataagaaacagcaatgagaaatatggcaacgtggaggggagggggtttttacaccaagggaggcgtcttcagaagtatacgatgcaggaagtagatagggtaataaaatgagagtggctatgttgtgaaggctgccaaatctattgtttctatgaatcgtaatccttttttatattatttctagagctgactctaaagagctgcatacgacattgaggactgttttttctctatataaagagagcataagagttgtatcatttaattcttgttcagttttgaattttgattaagaccggtttataggtgcaaaaaaataaaaaatattagggtccgcctccttctagaagggatcccaaactttaccttgccgcggtgcctatgccgaaggtttatataagtttttttatatggggtgccacctctttagttttaatacatttatctggcgccttgatgttttatacaaaatacacggcttgtttcatttgtgaaatattcctctagtgggggagtgttccccacattatcattgctatgggctctcttgtatattctatatctgtgacctctctctttgtgtcgcatctctatatgtcgttcatatatattatatatataaagatggtgtcttttgtagtacagtgagtgttacctcttattattttccatatacatattttttgttgacacactactcctgattcttttagatatccttcattttggtggagggtcgcatgctccctcttctgctaaacgctgttattttttctcctctctatattacagtcttctctgtatataaaagtgggcgggatgttgtctcgtatcctactcatacggcgtgagtctccccgcgctttttataacacttatgctttgctctc

SEQ ID NO: 3309 - DNA, 3604 bp, Sorghum bicolor
atgctactgctgctaatgctaatccccctcacatccctctcctaatcacttccttaaacccacgagccccccgcctcaccggcaggcggcaggcggcgcggcgccaatggactcctcgggctccgcctcgtcgtacaagctgcagctcgccctcgcggcgctcgtgggcgcctcctccgccgccgtagcggcctactacctgcactaccgtgccgtcgcgcaggtcgctcgctccgcctccaccaaccgccgcaggacccgcccccccacccccgcccccgccgccagcggccggaagctccctccgccgcgccgcgatgccgtcggctcagcctcgcttcccgacctctctgcgttctatgatgccggcggccacggcggcggcgggctcgcctccagcgggtacctcgtggaggaggaggaggaggatgatgcgcatggggtcgtgggcccgcacgcgaacggtggcgcgctcgaacacgcggagctgctggacatcccccagggattgcctagactgaacgtgggccccgacggcagtaaaccatttgcccgtacagtttcaactagacgagttgaaataattagacctaagtcacccaagtcccctgctgccagtgcaagtgcacttgagagtgcagatggatcaggtgatgctatacaaaatagtgacaatggctacatgaacacaaatggaaacctggaaggcgaacacaaaggaaatgcaattgtggaaaatggggctgccaaaccattagctgcagcaagcttgatgcggtcaaaaagtatatccaatggtcttcatgcagttcaacctgacccagttgctgcagatattctacgaaaagaagctcagcaagaatcatttatcaagatgttaactactccagaggagattccaactgctgacgaaattgaggtgttcaaaatccttcagaagtgcctcgagttaagagactcttatctctttagagaagaggttactccatgggagaaggaggccataaatgacccctgtactccaaaacctaaccccaacccgttcacttatgtgcctgaaccaaagtcagagcatgtcttccaaatggttgatggtgttgtccatgtttatgcggataaagattgtacagagagcatttatcctgtggctgatgccacaaccttcttcacggacctgcattatattctccgagtaacggctgcagggaacacaagaactgtctgccataatcggttaaatcttcttgagcataagtttaaatttcatctgatgttaaatgcggatagggaatttcttgcccagaagaccgcaccgcatcgtgatttttacaatgtcaggaaggttgacactcatgttcatcattcagcatgcatgaatcaaaagcatctgttgaggttcataaaatccaaactaaggaaagaacctgatgaggtggtcattttcagagatggtacttatatgactttaaaagaggtttttgagagcttggacttaactgggtatgatctgaatgttgatttgctagatgtccatgcagacaaaagcacatttcatcgttttgacaaattcaacctaaaatataatccatgtggccaaagtaggctcagagaaattttcctcaaacaagacaatctcattcaaggccgttttcttgccgagttgacaaagcaagttttctctgacctttctgctagcaaatatcagctggcagaatataggatttcaatctatgggaggaaacaaagtgaatgggaccaacttgcgagttggatagtgaacaatgaattgcacaatgaaaatgttgtctggctggttcagattccacgcttatataacgtgtacaagggaatgggtattgttacgtcattccaaaatcttcttgacaacattttccttcctctttttgaggttactattgatccagcttcacacccgcagctccatgtcttcctgaagcaggttgtagggctggacctggttgatgatgaaagtaaaccagaaaggcgtccaacaaagcaccacatgcctacacctgaacagtggaccaatgtgttcaaccctgcattttcatattatgcatactactgctatgctaacttattcaccctaaacaagctgcgtgagtcaaaggggatgaccactatcaaattccgtccacatgctggagaggctggagatatcgatcacttggctgcaacatttcttctttgtcacaacatatcacatggaatcaatctaaggaagtctcctgtgcttcagtacttatactatcttggtcagattggtctggcgatgtcgccattgagcaacaactccttgtttcttgactatcatcgcaacccttttccaacgttcttccaacgaggtctgaatgtctcattatctacggatgaccctttgcaaattcacctgacaaaagaaccattggtggaagaatacagcattgctgcttcgctgtggaagctcagttcttgtgatttatgtgaaattgcaaggaactccgtttatcaatctggattttcacatgctcaaaagtctcactggattggcaagaactacttcaaaagaggacttgctggaaatgacattcacagaacgaatgtaccacacatcagggttcaatttagagaaatgatctggagaaatgaaatgaaactagtttactctgacaatgagatcttaataccagacgagctggatctgtaagatgtccggcctcatgtataacctgtagtggcaatgggaattatacttcatgttttgttgctggaagtcagcatgagaagcgatgtgatcaagagtgtctccaaaccctattgaggaaaacctccagaaatgccccaagcacgccaagggatgcaataatgtggcaaagtgaagcagcagagatttgtgctagagttgcattatagcattatagggtgtcccctgtcccccctcgtttgtaagcatgtactcgaagtggttgtactctggttggatcctatagggtgagaataaagtgctgccggttgttttgctgcccagatgaaaatggaatcgaaccagatgaggaggcaattagataattaagtaaagccggttgtttgcccagatgaaaacagcaaccgaacaagaatagcaggcagttaatgcgcagatgaagaggatgctgtcatgacatagttcctagtaccaatgatgtcaacacgtctatgggtctggtgtgatgagtattgagtagttgtggtccattttcttgaatgatccgagaacttgataactactgatacgcaacctgacgacgaggcagtgcaccgtgagttcggcacatgcaatgaactgccggcacaattacccttccatgcaccaaaggagctagcccacgcaatcagccataaaagtcatgaaagcacaaactggagcactgtaattcggcgttctacaactccggaaggaaagaagaagttttgcaagcctctcaagacttcacgagtggttgttctcaacgtaacataagtgtttacatgaaatttgattaaggatgggaatggtccttcaaatggatacctgtggttcttctctaatgtaatttaatgaactaaataaacaatttctctcctc

SEQ ID NO: 3310 - DNA, 2844 bp, Arabidopsis lyrata
gccactaaaacgaaatcgtggtcttactctctcttctgacctgagctcacacacagattttgattgtgtctgtcactcatggaacccaatatttaccaacttgccctcgcggctctctttggagcttcctttgttgctgtttctgggtttttcatgcatttcaaggccctgaatctagtccttgagcgtggtaaggagcgtaaagagaaccctgaaggagacgagcctcaaaatcctaccttggtgagacggcggagccaggttagaaggaagggtattgaccaatacggtcgcagtcctgcttctcttccagatgccactccttttaccgatggcggcggtggtgatacaggtcggagcaacggtcacgtttatgtcgatgaaatccctcctggtctcccgaggcttcatacgccatctgaagggagagcttcagtacatggagctagtagtatcaggaaaactggaagctttgttagaccaatctctccgaaatcccctgttgctagtgctagtgcttttgagagtgtggaagaatctgatgatgatgataatttgactaatactgagggtttagatgcttcctacttgcaagctaatggtgacaatgaattgcctgtagatgccaatgaagagcaaatatctatggctgcttcaagtatgattcgatcacacagtgtgtctggtgacttacatggagttcagcctgatcctattgccgctgatattcttcgtaaggagcccgagcaagagacctttgtccgtcttaatgttcctcttgaggtgccaacatccgatgaagttgaagcctataaatgtctgcaagaatgtcttgaactgcggaagaggtatgtcttccaagaaacagttgcaccatgggaaaaagaagtcatatctgatcctagtactccaaagcctaatacagagccatttgcacactatcctcagggaaaatctgatcattattttgagatgcaagatggggtagtccacgtgtttgcaaataaagatacaaaagaagagctcttcccggtagctgatgccacagcgtttttcactgacttgcatcacgtactcaaagtcatagctgcaggaaacatccggactttgtgccaccgtcgactagtgctcctagaacaggcaagaaaatttaatctccatttgatgcttaatgcggataaagaatttcttgctcaaaaaagtgcaccacatcgtgatttttataacgttaggaaagtcgacactcatgtgcatcattcagcttgcatgaaccagaaacaccttttaaggtttatcaagtctaagctccggaaagaacccgatgaggttgtaatattccgagatggaacatatttgaccttgagagaagtttttgagagcctggatctgactggatatgacctgaacgtcgaccttttggatgttcatgcagacaaaagtacctttcatcgttttgataagttcaacctaaagtataatccttgtggtcaaagtaggcttagggaaattttccttaaacaggataatcttatccaaggtcgatttcttggtgagataacaaagcaagtcttctctgaccttgaagctagtaaatatcagatggccgaatacagaatatctatatatggcagaaaaatgagtgagtgggaccaactcgctagttggattgtgaacaatgatctatacagtgagaatgttgtctggttaattcagctcccacgcttgtacaacatttataaggacatgggtatcgtgacatctttccagaatatcctggacaatattttcattcctctgtttgaagcgacggtagatcctgattcccatccccagctccatgttttcttgaagcaggttgttggatttgatttggttgatgatgaaagcaaacctgaaagacgtcccacaaaacacatgcccactccagctcaatggactaacgcattcaatcctgcattttcttactatgtctactattgttatgctaacctctatgtgttaaataagcttcgagagtcaaagggcatgactaccatcacgctgcgaccacattctggagaggctggtgacattgaccacttggctgctacgtttctaacatgccatagcattgcacatggaatcaatctgcgaaagtctcctgtgcttcagtatctatactacctcgcccagattggtctggccatgtcaccactgagcaacaactctttgtttctagattaccaccgaaacccctttcctgtgtttttcttgagaggtctcaatgtgtctctgtctactgatgacccccttcagattcacttaactaaagagccgctcgtggaagagtatagcatagctgcctcagtttggaagctgagtgcgtgtgacctgtgcgagatagctcgtaactcagtgtaccagtcaggtttctcacatgccctgaagtcgcactggattggaaaagactactacaaaagaggacccgatggaaacgacattcacaaaacaaacgtgccacacataagggtggagttccgtgacacgatctggaaagaggagatgcaacaggtttatctaggcaaggctattatctcagatgaagttgttccgtaaacaccgcaatcagaaatggcaacgtttaagaatccaacatatttcaggagaacaaagagagcaagcagctagagaagtatacgaagcaggaacctagtagatagggtaataatatgagtggctctgtgccctgagaaagcgatttggctgtcaatcatattgtcttataaagctttttagataaagagagatacaaagtgaccagttgagaaccggttttaatataatggatttcagttttttggatta

SEQ ID NO: 3311 - DNA, 2908 bp, Arabidopsis thaliana
agcctttttgcaagtggcgtggtttcactcgttgggcctataaataacaactcaacctcgacctcccaccatcgccactaaaacgaaatcgtggtcttactctctcttctgagttctgacctgagcacacacacagagattttgattgtgtcactcatggaacccaatatttaccaacttgccctcgcggctctattcggagcttccttcgttgctgtttctgggtttttcatgcatttcaaggcactgaatctagtccttgagcgtggtaaggagcgtaaagagaaccctgatggagacgagcctcaaaatccgaccttggtgaggcggcggagccaagttagaaggaaggttaatgaccaatatggtcgcagtcctgcttctcttccagatgccactccttttaccgatggtggcggcggcggcggcggtgatacaggacggagcaacggtcacgtttatgtcgatgaaattcctcctggtctccctaggcttcatacgccatctgaagggagagcttctgtacatggagctagtagtatcaggaaaactggaagctttgttagaccaatatctccgaaatcccctgttgctagtgctagtgcttttgagagtgtggaagaatcagatgatgatgataatttgactaatagtgagggtttagatgcttcctacttgcaagctaatggtgacaatgagatgcctgcagatgctaatgaagaacaaatatctatggctgcttcaagtatgattcgatcccatagtgtgtctggtgacttacatggagttcagcctgatcctattgctgctgacattcttcgtaaggagccagagcaagagacctttgtccgtcttaatgttcctcttgaggtgccaacgtccgatgaagttgaagcctataaatgtctgcaagaatgtcttgaactgcggaagaggtatgtcttccaagaaacagttgcaccatgggaaaaagaagtcatatctgatcctagtactccaaagcctaatacagagccatttgcacactatcctcagggaaaatctgatcattgttttgagatgcaagatggggttgtccacgtgtttgcaaataaagatgcaaaagaagatctcttcccggtagctgatgccacagcgtttttcactgacttgcatcacgtactcaaagtcatagctgcaggaaacatccggactttgtgccaccgtcgactagtgctcctagaacagaaatttaatctccatttgatgcttaatgcggataaagaatttcttgctcaaaaaagtgcaccacatcgtgatttttataacgttaggaaagtcgacactcatgtgcatcattcagcttgcatgaaccagaaacaccttttaaggtttattaagtcaaagctccggaaagaacccgatgaggttgtaatattccgagatggaacatatttgaccttgagagaagtttttgagagcctggatctgactggatatgacctgaacgtcgaccttttggatgttcatgcagacaaaagtacctttcatcgttttgataagttcaacctaaagtataacccttgtggtcaaagtaggcttagggagattttccttaaacaggataatctcatccaaggtcgatttcttggtgagataacaaagcaagtcttctctgaccttgaagctagtaaatatcagatggctgaatacagaatatctatatatggcagaaaaatgagcgagtgggaccaactcgctagttggattgtgaacaatgatctatacagtgagaatgttgtctggttaattcagctcccacgcttgtacaacatttacaaggacatgggtattgtgacatcgttccagaatatcctggacaatatattcattcctctgtttgaagccacggtagatcctgattcccatcctcagctccatgtttttttgaagcaggttgttggatttgatttggttgatgatgaaagcaaacctgaaagacgtcccacaaaacacatgcccactccagctcaatggactaacgcattcaatcctgcattttcgtattatgtctactattgttatgctaacctctatgtgttaaataagcttcgagagtcaaagggcatgactactatcacgctacgaccacattctggagaggctggtgacattgaccacttggctgctacgtttctaacatgccatagcatcgcacatggaatcaatctgcgaaagtctcctgtgcttcagtatctgtactacctcgcccagattggtctggccatgtcaccactgagcaacaactctttgtttctagattaccaccggaacccgtttcctgtgtttttcttaagaggtctcaatgtttctctgtctactgatgacccccttcagattcacttaactaaagaacctctcgtggaagagtatagcatagctgcatcagtttggaagctgagtgcgtgtgacctgtgcgagatagctcgtaactcagtgtaccagtcaggtttctcacacgccctgaagtcgcactggattggaaaagattactacaaaagaggacctgatggaaacgacattcacaaaacaaacgtgccacacataagggtggagttccgtgacacgatctggaaagaggagatgcaacaggtttatctgggcaaggctgttatctctgatgaagttgttccataaaaaccacaatcagaaatggcaagacattgcaggggaacaaagagagcattttgagaagtatacgaaagcaggaacctagtagatagggtaataatatgagtggctctgtgccctgagaaagcgattaggctgtgccaaaatcttattgttttataaagctttttagataatgagatacaaagagaccagttgagaaccggttttaatataatggatttcagtttttggatta

SEQ ID NO: 3312 - DNA, 2005 bp, Brassica rapa
  misc_feature (749)..(749): n is a, c, g, or t
  misc_feature (782)..(782): n is a, c, g, or t
  misc_feature (794)..(794): n is a, c, g, or t
  misc_feature (797)..(797): n is a, c, g, or t
  misc_feature (818)..(818): n is a, c, g, or t
  misc_feature (857)..(857): n is a, c, g, or t
  misc_feature (864)..(864): n is a, c, g, or t
  misc_feature (1910)..(1910): n is a, c, g, or t
tcttccaagaaacagttgcgccatgggaaaaagaagtcatatctgatcctagtaccccaaagcctaatctagagccatttgcacattatcctcagggaaagtctgatcatcattttgagatgctagatggagtagtccacgtgtttcctaataaagatgtcaaagaagagctcttccctgtagctgatgccacagcgtttttcactgacttgcatcacgtactcaaagtcatagctgcaggaaacatgaggactctgtgccaccgtcgtctagtgctcctagaacagaaatttaatctccatttgatgcttaatgcggataaagagtttctcgcccaaaaaagtgcaccacatcgtgatttctataacgtgaggaaagtagacactcatgttcatcattcagcttgcatgaaccagaaacacctcttaaggtttatcaagtcgaagctcaggaaagaacctgatgaggttgtcatatttagggatggaacatatttgaccttgaaagaagtttttgagagccttgatctgactggatatgatctgaacgtggaccttttggatgtgcacgctgataagagcacttttcatcgctttgacaagttcaacctcaagtacaatccatgtggtcaaagtaggctgagggaaattttccttaaacaggataatctcatccaaggtcgttttcttggtgagataacaaaacaagttttctccgaccttgaagctagcaaatatcagatggctgantacagaatatctatatacggcagaaaaatgagngagtgggaccanctngctagttggattgtgaacaangatctatacagtgagaacgttgtctggttaatccagctnccacgcntgtacaacatctacaaggacatgggtattgtgacatcgttccagaatatccttgacaatatattcattcctctgtttgaagccacggtagatccggattcgcatccccagctccatgttttcttgaagcaggttgttggatttgatttggttgatgatgaaagtaaacctgagagacgtcccacgaaacacatgcccactccagctcaatggacgaacgcatttaatcctgcattttcctactatgtctactactgttacgctaacctctatgtgttaaacaagcttcgggagtcaaagggcatgacaacgatcacactacggccacattctggggaggctggtgacattgaccacttggctgctacgtttctcacatgccatagcatcgctcatggaatcaatctacgaaagtctcctgtgcttcagtatctctactacctcgcccagattggtctggccatgtctccactgaccaacaactctctgtttctagattaccaccggaacccgtttcctgtgtttttcttaagaggtctcaatgtttctctgtccacggatgatccccttcagattcacttaactaaagaacctctcgtggaagagtacagcattgctgcctcggtttggaagctgagttcgtgtgacctgtgcgagatagctcgtaactcagtgtaccagtcaggtttctcacatgccctcaagtcgcactggattggaaaagactactacaaaagaggacctgatggaaacgacattcataaaacaaatgtacctcacataagggtggagttccgtgacacgatctggaaagaggagatgcaacaggtttatttgggaaaggctgttatctcagatgaagttgttccataagaaacagcaatcagaaatggcaacgtggggatggggtttttacattaagggtggcgttttcagaaatatacgatgcaggaagtagatagggtaataaaatgagagtggctggctatgttgtgcctttatgacggctgccaaaatctattgtttctatgaatcttattttttttnttttctcttttttttcgagagctgactttaaagagctgcaaacgacttggataactgtttttttctctatataaagggaccataagagttatatc

SEQ ID NO: 3313 - DNA, 2362 bp, Triphysaria pusilla
ggctaatctagaacgctcatatcttcgcttccacggaaaaactaaagtaccagaccatatcaatgcaaacagtgaatcaacggcactggctacaccaagcatgattcgttcacatagtgtatctggtgatctacacggtgtccaacctgatcctgtggctgctgatattctgaggaaagagccagagcaagagtcttttgtacgattgagaatttctcccaacgagataccatctccagatgaagtagaggtttaccgtactctgcaagtttgccttgaaatgaggaaaacttacgtgtttaaagaagctgtttctccttgggaaaaggaaattatatctaatcctagtactccaaagcgagtcttgaacccatttgatcatacacccgaggcgaaatctgagcattattttcagatggaagatggagttgttcaagtttattcaaacaaaaactcgaaagagaaacttttttctgtagctgacgcgacaacttttttcactgatctgcatcatatccttaaggtcatagcagctggaaacatccgaaccctatgtcaccacagactagttcttctagaacagaaattcaaccttcatctaatgcttaatgcggataaagaattcctggctcaaaaaagtgctccacatcgagatttttataacgtgaggaaagtcgacactcacgttcatcattctgcttgcatgaatcaaaagcatcttctacggttcataaaatcaaagttgaggaaggaaccggacgaggttgttatattccgagatggaacatatctgacattgaaagaggtgtttgagagcttggatttaacagggtacgatctgaatgttgaccttttagacgttcatgcagacaaaagcacatttcatcgctttgacaaatttaatttgaagtataatccatgtggtcaaagtagattgagggagatcttcctgaaacaggataatcttatacagggtcgtttcctgggtgaattgacaaagcaagtttttacagatttggaaacaagtaaatatcaaatggctgagtatcgaatatcaatatatggcagaaaaatgagtgagtgggaccaactggcaagttggatcgtaaataatgacttgtacagcgataatgttgtatggttggttcagcttccaagactctacaatatttacaaggatatgggaatagtgacctcatttcagaacatccttgataacatctttctgcctttatttgaggttacagtcgatccagattcacatccacagttgcatgtcatcttaaagcaggttgttggattggatcttgtggatgatgaaagcaagcctgagagacggcctacaaaacacatgcctaccccagcccagtggactaatatattcaatcctgcattctcgtactatgcatactactgttatgctaacctctacaccctaaataagctacgtgaatccaaaggtatgagcactattaagttcaggccccattctggagaggctggcgacatagaccatcttgcagcaacttttctcacagctcataatattgcgcatgggataaatctaagaaaatctccagtccttcaatacttatactacctagctcagattggtttggcaatgtctcctttgagcaacaactccttattcctggactaccatcgtaatccatttcccatgtttttcctacggggacttaacgtgtccctctcgaccgatgaccctttacaaatccacttaacaaaagagccccttgtggaagaatacagtattgctgcttcggtgtggaagttaagttcatgtgatttatgtgagattgctcgaaattctgtgtatcagtctggtttttcacatgctttaaagtctcactggattggtaaggaatactttgagaggggaccggatggaaacgacattcacaagacaaatgtccctcatataaggctcgaatttcgcgatatgatttggagagaggaaatgcatcaggtttatttgggcaaggcaaactttcccaagtttattgatccatgatccaaggaacttgcaaacgaggtccaagggtactacttatagtcgcaacatgtagttaagtagccaccgtgtactcatgataagaaatgtccagaataaaaacacttgcaagaattctcttgtactatccaataatgacgtaatatcgactatcatcaattgtgtcgaaaacttcattttcaatatgaataactggtgtggtatttcatcactggactctacaaatgtaaatcactcattgcctactcacaaaataatcattagaatcgggagtagagatgttgatttggttcatccggattgatttaaacggaaatgacagaatcagac

SEQ ID NO: 3314 - DNA, 1730 bp, Cucurbita pepo
tcttaaatacaacccctgtggtcaaagtaggctcagggagatcttcctaaagcaggataacctaattcaaggccgtttccttggtgaggtgaccaaacaagtattttctgatcttggtgcaagtaaatatcagatggctgaatatcggatatctatatatggaaggaagcaaagtgaatgggatcaactcgccagttggataattaataatgatttatacagtgaaatgtcgtgtggttaattcagctgccacgactttacaatgtgtataaggaaatggggattgtgacttcatttcaaacattcttgacaacatcttcattccattatttgaggccacggtggatccagattcacatccgcagttgcatgtattcttgaaacaggttgttggtttggatttggttgatgatgagagcaagcctgaacgacgccctaccaagcacatgccaacacctgctcagtggacgaatgttttaatcctgcattctcatactatgtctattactgctatgccaatctctatacactaaacaagcttcgtgaatcaaagggcatgaccactataaatcttcgtccacattctggagaggctggtgatattgaccaccttgctacaactttcctaactgctcatagcattgcacatggaatcaatttgaggaagtctccagttcttcagtacttatattatctagcacaggttggtcttgctatgtctccccttagcaacaactccctgttttggactatcatcggaatccatttcccgtattcttttctcgtggtctaaatgtctctctttctactgatgatcctcttcaaatccacctaacaaaagaacctctggtggaagaatatagcatagctgcttcggtctggaagctgagttcatgtgatctatgtgaaatagctcgcaattctgtctaccaatcaggtttctctcatgctctgaaggcgcattggattggaaaagaatattacaagagaggaccagcaggaaatgatattcacagaacaaatgtgccacacatcagggtggaattccgtgacacgatctggagagaggaaatgcagctggtttatcttgggaaggccgaccttcctgatgagattgaaaagtgatgagcagtgatgaaacacttaagaccacactggattatttatattcttaggtggtagttcgaaggttcggttatttgggtgtcattcgatcgcctcgacgaaggagctggattttgattcatgttgttgcacccggacgaagaaatttgaagcgggggagaaggagagtatatacaaaaagtgcaaatggtagctgagggtctgtctagccgaagctttgatgtgggcatagtttaacgttggtagtatgagaaatacttcttattgggataagatcggcactttagatcccaaagacaatctactaagtatatggatatatggataatatatagatacatatttctatacgtagcctaaataatcataatgttgggaaataataagaggacatcaaaataaagatatactgcttccccatggttctaaggggaaagcttccctcattggattcttagtcttataatttatggctttcctcgtgttgctgcggcaataatatgatggtttgttatgatgttcgttcaaaactgacatcatatcttgcacgtgtatcttatggaatcttattggattgaaatgatgcctactgtcaactgacatta

SEQ ID NO: 3315 - DNA, 1631 bp, Lactuca sativa
gtacgtaaagttgacactcatgttcatcactctgcatgcatgaatcaaaagcatctgttgagattcataaagtccaagttaagaaaggaaccaaatgaggttgtaatatttcgtgatgggacatatctgaccttaaaagaggtttttgagagcttggatttaactggatatgacctgaatgttgatctattagatgtgcatgcagacaagagcacattccatcgttttgataaattcaatctgaaatacaacccctgtggtcaaagtaggcttcgggagattttcttgaaacaggacaatctaattcagggtcgtttccttgctgaggtaacaagccaagtgtttgcagatcttgaagctagtaaatatcaaatggctgaatacagaatatcaatatatggaagaaagcaaagtgagtgggacaatttggcgagttggattgtaaacaatgagttatacagtgagaatgttgtctggttgattcagctaccccggctttacaacatatacaaagaaatgggtattgtgacatcatttcagacaattctggataatgtcttccttccactctttgaggttacaatcgatccagattcacatccccagttgcatgttttcttgaaacaggtggtgggattggatttggtggatgatgagagcaagcctgaaagacgccctataaaacacatgccaacactcttccccttgttaaaaacatcttcaatcctgcattctcatactatgtctattattgttatgccaatctttataccctaaataagcttcgcgaatcaaagggcatgacaactattagattccgtcctcattgcggggaggcgggtgacattgaccacttagctgcctcatttcttacaactcacaacattgcacatggaattaatctcagaaaatctcctgtccttcaatatctatactaccttgctcagattgggcttgcaatgtctcctttaagcaacaactcgttatttctggattaccatcggaatccttttccgatgttttttctcagagggcttaatgtttccctatctactgatgaccccttacaaatccatctcacaaaggagcccttggtggaggaatacagtattgctgcttctgtctggaagttgagttcatgtgatctttgtgagatagcacgtaattccgtttaccaatcaggtttctcccatgttctcaagtctcattggattgggcaagagtactacaagagagggccagatggaaatgatattcacaagacgaatgtaccacacatccgacttgaattccgagatgtgatatggagagaggagatgcaacaggtatatttggggaaggccaatttccctgcatacatcgagacctaacctacccacccccaccctccctttgttcatacaatcttgccctaaactaaagtctgcagttcctgttgatggcgtgtggttgggagcagaaaagaggcttttgcttggtaaagccaagaattttcatgaaaagcttctgaataattgagcttttaataattattattatatagcaataggttttttagtatctttaacataagatatgtgaacaccaaggaatacttgaataaaagtatttatcattgtattatttattcg

SEQ ID NO: 3316 - DNA, 3039 bp, Distylium racemosum
taagaacccagaacctctgaagaagactatacccgccacttttacaactatacgcaaaaattattctccagcgaataataccattgctgccagtgtatatataaatgtttaggcgctgttagctaacactaccagtaaatcaattaaaaagaaagaaagaaatagagagatttgtgcgggtttgagatggatttcggcacttctcaggctctgcatttggtgatggcagccctggtaggggctaccgtggtggcggcgtccgcttactacatgcacaagcggacccttgatcagctcctcgaataccgacggcggattgacggagaagagacggaggaggaggagggagaaggcgagcccgcgcgcggaaagaggcgacggcgtcagaacggccggaaattgggccgggaagccgctcgttacagccggttttccagctcaatgccggacttcgcgacggtcgagggcgggggcttggagtactattatggcaacggtgaaaacaacaacaacgaggatgaggtgaatcggtacaaaaaatggagcaattatagcattaacgaggcggagaatgagaggcggggttcgtacgggaatttgaccatgattccgtcggggcttccgagtcttgagacgcggcgtgacggaagtcgacaatctctcaatcaattagcctctacaaaaagagtaccggtgttaactccaaaatcaccaaatgtcacaaatggtggtgcatttgagagcatggagggatctgatgaagaagatgagacccatgacaatcagggagaacagaattatgcctatgaagatggagatactgtaacagaaaatttgacagctatacctgaagacggtaaaccggtgtcttcctctggtcttgatcatgctggtatgaatggggaacaaaaccaaatgactgcatcgagcataatgagatctcacagtgtttctggagatctacatggtgtacatgcaacagatccagttgctgcaaatattctgagaaaggaaccagagcaggagacatttgtacgcttaaacattacgcccattgaggcaccatctactgaagaggaggaggtctgttgcatgttgcaagagtgtcttgagatgcgtgataagtatgtctttcgagaaaaggttgccccgtggaagaaggaaattataacagatcctagcactccaaggccaaaccccgacccatttctttatgaatctgaggaaaaaacagaacatcattttaggatggaggatggtgtggtccaagtctatgctaataaagatgcaacagaaccccttttcccagttcctgatgctacaaaatttttcaccgacttgcatcgcattcttaaaatcattgctgtgggaaatgttcgtactctctgtcaccatcgactacgtttattagagcagaaattcagtcttcatctaatgcttaatgcagatagggagtttctagcccaaaaaagtgccccccatcgtgatttctacaatgtcagaaaagtagatactcatgttcatcactcgtcatgtatgaatcagaaacatcttttacggtttattaagtctaagctgaggaaagaacctgatgaagtagttatctatcgtgatggcatatatctgacattaaaggaggtttttgagagcctggatttgacaggttatgatcttaatgttgatctactagatgtacatgcagacaagaacacttttcatcgatttgataagttcaatcttaagtacaacccttgtggacaaagcaggctaagagagatctttctaaagcaggataatcttattcaaggccgtttccttgctgagattacaaagcaagttttttctgatcttgctgcaagtaaataccagatggcagaatacagaatatcaatttatggaagaaaacaaagtgagtgggaccaaatggcaagctggatagtcaacaatgagttgtacagtgaaaatgttgtttggttgattcagttgcctcggttatataatgtgtacaaggatatgggcattgtcatgacctttcaaaatatgttggacaatattttcattccattgtttgaggtcacagttgatccaaattcacatcctcaactgcatgtcttcttgaaacaggttgtagggtttgatatggttgatgatgaaagcaaaccagagagacgtccaacaaagcacatgccaactccagaacagtggaacaatgttttcaatccagcctactcctactatgcttactattgctatgcaaatttatatgtacttaacaagcttcgtgaatccaagggatattcgatattaaaatttcgtccccattgtggcgaggctggtgatattgatcacttggcagccactttccttttggctcacaacattgctcatggaaataatttaaggaaatctcctgcactgcagtatttgtactatctatcacaaattggtttggccatgtctcctttgagtaacaattcactcttcttggattatcatcgaaatccgttccctatgttttttgcacgtggactcaatgtttctctttctacagatgatcctttacaaattcatttaacaaaagagcctcttgtagaagagtacagcattgcagcctcagtgtggaagctgagtgcttgtgacctttgtgaaattgctcgtaattctgtgtaccagtctggattttctcatgctctaaagtcgcattggattgggagaaattattacaagagaggtccagcaggaaatgatatacataggacgaatgtacctcatatgcgagttgagtttcgtgatgaggtctggaaagaggagatgcaatatctatatcttggtagtgctccaataccaaaggaggtggtgccgtaacagactaacttgcacgtatatacatcacggaggggtccaagaacctcatttcgtaagtaaatagttgtaacgtagaaggttcagagaataattaggagttagctcttgaaatctataacatgccctatatttctcaataggggatggttggaagtaaaatgtttttataatagg

SEQ ID NO: 3317 - DNA, 1882 bp, Raphanus sativus
  misc_feature (101)..(101): n is a, c, g, or t
  misc_feature (107)..(107): n is a, c, g, or t
  misc_feature (113)..(113): n is a, c, g, or t
  misc_feature (122)..(122): n is a, c, g, or t
  misc_feature (134)..(134): n is a, c, g, or t
  misc_feature (143)..(143): n is a, c, g, or t
  misc_feature (152)..(152): n is a, c, g, or t
  misc_feature (167)..(167): n is a, c, g, or t
  misc_feature (701)..(701): n is a, c, g, or t
  misc_feature (743)..(743): n is a, c, g, or t
  misc_feature (835)..(835): n is a, c, g, or t
  misc_feature (867)..(867): n is a, c, g, or t
  misc_feature (888)..(888): n is a, c, g, or t
  misc_feature (903)..(903): n is a, c, g, or t
  misc_feature (936)..(936): n is a, c, g, or t
  misc_feature (954)..(954): n is a, c, g, or t
  misc_feature (972)..(972): n is a, c, g, or t
  misc_feature (1062)..(1062): n is a, c, g, or t
  misc_feature (1104)..(1104): n is a, c, g, or t
  misc_feature (1146)..(1146): n is a, c, g, or t
  misc_feature (1281)..(1281): n is a, c, g, or t
  misc_feature (1284)..(1284): n is a, c, g, or t
  misc_feature (1745)..(1745): n is a, c, g, or t
gaaataaagatgcaaaagaagagctcttccctgtagctgatgccacagcgtttttcactgatttgcatcacgtactcaaagtcatagctgctggaaacatnaggacnttgtgncaccgtcgnctagtgctcctngaacagaantttaatctncatttgatgcttaangcggataaagaatttctcgcccaaaaaagtgcaccacaccgtgatttttataacgtgaggaaagtggatactcatgttcatcattcagcttgcatgaaccagaaacacctcttgaggtttatcaagtcaaagctccggaaagaacctgatgaggttgtcatcttccgggatggaacatatttaaccttgaaagaagtctttgagagcttggatctaactggatatgacctgaacgtggaccttatggatgttcatgcagacaagagcacattccatcgctttgataagttcaacctcaagtacaatccctgtggtcaaagtaggcttagggaaattttccttaaacaggataatctcatccaaggtcgttttcttggtgagataacaaaacaagttttctccgaccttgaagctagcaaatatcagatggctgaatacagaatatctatatacggtagaaaaatgagcgagtgggaccaactggctagttggattgtgaacaatgatctatacagtgagaacgttgtctggttnattcagctcccacgcctgtacaacatttacaaggacatgggnattgtgacatcgttccagaatatcctcgacaatatattcattcctctgtttgaagccacggtagatcccgattcgcaccccagctccatgtntttctgaagcagttgttggatttgatttggtngatgatgaaagcaaacctganagacgtcccacaaancacatgcccactccagctcaatggactaacgcntttaatcctgcattctcntactatgtctactactgntacgctaacctctatgtgctaaacaagcttcgggagtctaagggcatgacaaccatcacactacggccacattctggggaggctggtganattgaccacttggctgctacatttctcacatgtcatagcatngctcacggaatcaatctacgaaagtctcctgtgcttcagtanctctactacctcgcccagattggtctggccatgtctccactgagcaacaactctctgtttctagattaccaccgaaacccgtttcctgtgtttttcttaagaggtctcaatgtttccctgtccacggatgatccnctncagattcacttaactaaagaacctctcgtggaagagtacagcattgctgcctcggtgtggaagctgagttcgtgtgacctgtgcgagatagctcgtaactcagtgtaccagtcaggtttctcacatgccctgaagtcgcactggattggaaaagactactacaaaagaggacctgatggaaacgacattcacaaaacaaatgtacctcacataagggtggagttccgtgacacgatctggaaagaggagatgcaacaggtttatttgggaaaggctgttatctcagatgaagttgttccataagaaacagaaatgagaaatggcaacgtgggaagggggtttatacaccaagggagacgtcttcagaagtatacgatgcaggaagtagatagggtaataaataaagtgagagtggctatgttgtgcccttatgaaggctgctgccaaatctattgtttctntgaatcgtaatttcttttttttctagagctgacttaaaagagctgcaaacgacattgagaactgttttttttctatatataaagagaccataagagttatactatcatttaattctagttgagttttgattaagaca

SEQ ID NO: 3318 - DNA, 1464 bp, Conyza canadensis
aaattttcttgaagcaagataaccttatccagggtcgctttcttgctgagttgacgcaacaagtatttaccgatcttgaagcaagtaaatatcaaatggctgaatatagaatatccatatacgggaggaagcaaagtgagtgggacaatttggcgagttggattgtgaataatgaactatacagtgagaatgttgtatggctgattcagttgcctcgactttataatatatacaagggaatgggtatcgtctcatcatttcagaccattcttgacaatatattccttcctctctttgaagttaccatcgacccgggatcgcatcctcagttgcatgttttcttaaaacaggttgtaggattagatttagttgatgatgagagcaagcccgaaagacgccctacaaagcacatgccaacaccagaacagtggaacaacgtacataaccctgccttcgcatactatgtatactattgctatgccaacctctataccctaaacaagctccgcgaatcaaaaggaatgaataccatcagattccggcctcattgcggagaggctggtgacattgaccatctcgctgcttcatttcttacaactcatagcatctcacatgggatcaacctgagaaagtctcccgtacttcaatacttatactacctttcccagattggtcttgctatgtctcctttgagcaacaactccttatttcttgattatcaccggaaccctttcccaattttttttgctcgaggtcttaatgtttccctatcaactgatgaccctttacaaatccatctaacgaaggagccactggtggaggagtacagcattgctgcttctgtatggaaattaagttcctgtgatctctgtgagattgcccgtaattctgtataccaatcaggtttctcacatgctcaaaagtcccattggattggtcaggagtactacaagacaggaccggacggaaatgatatacgcaagacaaatgtgccacgtatccgactagaatttcgtgatatggtttggaaagaggagatgcagcaggtttacttagggaagccatatattcctgaacacatcgagtcttagcttcattcatgtgatgccgccattttgtgggtttcgggccattggcagctagtttttggataatgtcactgctgaaacttgcatgcccctaaagtttaatagctgtgttgtccacaccgatgttcagtgaaagctttaggtcaacctgggttcccccatgtaggtgtcgattataagaagtcgtcatgaccagagttgagtctgttgacaggcagaactgaaaatgtgtatttcaagatatttaatgaattcttagtagtgcattatttatacacaatgaacatgttcagcatgcatgctggcattctgttatcattttacatgcttctaaatgctcgaattacaaataaatcacttcctattagaatattca

SEQ ID NO: 3319 - DNA, 2089 bp, Vinca minor
atatctgacccgagcacgccaaagcctaaccccaatccatttgattttttttcagagggaaaatctgatcatcactttcagatggaagatggtgttgttcaaatctatgcaaataaagactctaaggagaaactttttcctgttgctgatgcaacaacatttttcactgacctgcatcacatcctcaaagttattgctgctgggaacatccggacactgtgtcatcatcgtctagttcttctggaacaaaaattcaatcttcatttaatgctcaatgcggataaggagttccttgcccagaaaagtgcaccacatcgtgacttctataatgttcggaaagttgatacccatgttcatcattcagcatgcatgaaccaaaagcatcttctgaggtttataaagtccaagttgaggaaagaacctgatgaggtggttatatttcgagatggaacctatttgacactaaaagaggtttttgagagcttggacttaactggatatgatctgaatgtcgacctgctggacgttcatgctgacaagagtactttccatcgttttgacaagtttaatctcaagtacaatccgtgtggtcaaagtaggctgagagaaattttcttgaagcaggataatctgatacagggtcgtttccttggcgagctgacaaagcaagtcttttccgatcttgcggcaagtaaataccagatggctgaatacagggtgtcaatatatggcagaaagcagagtgaatgggaccaactggctagttggataataaataatgatctgtacagtgaaaatgttgtctggttgattcagcttccaaggctctacaatatctacatggaaatgggaatcgtgacatctttccaaaacattcttgataatgttttcattcctttgtttgaggctactgttgatccagattcacatcctcagctgcacgttttcctgaaacaggttgtaggttttgatttggtagatgatgaaagcaagcctgaaagacggccaacaaagcacatgccaacacctgctcaatggaccaacatattcaatcctgcattctcatattatgcttactactgttatgccaacctctacactctaaataagctccgtgaatcaaaaggtatgacaactatcaaattccgtccacattctggagaggctggtgatattgaccaccttgctgcgacatttctgactgctcataatattgcacatggaatcaacttgagaaaatcccctgtacttcaatatttgtactacctggcacagattggtctggcaatgtcacctttgagcaacaactctttatttttagactaccatcggaatccctttccgatgtttttcctccgcggtctcaatgtttcactttctactgatgatccattgcaaatccacttgaccaaagagccccttgtggaagagtacagcatagctgcttctgtatggaagttgagttcatgcgacctatgtgagattgctcgcaattcagtctatcaatctggtttctcgcatgcattgaagtcgcactgggttggtaaggcatacaacatgagaggaccagatgggaatgatattcgcaagaccaacgttcctcatatccggcttgaattccgtgatacgatttggcgagaagagatgcaacaagtttatttgggcaaggccagcttccctcaatttgttgacccgtaatctggttggcacattgatttttgcaggcttgtatattctctctaccctggagatcagtagcggagcattctacctgttttcacttgcgcaaagacagacatctgatctgcatatccggacaggatattagctcagcataagcttacagctaatagcttgaatgaagcatagtgttcagatcaccgaggtaaaatctgaatgaataagatctccagcgtctcagtaagggtaagacgaaatgtgctgggaaaaagtttgcataccatatggtgttatataggttttatctagtctagaaatgacagctatccctggaattattatcttgtaattatgaacattgtaatccttgttaagcaatagaacggtctcattagttttaaatgtactc

SEQ ID NO: 3320 - DNA, 1285 bp, Cenchrus ciliaris
  misc_feature (661)..(661): n is a, c, g, or t
  misc_feature (678)..(678): n is a, c, g, or t
cttaaaacaggataatcttattcaaggtcgcttccttgctgagctcacaaaagaagtgttttctgaccttgaagcaagtaaatatcagatggctgagtatcggatatctatctatgggaggaagaaaagtgaatgggaccagatggctagttggatagtgaacaatgaattatacagtgagaatgttgtttggttaattcagattcctcggatatacaatatatacagggagatgggcacaatcaattcgttccaaaaccttctcgacaatatttttcttcctctttacgaagtaactattgaccctgcttcacatcctcagctgcatgttttcttagaacaggttgttgggttggatttggtggatgatgaaagcaaaccagaaaggcgcccaacaaaacatatgccaacacctgagcaatggactaatgttttcaacccagcctatgcatattatgtgtactattgttatgccaatctgtacacactgaacaagcttcgtgagtctaagggcatgacaacaatcaaacttcgtccacactgtggggaggctggcgatatcgaccatcttgctgcggcatttcttacttctcataacatagctcatggggttaatctaaggaaatcccctgtccttcagtacctgtattatcttgctcanattggtctcgcaatgtntcctttaagtaacaattcgttgtttattgactatcaccggaaccctttccctacatttttcttgagaggacttaacgtgtctttttcaactgatgacccattacaaattcacctgacaaaggaacctttggttgaagaatacagtatcgctgcttcgctttggaagttgagttcatgtgacttgtgtgaaattgctaggaattttgtgtaccagtccggtttttttcacaggctgaagtttcactggatcgggcggaaataatacagaaggggccccgagggcaatgacatccaccagacaaatgttcctcacatcagggttgaatttcgacacacgatttggaaagaagaaatggaggtaatacatttaagaaatgttaagctaccggaagaaattgacaggtgaagatttagttgcatggttggaaacctttggcaagtgtgtggagcctgcccggggttgcaagggaggagagaaagggggtcggagttgattccgcagagtgggtgaataggaatatgcgatgattatgatagcaccaagcaagcctcgtagcacattgaataagaaagttgaatttgtggttacagtacattatatgttgga

SEQ ID NO: 3321 - DNA, 1770 bp, Pseudotsuga menziesii
ctgttgcgttttatcaaatctaagctgaagaaagaaccagacgaggtggttatcttccgagatggcaaatatctcaccttaaaggaagtttttgagagcttggacttgacaggatatgacctcaatgtagatctcctggatgtacacgcagacaagaatacatttcatcgatttgataagtttaatctaaagtataatccctgtggacagagcagactaagagaaattttcttaaagcaagataatctcattcaaggtcgttttcttgctgagctgacaaaacaagtcttatctgatctggaagcaagtaaataccagatggcagagtataggatatctgtttatggaaggaaacaaagtgaatgggaccagttggcaagctggtttgttaacaatgagatatacagcgaaaatgctatctggttaattcagttccctcgactatacaatgtgtacaagggaatgggaatcgttctatcttttcaaaatattctggataacattttcattcctctttttgaggttacagttgatccaggttctcatcctcaactacacgtcttcttgaaacaggtggttggctttgatatggtagatgatgaaagtaagcccgaaaggcgtcccacaaagcacatgccaaccccggagcagtggacaaatgattttaatcctgctttttcatactatgcttactattgttatgcaaatttgtacacacttaacaagcttcgtgaatctaaaggaatgacaacaattaaatttcgtcctcactgtggcgaggctggtgatattgatcacttggcagctgccttccttttgactcacaatattgcacatggaaataatcttaggaagtctcctgctttgcagtatttatactatctttcccagattggcttggccatgtcccccttgagcaacaactcattatttctggattatcaccgaaatccttttcccatgttttttgcacgtggccttaatgtctccctttcaacagacgatccattacaaatccatttgactaaagagcctcttgtagaggaatacagtgttgctgctcaggtttggaagctcagtgcttgtgatctttgtgaaattgctcgtaattcagtctaccagtctggattctctcatgcttgtaagtctcattgggttggaagaaaatattacatcagagggcctgaagggaatgacatacatagaacgaatgtacctcatatgcgagttgaatttcgccacgaggtctggaaagaagagaggcaatatttataccttggacaggccaaaataccaagagaaagtgatccatagaagtaaacatctctttcatgttatcattagagccaatacatatcgttgtcatatgggtgaaatgcagatatatgtaaactagaagtgttagttaagagaatgactatataatgatgttgcacataccgtagtggaatgctagaactcaaatgcaagattcttggacttgttgctctggtgaacacaaagtatgtgctgatatgtaaccccatggtcaattaatgtggtggttgctttgcttcaataaagtggtgaaaattacacctcttcattatcctttaactaactggagtagtttatatcctgctgctctttgtgtaggcccttcgtaacaaacatttattcctttttgtttcccactcttgtagtttgggtggaaaagagcatttgaaattggcggtcctaaaaatgtctttgcaatctttgaagttgtatctttttccttggtttgcattg

SEQ ID NO: 3322 - DNA, 2120 bp, Triticum aestivum
tgtcaggtcaaatctgtttcaagccttggtggagctggctacagagtctcgcgagaagatggttcagaggaaacatacgacagtgtcatccttggggtccatgcacccaatgctctcaaagtactaggacttgaagctacaaatcgcgaacggagaattctaggtgcttgtcagtatgttcttttggatatataccttcactccgatcaaaatctgatgccccgaaattcgtcagcatggagcgcctggaatttcctggggacaagtagcagggttttttctgttacttactggctaaaccaaattcagaaaattgaatctgtcaggcctttcctggtgacactcaaccccccttgtgttccggatcatgtactgcttaaatggaatacaagccttcctgttccgtctgtggccgcggcgaaggcttatcttcagcttgatcagatccagggaaagaggggaatatggttctgtggggtatataacggtcatggcttccacgaagacggattgaagtccgggaaagcagcagctcaaggtttgcttggaaagaaatgtgatgttctgctgaacccaaagaagatgtctccatcatggactgaggctggggcgcgccttctagttataagatttttcaaccaatacgtatccattggtaacttgatattggtcgaagaaggaggtagtgtgttcagctttggtaaagcttgcgacaaatgctgtgtaaaatctgtcatccaagttcatgaccccttgttctattggaaggttgcaatagaaggaggcatgggcttggcagaagcctatattgatggttgttactctgttcttgacaagagagaaggccttctgaatcttatcctgattctcattgctaacagagacgagcgtaggaaccgccgcattgccagaaaagggttttggttgtcacccttccatgtaatagctcaattggcatatgctaaacactttttgcgcgagacctcaaggaagaacactgcgacacaaactcgtcgaaacatctctcagcactatgatcttagtaatgactttttctcgctttttctggataaatcaatgacttactcttgtgcagttttcaaggataatgaaagcttagaagcagcccagcaacgtaaacttagccttctaatcaacaaggctaaagtcaagagggggcatcatgttcttgatatcggtagcggctggggaagtttggcactagaaacagttaagcaaactggctgcaaatacactggagtcactttgtcggcggagcagcataaatacgctgagagaaaagtaagagaagctggcttagaggaccgcataaattttctgctgtgcgactaccgcaaaataccaccttttaagtatgacgcaatcataagctgcggtatgattgaacatgttggccatggatacatgaacgaattttttgcttgctgtgagtcttacttggctgaagatgggatattggtcctccagttcatctcagttccagaggaacggtatgagcaatacagaaaaaggccagacttcataaaagaatacatattccctggcggttgccttccttctttggcccgtataatgtctgccatgaccacgtcatcaaggttctgcatagagcatgtcgagaatattggacccaattactacacaactctgatgcattggagggacaacttcatggccaacaaagatgaagttttggccctgggctttgatgaaaggttcctccgtatatgggagtactacctcatattctctgcggctggtttcaagtcacgagcatttggagattaccaggttgttttctctcgtccaggcaaccgtcggctaggccagccttgatggctgaagacagcatatccttctccgttcggctgttgaactgttacttctcggtaccctacggccttttaataagtcagtcctggaacggtttgttcataagggcagtccaatcaggtggtttggtgatctatcgtgttgcttaatcattcaatgtttggtttttcgtggcagtatattggtatctgtcaataaacttgtatatgcaatgcaagtgctacattgttagccaggttcctagaatttgagaattgtatgaagtg

SEQ ID NO: 3323 - DNA, 1717 bp, Triticum aestivum
cagatccagggaaagagagaaatatggtcctgtgggagttatcaaggtcatggattccatgaagacggattgatggctgggaaagcagcagcgcaaggtttgcttggaaagaaatgcgagcttctgttgtacccaaagcagatcattccatcatggaccgtggctggggcacgccttgcatttgcaagatttttcatgcaatacatatccatcggtaacttgatattggttgaagcgggaggtagtgtgttcagctttggtaaagcttgcaacaaatgccatgtaaaatctgttgtgcgagttcatgaccccttgttctattggaaggctacaacagaaggagagatcggcttaggagaagcctatattaacggctatttctcttgtcttgacaagagagaaggccttctgaatcttatcctgattctcattgctaacagagacgagcgtaagagccgcggcattgccagaaaaaggcgttggggctcacccttgcatgtaatagctcggttgtcatatgctaaatacgttttgcgccacgcctcaaggaagaacaccgcagcacaaactcgtcgaaacatctctcagcattatgatcttagtaatgatttcttctcgctttttctggataaatcgatgacttactcatgcgcagttttcaagatggagaacgaaagcttagaagcagcccagcaacgtaaactgagccttctaatcgacaaggctaaagttgagagggagcatcatgtccttgatatcggtagcggctggggaagtttagcaatacaagtggttaagcaaactggctgcaaatacactggagttactttgtcggaggagcagcttaaatacgccgagagtaaagtaagagaagctggcctagaggaccacataacttttctgttgtgtgactatcgcctaataccaccttacaagtatgacgctatcataagctgtggaatgatcgaacatgttggccatgaatacatggacgaattttttgcctgctgcgagtcttacttggctgaagatggcatattggtcctccagttcatctcaattgcagaggaacggtacgagcaatacagaagaaggccacacttcgtcaaagaatacatattccctggcggttgcattccttctttggcccgtgtaatgtctgccatgaccacgtcatcaaggttcagcatagagcatgtcgagaatattggacccaactactacacaactctgatgcactggagggacaacttcatggccaacaaagatcaagttttggaactgggctttgatgagaagttcatccgtatatgggagttttacctcatatactctgcggctggtttcaagtcacgagcagttggagattaccaggttgttttctctcgtccaggcaaccgtcggctaggcctgccttgatggctaaaggcaacttatccttctccattaataagtcagccctggaatggttcgctcatacgggcagcctaatcaggtggtttggtaatctatcttcttgttttaatcatgaaatgtttagttttcatggcggtgtattgtctattaataaatttgcgtgtgtatgcaagtgctacatgaacctggttactagaatttgagaattgtatcagaaagagttgatgtccttgattgtagttttcgatcttttccgtgtttgacatttgtgatgttggttatgggagagaatggatgtttc

SEQ ID NO: 3324 - DNA, 2077 bp, Triticum aestivum
caaagtactaggagctgaagctacacatcacgaaaggagaattctaggtgcttgtcagtatgtccacagggatatatacctccactacgatcaaaatttgatgccccgaaattcttcggcatggagcgcctgtaatttcatggggacaactagcagtggtttttctgttacttattggctaaaccatattcagaaaattggacctgtcaggactttcctggtgactctcaatcctcctcgtgttccggataatgtactgcttaaatggtctacaagccttcctgttccgtctgtagctgcggcgaaggcttatcttcagcttgatcagatccagggaaagagaggaatatggttctgtggggcatatcaaggtcacggcttccatgaagacggattgaaggctgggaaagcagtagctcaaggtttgcttggaaagaaatgtgagcttctgctgaatccaaagcagatgattccatcatggactgaggctggggcgcgccttctagttgcaagttttttcaacctatacatatccatcggcaatttgatattggtcgaagaaggaggtagtgtgttcagctttggtaaagcttgcgacaaatgccatgtaaaatctgtaatgcgagttcatgaccccttgttctattggaagattgcaacagaaggaaaccttggcttggcagaagcctatattaacggctgtttctcttttctcgacaagagagaaggccttctgaatcttatcctgattctcattgctaacagagatgaccgtaggaaccgccgcattgccagaaaagggggtcgatggacaccattgcatgtattaggtcggttggcacatgctaagtactttttgggcaaattctcgaggaagaacactgtgacacgaagtcgccgaaatgtctctcagcactatgatcttagtaacgagtttttctcgctttttatggataaatcgatgacttactcttgtgcaatttttaagatggagaacgaaagcttagaagcagcccaggaacgtaaacttagacttctaatcaacaaggctaaagtcgagagggggcatcatgttcttgatatcggtttcggctggggaagtttggcaatacaagtggttaagcaaactggctgcaaatacaccggagtcactttgtcggaggagcagcttaaatacgcccagggaaaagcaagagaagctggcttagaggaccacataacttttctgctgtgtgactaccgtcacataccaccttacaagtatgacgcaatcataagcatctgtatgattgaacatgttggccatgaatgcatggacgaattttttgcctgctgcgagtcttacttagctgaagatggcataatggccctgcagttcatctcagctccagaggaacggtacgaacaatacagaaaaaggccagacttcctaacagaatacatatttcctggtggttgccttccttctttggcccgtgtagtgtctgccatgagcacatcatcaaggttcagcatagagcatgtcgagaatattgggcccaattactacccaactctgatgtgctggatggacaacttcactgccaacaaagataaaatgttggccctgggctttgatgagaagttcatccgcatatgggagtactacctcatattctctgcagcttgtatgaagtcacggacacttggagtttaccaggttgttttctctcgcccaggcaaccgtcggctaggccagcctttggctaaagcctaaaggcaacatatccttgtccgttcagttgtcgaactgttacttctcgataacctacgaccttttagtaagtcagccccggaatggttcgttcatacgggcagcctaatcaggtggtttgagatctatctctctgttttaatcgtgaaatggttagtttttcatggcagggtattatctatcaataaacttgtatgtgtgcatgcaagtgctaccttagactggtcagtagaatttgagaattgtatggaaggaactggtttgttgctttgatatctatcaaaatgagatgatgtcctggtttgttatttttttatctattcc

SEQ ID NO: 3325 - DNA, 1414 bp, Triticum aestivum
gttcagctttggtaaagcttgcgacaaatgccgtgtaaaatctgtaatgcgagttcatgaccccttgttctattggaagattgcaacagaaggaaaccttggcttggcagaagcctatattaacggctgtttctcttttctcgacaagagagaaggccttctgaatcttatcctgattctcattgctaacagagatgaccgtaggaaccgccgcattgccagaaaagggggtcgatggacaccattgcatgtattaggtcggttggcacatgctaagtactttttgggcaaattctcgaggaagaacactgtgacacgaagtcgccgaaatgtctctcagcactatgatcttagtaacgagtttttctcgctttttatggataaatcgatgacttactcttgtgcaatttttaagatggagaacgaaagcttagaagcagcccaggaacgtaaacttagacttctaatcaacaaggctaaagtcgagagggggcatcatgttcttgatatcggtttcggctggggaagtttggcaatacaagtggttaagcaaactggctgcaaatacaccggagtcactttgtcggaggagcagcttaaatacgcccagggaaaagcaagagaagctggcttagaggaccacataacttttctgctgtgtgactaccgtcacataccaccttacaagtatgacgcaatcataagcatctgtatgattgaacatgttggccatgaatgcatggatgaattttttgcctgctgcgagtcttacttagctgaagatggcataatggccctgcagttcatctcagctccagaggaacggtacgaacaatacagaaaaaggccagacttcctaacagaatacatatttcctggtggttgccttccttctttggcccgtgtagtgtctgccatgagcacatcatcaaggttctgcatagagcatgtcgagaatattgggcccaattactacccaactctgatgtgctggatggacaacttcactgccaacaaagataagatgttggccctgggctttgatgagaagttcatccgtatatgggagtactacctcatattctctgcggcttgtatgaagtcacggacacttggagtttaccaggttgttttctctcgcccaggcaaccgtcggctaggccagcctttggctaaagcctaaaggcaacatatccttgtccgttcagttcttgaactgttactcacttactcctcgatagcctatgaccttttaataagtcagccctggaatggttcgttcatacgggcagcctaatcaggcggtttgtggatctatcttgttgttttaaacatggaatgttattttcatggcagtgtgttatctataaataaacttctatgtgtgtatgcaagtgctaccttatactggtca

SEQ ID NO: 3326 - DNA, 1324 bp, Triticum aestivum
gacactcctcctcgactcctcccttacccgcccgccgccggcgcccgcaacctctcccggacgtgcccctgctgaggatctgcaccgccggcgagctcctggcgccgcgagaggtgcatatttggtatctttgtcccgatgagctgaaaaatcagtcccaactgaacatgtatgaagaactcctgtctccttctgaaagagagtatgctgactctatgaaagcaacaatgttgcggaaagatgctgttttgtcccgtgcattgttgcgcaccaccctctcaagatatacaggttataaaattgatccgaggtcatttgagtttaagaagaacaaatttggcaaacctgaggtattgtggccacatgatgatagcactgcagagcaacctttgcatttcaacatttcacacacaacttctttgattgcctgtggtattgccattaatgctcgtattggcattgatattgaagagaagaagcgaaatacaaccaagaatatttcatctcttgctcgccgttacttcaccccttctgaagttaattatctatctgaggtttcagattcagatgctcagcgaaaggaattcctgaaactatggactcttaaagaagcatatgtaaaagctcttggaatgggtttctcaggtgctccattcagtacgttttcaatcatgctgaatacaagtaagggaattcggatttctaaggcattgaatgattccaggactggctgtgaccatctgtctgagaactggctgtttacactcgcggagctaaatagttctcactacatgtcagtttgtatagaggacagctccagaagtcaaggccctgaagacagcccagcaccagtaggattgaaagtatggaagaccataccatttgtcgaagatacactcgtctctggaacagaagctgtaaaacttattgcctgactaccgaaacatcgttgtgaaatacacttggtccagtaccgataggttttggtctctgcccactgaaacatcatttttcctgtgtgttggctctcttctgttggtggaaacattgttggtctgagctgccattcaatggctgttactacattaccatatgtgtcttcagagtttgtttgctcacaacatttttttttatcggagacgaatcttgcgatttgaagctgttggagaagggcttcagagaagcatattggtcgaaaggcctgtatttgcatttttagggcgagtgattgctccatctagtttgttctatacctaaacagagttgccctgttttaagagaaagagttgctcaatttttatcaggaaaaaaaaaaaaaaaacga

SEQ ID NO: 3327 - DNA, 653 bp, Triticum aestivum
ggttttaatatgctgaatacaagtaagggaattcggatttctaaggcattgaatgattccaggactggctgtgaccatctgtctgagaactggctgtttacactcgcggagctaaatagttctcactacatgtcagtttgtatagaggacagctccagaagtcaaggccctgaagacagcccagcaccagtaggattgaaagtatggaagaccataccatttgtcgaagatacactcgtctctggaacagaagctgtaaaacttattgcctgactaccgaaacatcgttgtgaaatacacttggtccagtaccgataggttttggtctctgcccactgaaacatcatttttcctgtgtgttggctctcttctgttggtggaaacattgttggtctgagctgccattcaatggctgttactacattaccatatgtgtcttcagagtttgtttgctcacaacatttttttttatcggagacgaatcttgcgatttgaagctgttggagaagggcttcagagaagcatattggtcgaaaggcctgtatttgcatttttagggcgagtgattgctccatctagtttgttctatacctaaacagagttgccctgttttaagagaaagagttgctcaatttttatcaggaaaaaaaaaa

SEQ ID NO: 3328 - DNA, 1471 bp, Avena sativa
gagcagcgagacgagcatgcgaggagatcatgtacgggacctcctcgccggcgagaagaagctgatgacggtggcccgcacggcgcggcgtcgccggctggagctccgggggctcggccggacggcgtccgcggcggcggaggacgaggccgcgaagagggtgcgggctgcgccggacagctcctctgactcgtgtgactcgtcggcgagggtggcgccggacaacgccgtggtcgtggctaggtgtccgacgtgcgtgtcgtacggtgcggtgtcggtgatcgggcgccggagggagatggaggacgcggtggccgtggccccgtgcttcttggccgagaaggcggtcgtggagggcggcagcagcggcgacgccgagcacgtagacggggaagaagagggcttcttcgcggtgtacgacgggcacggcgggtcccgcgtggcggaagcgtgcagggagcggatgcacgtggtgctcgcggaggaggtgcggcttcgtcgtcgcggggacgacaaagcaggaccgaggacggcgaggacagcgcgcggtggaaggaggccatgacggcctgcttcgcacgggtggacggcgaggtcggcgtggacgacgagacagacactggcgagcagacggtggggtccaccgccgtcctggccgtggtgggccccgccgcatcgtcgtggcgaactgcggcgactcccgcgccgtgctctcccggggcggcgtcccgtgccgctctcctccgaccacaagccagaccgtcctgacgagctggaaagagtagaagcagctggtggcagggtcattaactggaatggataccgtatcctgggagtgcttgcgacttccaggtctatcggagactattatctgaaaccatatgtgatagcagaaccagaggttacagtcatggaccggacagacaaagacgagttccttatactggcaagcgacggtctgtgggacgtcgtgtccaacgacgttgcctgcaagatcgcgaggaactgcctaagtgggcgtgcggcttccaaatacccggagtccgtctccgggagcacggcgaccgacgccgcggcgctgcttgtcgagctcgccatctcgcgcggcagcaaggacaacatcagcgtcgtcgtggtcgagttgcgacgactgaagagtagaaccgcagcggtgatcaaagagaaccgcacgtagggctagtagtaacttaggcgtggccggctgtcacagtattcgaccatggcgacaggaacaaaagaaagaaagataggggtttcagctgagttcgcggggatggtatagtttaaaacggctcagggacgttgtgactgctgttgagttgagtgcgctatttgtagccgtgcgcccgtgccgttgtattgcgttgccttggttctttagttcttctatatgctgacgttcaggacgaagcagcagcagcaggaagcataagcttctttcgttggttct

SEQ ID NO: 3329 - DNA, 3731 bp, Triticum aestivum
cagatgagttcgaagaaggttccgttcaatcggcataaggagaacgaggaggcaaggaagaagagggaggaagatgaagcggcgcgtgtgtacgcggagtttgtcaagtcattcgagggtgaaagcgcatctgggtcaaagtttgtccgagggggtgttatcgaccccaatgccaagctgagagctgattctgaaggtggaaattccaaagatagggggtctgttccaaagaagggcagtaggtatgttccatcttttgtgccaccctcatttgggagagaaccagagaaaaagaaggaagatgagcggccaaaggaaaaggaaaaaggaaagccacgggcaatagacactgtcatggaggaattgaagctggagaaagagcttcgagaaaggcgtaatcaagaacgtgccagtcgacatggtgacacctccatgccctctagccgttttgatgaactaccagatgaatttgatcccactgggagaataccaggatcatttgatgacggagatccacaaaccacaaacttatatgttggcaatctctctcctaaggtggatgagaattttcttctgaggacatttggtcggtttggacctatcgcaagcgtcaagatcatgtggcctcgaacagaagaagaacgcaaaaggcaaagaaattgtgggtttgttgcattcatgaatagagcagaaggacaggcagccaaggatgaaatgcaaggtgttgttgtgtatgactatgagctgaagattgggtggggaaaatctgttgctcttccatcacaagcactacctgctcctcctccaggggcacatggctatcagaaacaaggagggtggtactgtcatcatatctggtcctggaggtccacctgttgcatctgttacacagcaaacctcagagctggtgcttactccaaatgttcctgatataatggttgctccgccagatgattcacatcttcggcatgtgattgatacaatggccctgcatgtacttgatggcggatgtgcttttgaacaagctataatggaacgaggacgaggaaaagcattatttaacttcttgtttgatcttaaatctaaagaacacacatactatgtttggcggttatactcattcgctcagggcgatactttacaacgatggcgaacagaaccatttatcatgattacaggaagtggaagatgggttccacctgctttgccatccagccgaagtcctgatcgtgaaaaagaatctacttttgcagctggtagaaccaggcgtgttgaagtggagcgcacattgaccgagacacaacgtgatgaatttgaggacatgctgcgtgcattgacattagagagaagtcagataagggaggctatgggatttgcattggataatgctgatgctgctggagagattgtcgaggttcttgcagaatctttgacactcaaggagacacctatcccaactaaggttgcacggcttatgctagtgtccgacatccttcataacagtagtgctcctgtgaagaatgcctctgcatttcgaaccaagtttgaggctgctatacctgatgtcatggagagcttcaatgacttgtattgcagtatcacaggaaggattactgctgaagctctgaaggagagggttttgaaagttctacaagtatgggcagactggttcctgttttctgatgcatatctgaatgggctaaaagctacctttcttagaccaggcaactctggggtcaccccgttccactctctatgtggtgatgcaccagaaattgaaaagaaaactagctccgaggataataatggatttaggcttgatgaagatgtgccctggccacaggaaaggcagcagcacgaaagagctgttaaggcttccacttgctgaacttgaacgtcgttgtagacataatggcctctcactatgtggtgggaaagagatgatggttgccagattgctcagcctggaagaggctgagaaggagcaagtatatcagaaagacgtcgacatgaaatatggacaaggagaaccgcatagagctggaagagaggatattggtttgaatgcgcatggtgcttcgagacctgcagaaggtactgttgatgatgaatcagatatgctgggtctctctcgtcacacaggtcaaaaatactatggaaaatctgcatctgctgaaccgaaacaagttccaagcaagaagcagagagctgatcccatcttaccagcttctaaatggaatcgagaggatgatggcagcggcgatgaagatagaaaagatggtcaaggattgggattgagctattcatctggaagtgatattgctggtgatcccgggaaagctgatgcaacagaaattagtactgatcacgcaattcatcatccagatacaattgttgatgaagagcataggcagaagctgaggcagattgagatcggtgtcatgcagtatcgtgaatctcttgaggagaagggtttgtggaacatggaggagcttgagaggaaggttgccagccaccgtaggcgtcttcagtctgaatatgggttgtcttcttctgtagatggggcaaacaacaggcgctcttccgagagaataccatcggaccggaaaggaaggtatgatgatgcacgcgattcttccaagaagcggcctcacagcccaagtaggagccatagtccttcaaagaaattatcactggatagagaccgagagcacaatcgcagcagagacagattgcatggtaatgatgtcgggagagacagggcacgcgagaaaagttcaggccgagagaaggatgatcaccatgatagaagcagagaaagagaaaaggacaggagaaaggggaggtgactgagggtatgtttggttccagccctaccaaatatttggctagccaaaattttggttgaccttttggttgcccatgagttggtcaacatcggcaaggaaaacgagctagagtaaccaaaaaggcgttggcatgccaaatactcctagttggcaaccatgcaaacaaagcccagtgttttggacatgaccaaatattggtagggtaagtttagctgccataacatacatacataccctgatacttgtagatctcgcacttgtccttgggctgaataagtgtcttgagaaaggaaatatttgagctgggctgcatccgccaatacccgccgcatgtaaatgggtgcgcatggcctgctcaaggacctgcttgtagcggatttgaggatttaggctgtggtcctaatggcggacctgtttttgtagtatcaaggaacagtagtttgtgaaacataagtactttgatcaagcaacactgaatgaaatgctgtcagttcgtggcatgggctgctactaataaactttgacaagttgctatggatttgctctggcaatcttgttgtttaacccctgtaggattcagcttagaattagcatggtgctactgctgcctcaactcctccatttgacatttcggttaatctggatgaagggcccggcatggcaggttgtttaacttgctggtgcattcttctgcgcatggttaattggctgtattgtttgtggatgcttcattttcgagctcgtttcttttttaggctgattttattttttcaggctggagctcatttctttgaaccttatttgtggatgctgtaaattcaggcgagcgtagttctctgtaccgcatctgactgaatcattataaaaaaaaaaaaaaaacga

SEQ ID NO: 3330 - DNA, 2472 bp, Triticum aestivum
  misc_feature (111)..(111): n is a, c, g, or t
  misc_feature (160)..(160): n is a, c, g, or t
  misc_feature (398)..(398): n is a, c, g, or t
  misc_feature (652)..(652): n is a, c, g, or t
  misc_feature (654)..(654): n is a, c, g, or t
  misc_feature (656)..(656): n is a, c, g, or t
  misc_feature (774)..(774): n is a, c, g, or t
  misc_feature (783)..(784): n is a, c, g, or t
  misc_feature (786)..(786): n is a, c, g, or t
  misc_feature (792)..(792): n is a, c, g, or t
  misc_feature (801)..(801): n is a, c, g, or t
  misc_feature (819)..(819): n is a, c, g, or t
  misc_feature (837)..(837): n is a, c, g, or t
  misc_feature (866)..(866): n is a, c, g, or t
  misc_feature (876)..(876): n is a, c, g, or t
  misc_feature (881)..(881): n is a, c, g, or t
  misc_feature (898)..(898): n is a, c, g, or t
cccacgcgtccgtgtttggcggttatactcattcgctcagggcgatactttacaacgatggcgaacagaaccatttatcatgattacaggaagtggaagatgggttccacnctgctttgccatccagccgaagtcctgatcgtgaaaaagaatctacttntgcagctggtagaaccaggcgtgtcgaagtggagcgcacattgactgagacacaacgtgatgaatttgaggacatgttgcgtgcattgacattagagagaagtcagataagggcagctatgggatttgcattggataatgctgatgctgctggagagattgtcgaggttcttgcagaatctttgacactcaaggagacacctatcccaactaaggttgcacggcttatgctagtgtcngacatccttcataacagtagtgctcctgtgaagaatgcctctgcatttcgaaccaagtttgaggctgctatacctgatgtcatggagagcttcaatgacttgtattgcagtatcacaggaaggattactgctgaagctctgaaggagagggttttgaaagttctacaagtatgggcagactggttcctgttttctgatgcatatctgaatgggctaaaagctacctttcttagaccaggcaactctggggtcancncnttccactctctatgtggtgatgcaccagaaattgaaaagaaaactagctccgaggataataatgggtttaggcttgatgaagatgtgccctggccacaggaaaggcagcagcacgaangagctgttnngncttccncttgctgancttgaacgtcgttgtagncataatggcctctcactntgtggtggtaagagatgatggttgccagnttgctcagcntggangaggctgagaaggagcnagtatatcagaaagatgtcgacatgaaatatggacaaggagaacctcatagatctgggagagaggatattggtttgaatgcgcatggtgcttcgagacctgcagaaggtactgttgatgatgaatcagatatgctgggtctctctcgtcacacaggtcaaaaatactatggaaaatctgcatctgctgaaccgaaacaagttccaagcaagaagcagagagctgatcccatcttaccagcttctaaatggaatcgagaggatgatggcagcggcgatgaagatagaaaagatggtcaaggattgggattgagctattcatctggaagtgatattgctggtgatcccgggaaagctgatgcaacagaaattagtactgatcacgcaattcatcatccagatacaattgttgatgaagagcataggcagaagctgaggcagattgagatcggtgtcatgcagtatcgtgaatctcttgaggagaagggtttgtggaacatggaggagcttgagaggaaggttgccagccaccgtaggcgtcttcagtctgaatatgggttgtcttcttctgtagatggggcaaacaacaggcgctcttccgagagaataccatcggaccggaaaggaaggtatgatgatgcacgcgattcttccaagaagcggcctcacagcccaagtaggagccatagtccttcaaagaaattatcactggatagagaccgagagcacaatcgcagcagagacagattgcatggtaatgatgtcgggagagacagggcacgcgagaaaagttcaggccgagagaaggatgatcaccatgatagaagcagagaaagagaaaaggacaggagaaaggggaggtgactgagggtatgtttggttccagccctaccaaatatttggctagccaaaattttggttgaccttttggttgcccatgagttggtcaacatcggcaaggaaaacgagctagagtaaccaaaaaggcgttggcatgccaaatactcctagttggcaaccatgcaaacaaagcccagtgttttggacatgaccaaatattggtagggtaagtttagctgccataacatacatacataccctgatacttgtagatctcgcacttgtccttgggctgaataagtgtcttgagaaaggaaatatttgagctgggctgcatccgccaatacccgccgcatgtaaatgggtgcgcatggcctgctcaaggacctgcttgtagcggatttgaggatttaggctgtggtcctaatggcggacctgtttttgtagtatcaaggaacagtagtttgtgaaacataagtactttgatcaagcaacactgaatgaaatgctgtcagttcgtggcatgggctgctactaataaactttgacaagttgctatggatttgctctggcaatcttgttgtttaacccctgtaggattcagcttagaattagcatggtgctactgctgcctcaactcctccatttgacatttcggttaatctggatgaagggcccggcatggcaggttgtttaacttgctggtgcattcttctgcgcatggttaaaaaaaaaa

SEQ ID NO: 3331 - DNA, 837 bp, Triticum aestivum
  misc_feature (466)..(466): n is a, c, g, or t
ttaagctattcatctggaagtgatattgctggtgattctgggaaagtggacacaaccgaaattagtaccgatcaggcaattcaccatcaagatactattgttgatgaagagcataggcagaagctaaggcagattgagattgctgtaatgcagtatcgtgaatctctcgaggagaaggggttgcatagcatggaggagattgagaggaaggttgccagccaccgtaggcgccttcaatcagattatggtttgtcttcaatagatggtgcaaacaacaggcggtcttctgagagactatcattggaacggaaagaaagggcggatgatgcacgtgattcttccaggaagcggcctcgcagccggagcaggagccgtagtccttcaaggaagtcatcactggatagagaccgagagcacaatcgcagcagaggcagattgcatggcaatgatgccgggagagacaggncacgtgaaaaaggctcaggccgagggaaggatgatcaccacgataggagcagcagagaccgggaaaaggacaggagaacgggaaggtgatcggaacctgctgtgcactcatcctttgcctgaacctgctgtgcactcatatgagctgggctgcctaaatgcgccatacatgggctccacgaacctgtttgtaatggggtcagctgaggaactgttttttgtagtttcaagaacagaagtagtgttatcaaacatctaatgttgactttgaatgattgaaatgctgcccattgtcgtcatgcactgcggcttaatgaacttggatggcatcggttgcaagtttatgaatttgctgtgctaaggttttttatg

SEQ ID NO: 3332 - DNA, 817 bp, Triticum aestivum
gattgggattaagctattcatctggaagtgatattgctggtgattctgggaaagtggacacaaccgaaattagtaccgatcaggcaattcaccatccagatacaattgtggatgaagagcataggcagaagctaaggcagattgagattgctgtaatgcagtatcgtgaatctctagaggagaaggggttgcatagcatggaggagatcgagaggaaggttgccagccaccgtaggcgccttcaatcagactatggtttgtcttcaatagatggtgcaaacaacaggtggtcttctgagagactatcattggaacggagagaaagggcggatgatgcacgtgattcttccaggaagcggcctcgcagccggagcaggagccgtagtccttcaaggaagtcatcactggatagagaccgagagtacaatcgcagcagaggcagattgcatggcaatgatgccgggagagacagggcgcgcgaaaaaagctcaggccgagggaaggatgatcaccacgataggagcagcagagaccgggaaaaggacaggagaaccggaaggtgatcggaacctgctgggcactcatcctttgcctgaacctgctgtgcactcatatgagctgggctgcctaaatgcgccatacatgggctccacgaacctgtttgtaatggggtcagctggggaactattttttgtagtttcaagaacagaagtagtgttatcaaacatctaatgttgactttgaatgattgaaatgctgcccattgtcgtcatggaccgtggcttaatgaacttggatggcatcggttgcaagttta

SEQ ID NO: 3333 - DNA, 810 bp, Triticum aestivum
ttaagctattcatctggaagtgatattgctggtgattctgggaaagtggacacaaccgaaattagtaccgatcaggcaattcaccatccagatacaattgttgatgaagagcataggcagaagctaaggcagattgagattgctgtaatgcagtatcgtgaatctctagaggagaaggggttgcatagcatggaggagatcgagaggaaggttgccagccaccgtaggcgccttcaatcagactatggtttgtcttcaatagatggtgcaaacaacaggtggtcttctgagagactatcattggaacggagagaaagggcggatgatgcacgtgattcttccaggaagcggcctcgcagccggagcaggagccgtagtccttcaaggaagtcatcactggatagagaccgagagtacaatcgcagcagaggcagattgcatggcaatgatgccgggagagacagggcacgcgaaaaaagctcaggccgagggaaggatgatcaccacgataggagcagcagagaccgggaaaaggacaggagaacgggaaggtgatcggaacctgctgtgcactcatcctttgcctgaacctgctgtgcactcatatgagctgggctgcctaaatgcgccatacatgggctccacgaacctgtttgtaatggggtcagctggggaactattttttgtagtttcaagaacagaagtagtgttatcaaacatctaatgttgactttgaatgattgaaatgctgcccattgtcgtcatggaccgtggcttaatgaacttggatggcatcggttgcaagtttaa

SEQ ID NO: 3334 - DNA, 944 bp, Hordeum vulgare
ctggtgattctgggaaagtggacacaaccgaaattagtaccgatcaggcaattcatcatccagatacaattgttaatgaagagcataggcagaagctaaggcagattgagattgctgtaatgcagtatcgtgattctctcgaggagaaggggctgcataacatggaggagattgagaggaaggttgccagccaccgtaggcgccttcaatctgatcatggtttgtcttcaatagacggtgcaaacaacagacggtcttctgagagactatcattggagcggaaagaaagggcggatgatgcacgtgattcttccaggaaacggcctcgcagccgaagcaggagccgtagtccttcaaggaagtcatcactggatagagatagagagtacagtcgcagcagaggcagattgcatggcaatgacgccgggagagacagggcacgtgaaaaaagctcaggccgagggaaggatgatcaccacgataggagcagcagagaccgggaaaaggacaggagaacgggaaggtgattgaaacctgttgtgcgctcatcatttgcctgaacaagggttgtgttaaaagcaaggaaacataactgggcagcatcagctgataacatgcaaatgggcatgtggttccatgaacctgtttgtaatcgggtcaactttgaggattgtgatagagtaactattttttgtagtctcaagaacaaaagcagtgttgtcaaacatcgacttgtgcattattgtagtagcatgagcggccgctgggcaaccgagtgaagcgcaagaagcgatgctggaaggttatacatccgagaacgaaatatgtggcatttgtagagatattgtcatcgatagaggagttttggatggttgccaacactggtcttgagggtcaatattgtgcggctagggaacttattaggttttgctatacatgcatag

SEQ ID NO: 3335 - DNA, 490 bp, Triticum aestivum
cacgaggctaaagcccacgatacacaaaaagagcaagtactaaccctcaccaactcagaacatgtagatccagaacccagagagggccgagaagatggacctgataaaggccaagagactctggttttagctgattctctaatgctagagaatggtggcacatgcaatgtcccagctgatgaagacactaaaaactttgagctcttccctcccaaagctgtagcgctgcatcgactgagatggaatatgaacaaaggtagcgagaaatggttatgctacggaggcgccgcaggcatcattcgttgtcagaggatctaaaaggcaagcacaattggggaatgttcgccgcaacccaggatcatccgtatgtatccacctacacaataagctgtcgcagcatctgctgttacttggagcaatatatggtatgtttgtccgattcaacctttcaatgggttgccattgcggatttccagttacgcactgttat

SEQ ID NO: 3336 - DNA, 719 bp, Pseudoroegneria spicata
agagaatggtggcacatgcaacgtcccagttgatgaagacactaaagactttgatgtcttccctcccaaagctgtagcactgcatcgactgagatggaacatgaacaaaggtagcgagaaatggttatgctacggaggcgctgcaggcatcatccgttgtcagaggatctaaaagacgagcataattggggaatgttcgctgcaaactagggtcatccatgtgcatgcacctacacaataagctgttgcagcaataggtggtatgttcatccagttctttcctcaactggctgccattgcggatgtcctttctacagttatgcacagttatacataacagaactgtgtattaggaactccaacagatccttgtagttgaggaactcaagctcaggcaatatgagctaccaggtcctgcatatcttggacagcaaatcatagttatgagaatattagcagctcagcaacacaataaggggcatcggtctggaataagcgcgggcgccgcagctttctgaacctggtgcaagttgaaactgactttttcttttattttgctttttcctgtaaggctgtaacatatgtacatctattgtttacacagtcgcacaaattgagcaatgtcgcgccagttgtaacattgacaaactgaacaatgtcgcgccaaatatgttatagacgaataatggaaatcatgagccattgctcttaaacctgca

SEQ ID NO: 3337 - DNA, 4321 bp, Oryza sativa
ctcggtagcccggcggcggcgtcgttggcgtcggcagcggcggacgggtggcgcggcggcgagggccacgggcggcaggcgcgcgggcggaggcgcggggtggcggcggcggctgcgcgcgggcggtggcgcggggtcggcggcgcgcggcacgttacagaagaaacaaagcggacacgtatctcgccgtcgtctcccgctccgcacgcaagcagcgggcggctgctgctccgcgcctccgtcgtgtggggctcgcgagagcctggaccacggcggaggcctccaccggcgttgctcgccaccggatttggcgtgctctgcttaattgggccgatctcaagcccttggcggaacttgcacttctcgacccaaaaacccaaacaaggcataattgggccgattccctcctatattctcgtttcccgcggctcaaccgctcatcaagccctagatagtgctctctctctctctctctttgctcgattcgccggcgatggcggcgccgccggaggcgacgggggcgccgccccagactgaaggagaggaggttaaggatggcgtcgaggtctgcgtatttgacgagtcaccggaggtcttctccagagcggtgcacgccatctcggagctcacaaccggggagcacgagccgaacttccctgacgccgaagtcgagcggctcgcctcctcaataactttcctcagagaatggaggcacttctcttatgagccaaaaaatgttagtttcacttgtgacgccagatcagctccatccagagttgacacacacaagataaacttaccacagttctcgtctgcatctgtcccccagatcacacacctagacaatgggaaggctaaaacagacaggtcttctatgaaacacgagatgcgggacttgaatcttattttgaaagccctccaaacttgtttaaagatttcagtacagtctccaaaactactaagatatcttgctgttgctgctcaccctcctggttcttcttaccataaaattggcatgccgttaatcgggagaggtataattcaagtttggtgtctcctagcaccatctgaagagggtcatcctcatcagtcattggttgcatgcaataaatataatccatccaatcaaccaaaacaaaggggtagaccaagaaagaccatcacaacttctgatgatcacttggaaccaagtgtcaaaagaccaaggggcagaccaagaaaatatccactgccaattgccaaagtggaagattcatcccaaaacgacagaagtcaagagtttgctcttatttatcctcttgtcagtccagcagttgtttcatgtgacattgcaatagcttatcccatgccaactgttaatcctgtggaatcaactccaagaaaaggtagagggcgacctaggaaaaaacctgttgaaataaaaggtttgtctggcattaaactaacagaagacttgtctacagctctatctccaatagctttaacctgcatggagcccaagaaaaaaagggggaggccccgaaagtatcctgctccaagcaacagcaagcatcttccaggcactgatactgaattaggaaatgattctgtctgtcagcctggttcaattgattttggtttgggtcccactgaaaatactgggtctggtgctaatataactcatgctgcagttgatgcagcctccccagttccattgtcaggtcagaggggtagagaacagccagaaaaggaagtaattcatattgagaattccatgcaatctggacagtctgacataggatccatgttgcctacgtatattttacctgaatcaggcaacaagagtaactcaactggtctgaggcggaggggacgacctaggaagaaaccatttccgagtacaaccagttgtgtatttgttcctggtactgagaccccaaagaaaggttctactctgaccaattcaaataatctcgtggtcttggccaagagtaattgtgacattttagcaaatgatattggtccatcaagctgtgctatagagaacagtgtccatttgagtgttggaacatctcatgctgcaacaccagcacagggcatatgtcttgcaaaatgcaaggaagaatcaagtgccaagaagggtagaggcagacctagaaagcagccaatttcaacggaatgcggttgttctaaagcatgcaggggtgaagaacaaaaaactcagacaattcccaagtcaagcgacaatgcgtccttggttgaaaattgcaagaaagaatcatgtcccggaaagggcagagtgcaagataaaaagaaatctgtttcaaatgaaagaagttcagtagtgcttagtgttgaagcacagaacatggacggatcttctgcatcaactgcatatacttcatgttgtactcctgcttgtaactttgaaaacgcagagacaaatcaggctgtatctgttccttccgaaaacagtgctcaggttattgatgaactaaaagatacagaagtggctcgattcaaagaatcaactaaagatgataatatgatttgttctgcagaaaagaccctttctcgtgtcccaaaagacatttctctaccaagggttgtcttatgtttagctcataatggaaaagttgcttgggacgtaaaatggaaacctccttcagcaaatcagtcagaacataaatcatgtttgggttttcttgcagtactcttggggaatggctcgcttgaagtatgggaagttccatctccaagcatgattcagaaaatatattcctcttcttcaaaggagggtactgaccctcgatttttaaagctgaagcctgtgtttagctctgccaaagtaaagtgcgggaacagacaaagcattcccttgacagttgattggtcaccctctcatgatatgatattggcgggatgtcacgatggaacggttgctttatggaagttctctgcaaacctgtcatttcaaggttcaaaaccttttatgtgtgtaactgctgaatctgctcccatcagaaccgtgtcgtgggcaccatctgtgagtaaggaaaacgtgaatacctttgtcactgctggagaggatggtctgaaattctgggatttaagagatccatatcgtcatctttgggagttaactactgctccaagggccgtaataagtcttcaatggttgaaggatgcaagaggtgttgtcatatcattggaagatggcacattaaagttcgttagcttgtcaagaatcgcaaatgatgttccttttactggaaggccatttgttggaacgaaaactcagggtgtttctacctatcaattgtctgaatatttgatctggagtgtccatgcctcagaaattacaggctatgcggcttattgtgtggctgatggaactgctgtttgctttgagcttactccgagattctgggaaaaggaacctgggaggaaccgtgtaccatattttctttgtggttcattatcagaggagggaacaaccattaaaattggtatcgcattaccaaactctcctttgtcaaatgttcctctggggaccaaacgggctactaaaacttgcaaagatgtagctcaattgcatgttatagaagaagggaaacttcttaccaactcagaatacaatggtgctataaatccgagcatcagagatggtcaacaagatgaacctgatgaaggacaagaaaccggtgccatagttttagctgctccttcaatgcaagagaattttgacacaagcaccagcaggggtagtgaatcccctgaaaattttgaggtctttcctcctaaagctgtagcattgcatcggttgagatggaacatgaataaaggtagcgagaaatggttgtgctatggaggtgctgcaggcattatccggtgtcagaggatctaagaaacaagagcacacttgaggaatctccttgcatatcaggaaaatctgcatgtgtccatctacacaataaactgttgcatgctgtgagctgtatagccttatggactgaagctttacctgagctgcgaggttctctgcgttttgggaccagcaattcattgcaggttggtttgaaaatagaaaatactgtcactccatgcgattcttcctcgacattagtctgaaataagtgcaataagtgcctttggcgatccagattcgctaaatctgttgtaattgtaattgtaattgtaattataattgatagctattcttattcatttccttaaacatattattgatgcagctgaaaaactgcacgatattaggtggaatttcatgcatcgctgtttaagttttggaagtcatacagccttgttgcttcatctcttttta

SEQ ID NO: 3338 - DNA, 6012 bp, Oryza sativa
agagtcaccctccgccgccgacaaaaccctagaccagcgccgccctcgactgccgctcccgtcgtcccaacccaccgcccccctgccgtcgtcccatcccgcccgtcgtcgcatctcgtcgcccccccccaatccatcctccggactcccccacatagccacgccggcccccacatcgtcaccgtcgaccgttggacaccgccgccctcctctcgctcgcactcaccccgtcacccgacgccgccgactcctccctcatcgcgccttcctctactcgtaccactgccgaaaccctagacccgcaccgccctcgaccgccgcccgtcgcgtcccgcctcctccccgagtccgcgacaactattcccaagaaagtcagaagctatatgggcctaatgcattgttacgctttcagcccataactacaggcccgtagagatctcaattggaaaccggcagaatattcggggatggcgggccgccggctcgattgaacaaccccacctgcgagggccgattccccccattctcgttttccacggctcaaccgctctcttcgctcgattcgccggtgatggcggcgctgccggaggcgacgggggcgctgccccagactgaaggagaggaggttaaggatggcgtcgaggtctgcgtatttgacgagtcaccggaggtcttctccagagcggtgcacgccatctcggagctcacagccggggagcccgagccgaacttccctgacgccgaagtagagcggctcgcctcttcaataactttcctcagagaatggaggcacctctcttatgagccaaaaaatgttagtttcacttgtgacgccagatcagctccatccagagttgacacacacaagataaacttaccacagttctcgtctgcatctgttccccagatcacacacctagacgatgggaaggctaaaacagacagttattgtttatggagttctttctctcagattttgttatatttgccgggggcaatgtttgggcattggactggtgccctaggttgtgtgacaggcctcattctcccataaactgtgagtatcttgctgttgctgctcaccctcctggttcttcttaccataaaattggcatgccattaatcgggagaggtataattcaagtttggtgtctcctagcaccatctgaagagggtcatcctcatcagtcattggttgcatgcaataaatataatccatccaatcaaccaaaacgaaggggtagaccaagaaagaccatcacaaattctgatcacttggaaccaagtgtcaaaagaccaaggggcagaccaagaaaatatccgctgccaattgccaaattggaagattcatcccaaaacgacacaagtcaagagtttgctcttattgatcctcttgtcagttcagcagttgtttcatgtgacgttgcaatagcttgtcccatgccaactgttaatcctgtggaatcaactccaagaaaaggtagagggcgacctaggaaaaaacctgttgaaataaaaggtttgtctggcattaaactaacagaagacttgtctacagctctatctccaatagctttaacctgcatggagcccaagaaaaaaagggggaggccccgaaagtatcctgctccaagcaacagcaagcatcttccaggcactgatactgaattaggaaatgattctgtctgtctgttgcctggttcaattgattgtggtttgggtcccactgaaaatactgggtctggtgctaatataactcatgctgcagttgatgcagcctccccagttccattgtcaggtcagaggggtagagaacagccagaaaaggaagtaattcatattgataattccatgcaatctggacagtctgacgtaggatccatgttgcctacgtatattttacctgaatcaagcaacaagagtaactcaactggtccgaggcggaggggacgacctaggaagaaaccatttccgagtacaaccagttgtgtatttgctcctggtactgagaccccaaagaaaggttctactttgaccaattcaaataatctcatggtcttggccaagagtaattgtgacattttagcaaatgacattggtcgatcaagctgtgctatagagaacagtgtccatttgagtgttggaacatctcgtgttgcaacaccagcacagggcatatgtcttgcaaaatgcaaggaagaatcaagtgccaagaagggtagaggcagacctagaaagcagccaatttcaacggaacgcggttgttctaaagcatgcaggggtgaagaacaaaaaacacagacaattcccaagtcaagcgacaatgcggccttagttgaaaattgcaagaaagaatcatgtcccggaaagggcagtgttcaagataaaaagaaatctgtttcaaatgaaagaagttcagtagtgcttagtgttgaagtacagaacatggacggatcttctgcatcaactgcatatacttcatgttgtactcctgcttgtaactttgaaaacgcagagagaaatcaggctgtatctgttccttctgaaaacagtgctcaggttattgatgaactaaaagatacagaagtggctcgatttaaagaatcaactaaagattatcatatgatttgttctgcagaaaagaccctttctcgtgtcccaaaagacatttctctaccaagggttgtcttatgtttagctcataatggaaaagttgcttgggacataaaatggaaacctccttcagcaaatcagtcagaacataaatcatgtttgggttttcttgcagtactcttggggaatggctcgcttgaagtatgggaagttccatcaccaagcatgattcagaaaatatattcctcttcttcaaaggagggtactgaccctcgatttttaaagctgaagcctgtgtttagctctgccaaagtaaagtgtgggaacagacaaagcattcccttgacagttgattggtcaccctctcatgatatgatattggcgggatgtcacgatggaacggttgctttatggaagttctcagcaaacttgtcatttcaaggttcaaaaccttttatgtgtgtaactgctgaatctgctcccatcagaaccgtgtcgtggacaccatctgtgagtaaggaaaacatgaatgcctttgtcactgctggagaggatggtctgaaattctgggatttaagagatccatatcgccatctttgggagttaactactgctcgaagggccgtaataagtcttcaatggttgaaggatgcaagaggtattgtcatatcattggaagatggcacgttaaagttcgttagcttgtcgagaatcgcaaatgatgttcctgttactggaaggccatttgttggaatgaaaactcagggtgtttctacctatcaattgtctgaatatttgatctggagtgtccatgcctcagaaattgcaggctatgcggcttattgtgtggctgatggaactgctgtttgctttgagcttactccgagattctgggaaaaggaacctgggaggaaccgtgtaccatattttctttgtggttcattatcagaggagggaacaaccattaaaattggtattgcattaccaaactctcctttgtcaaatgttcctctggggaccaaacgggctactaaaacttgcaaagatgtagctcaattgcatgttatagaagaaggggaacttcttgccaactcagaatacaattgtgctataaatccgagcatcagagatggtcaacaagatgaacctgatgaaggacaagaaactggtgccatagttttagctgctccttcaatgcaagagaattttggcacaagcaccagcaggggtagcgaatcccctgaaaattttgaggtctttcctcctaaagctgtagcattgcatcggttgagatggaacatgaataaaggtagcgagaaatggttgtgctatggaggtgctgcaggcattatccggtgtcagaggatctaaggaacaagagcacacttgaggaatctccttgcatatcaggaaaatctgcatgtgtccatctacacaataaactgttgcatgctgtgggatggttatgccttatattttggaatggagggagtaacagattatctttggaactcccgacagagatgtatagccttatggactgaagctttacctgagcagcgaggttctctgtgttttgggaccagcaattcattgcagattcgcaaaatctgttgtaattgtaattgatagctactagcatacaatgcttgatttcaccagggtgtacccacatactgccctcgtctggtatcggttggttctcgaggggtcccttggttctttgagttcatccggtaatctctgtcagaccagtgcttctgcagatcagctcaatgttgctacatggtctggaaatgtaacaagatcagtctcaaaacctcatgggcggaacttgtttctgcaaagcttagttgaagaagggcagaatccaagcactagcaatggtgccagcaactcccagaaaagtgttgaagataaggacctgatcgactgtctagagaatggcgtcaacttttggacggattattcaaaagttcagtatcatcctcagagtttatatgagttacatgggtcatggacagactttgacaagtttgataactatggcagcgcacaagaggttgtttcagactggtcgcaaatagaggaaatgaatgagaggctaaggttctttgttgaagaatgcgaccatattcagggcatccagtttattgtgggtgattcaggaagtttttccagtgtagctgcacagtttttggagaacattgctgatgattacacaaatacacctgtattgctttactgtgtgagggatccaatgacccttggatcatccaggatgaatcaaagggagtccattatgagagctcttcatgatgctgtttcattttcaaaactttcgtccttttgcaacctgatggtccccataggaccgccttcattaagtagaagttacatgtcaccgtatctttatatacaagacgagaaaccattccatgctagtgctgtttgtgctgcagcaatacattcaattactgttccatttagattgcaacgaacgggcccgagttcagacttagcacattcatctggtaatcttgacattggtgaacttctgcacattttatctgatcaaggtcggcagaatatggttactgctctggatgtagcgatgcctgccccttctttgacagatagagatgctattggggaacatagagatgaagctgcactctttgacccctgaaatcagcgacgaggacgaagatccttattcagttgaatcgctggtggttcatggagctcttgatagaggtgggcaaaggacttccatatcacaagtgaaagactcggtatgttcagtctacgaagccagagagacaaagccaaaattttcccatctctcagcatctctttgccccctccctgtcccccttccgttcccgtcaatcttcagaggcaacattggccggcacggggagatccttagcgaccatgcagaagaatcccagccaaagggctcactcgatattgaatcgataccgatggcggcacgattacgatcaagcagcactgtcctgcctttcatagagaggcgatcggggagcctccagaagcacggtgtcgcaagaggtgccatcgggtctttggtcctccgtgactggggcttcgggagggaggaggtggatgacatgggggagcacctagcaaagttactccgcccgtttcaccctgaaatggatcttacttcggattctgactagatcatcttcgaaaatcttacttggagaatcaagcatgatctatctgttgcaatgtttgtggattgttgcaatactgaatttgtttttaagagggttttcatatactgaaaattcatgctcatgtggctagctgttgtgaaatcaagaatgagagatctgaatctatgctatggtagaatttctttttcttgtg

SEQ ID NO: 3339 - DNA, 880 bp, Triticum aestivum
aaaaagtacctaaagcccccgatacacaaaaagagcaagtacttaccctcaccaactcagaacatgtagatgcagaacccagagagggccgacaagatgggcctgataaaggccaagagactaatgctctggctttagccgatcctctaatgctagagaatggtggcacatgcaacgtcccagttgatgaagacactaaagactttgagctcttccctcccaaagctgtagcgctgcatcgactgagatggaatatgaacaaaggcagcgagaaatggttatgctacggaggcgccgcaggcatcatccgttgtcagaggatctaaaaggcaagcatagttggggagtgtttgccgcaaaccagggtcctccgtggtatccacctacacaataagctgtcgcagcatctgctgttacttgcagcaatatatggtatgttcgtccgattcaacctttcaacgggttgccattgcggatttccagttacgcagagttatacataacaaagctgtgtatctgaggaactccaacagatccttgtagtttaggaactcaagttcaggcaatatgagctaccaggtcctgcatatcttgggctcagcaaatcatagttctgagaatattagcagctcagcaacacaataaggggcatcgatctggaataagtgcgggctaggcgcccgcaacttctttgaacctggtgcaagttgtaactgagtttttttttttcctgtaaggctgtaacatatgtacatctattgtttacgcagtcacacaaattcagcaatgtcgtgccagttgtaacattgacaaactgaacaatgtcgcgccaatatgtaatagatgaataatgggaatcatgagccattgctcttgatac

SEQ ID NO: 3340 - DNA, 842 bp, Triticum aestivum
  misc_feature (10)..(10): n is a, c, g, or t
  misc_feature (44)..(44): n is a, c, g, or t
aaaaagtacntaaagcccacgatacacaaaaagagcaagtactnaccctcaccaactcagaacatgtagatgcagaacccagagagggccgacaagatgggcctgataaaggccaagagactaatgctctggctttagccgatcctctaatgctagagaatggtggcacatgcaacgtcccagttgatgaagacactaaagactttgagctcttccctcccaaagctgtagcgctgcatcgactgagatggaatatgaacaaaggcagcgagaaatggttatgctacggaggcgccgcaggcatcatccgttgtcagaggatctaaaaggcaagcatagttggggagtgtttgccgcaaaccagggtcctccgtggtatccacctacacaataagctgtcgcagcatctgctgttacttgcagcaatatatggtatgttcgtccgattcaacctttcaacgggttgccattgcggatttccagttacgcagagttatacataacaaagctgtgtatctgaggaactccaacagatccttgtagtttaggaactcaagttcaggcaatatgagctaccaggtcctgcatatcttgggctcagcaaatcatagttctgagaatattagcagctcagcaacacaataaggggcatcgatctggaataagtgcgggctaggcgcccgcaacttctttgaacctggtgcaagttgtaactgagtttttttttcctgtaaggctgtaacatatgtacatctattgtttacgcagtcacacaaattcagcaatgtcgtgccagttgtaacattgacaaactgaacaatgtcgcgccaatatgtaataga

SEQ ID NO: 3341 - DNA, 3839 bp, Brachypodium distachyon
cgctactcccctcgccggcgatggccgcgccgccggagacgacggaggcgccgtccccgccggaaggggaggagggcaataaaggcatcgaggtctgcctattcgacgaatcgccggaggatttctccagagcggtacgcgccatctcggagctcgccggcggcgagcttgagccgagcttcgctgacgccgaagtcgagcggctcgcctcctctataacgttcctcagagaatggaggcatttctcttatgagccaaaaggtgtaagtttcactagcggcactggatcaacttcttccagagatgatgcacacgagataaccttaccacaattctcatctgcgtctgttcctcaggtcacacacttagaagatggaagatgtaataacacagacagttgctctctttttgtggatcgtgacttcaaaaacttattcatcatcttattattcaatgtttatctcgctgttgctgctcatcctccaggttcttcttaccataaacttggtatgccattaaccggcagaggtatcattcaagtttggtgtctggtagcaccctttgaagaggcagatcctcgtaaggcaatggttgcttacaataagagcaatcgtagaggaaggcctagaaaaatactagatgagaacaatcctatccagagttcatcaattccacgaaaaccattagggaggccaagaaagataaaatcgacaactactgatgaacacgcagaaccaagtcctaaaagaccaaggggcaggccaagaaaacatccactgccagttgccaaagtggtggattcgactaaaaatagcggaactcaagattccagttttatggaccctcttgccacttcaacagttgttccaggtgatcttgcattatcttgtgtcgtacgaacagtgaaatctgcggaattgaccccaagagaaggtaggggtcaaactaggaaaaccccaactaacaaaaaaaagtgtccacctggcattgaatcaaaagaagatatgtctacagctctaatatgtatggaaccaaagaaaaaaagggggaggcctcggaaatatccagcccaaagcagcagcaagcatgtttcaggcactgatactgaattagcaagagaagctatgtgcttgcctgttacagttggttgcaatctgggccacactggtgatgcacagtctaattctaatttaagtgttgttacaggtgatacagcactatcagttctatcttcatctagtaaaatttgtgagaaaaaagcaaaaggtagaggacgacctaaaaaggaagcaatttctgggtcactttcttgctcagtggtttctgaagattctttgttgcccatgcatattgcacctaaatcaaatggcgaggaatcaagtggtaggttgggaagaggacgtcgcagaaggaaaccactttcgagtacaaatggttctttacttgcttctggtaccgagtccccaaaggcagatactataatgaacaattccgacaagcccatggctttggccaagtgtgatggtgaagttggtttgtgcaatgcaaattgcaaggaaaaatcaattgctaaatgtagaggcagagatagaagtaagctagtttcaaccaagtgcaattgttctaacactggtgaagaacaaaaaaatcagagaactcccaagccaaatgacaatgtcttctcagttgaaaattgcaagaaagaattacttgtctacaccagaaggagtgtacggcgaactacaaagagaccttctccaaataagagttactcactggctcttagctgtgaagtacagaaggtgaagagatcctcaacatctatcatgccaaagagtcatttgtcttctgttgaggatcctaagctactggattcatctataattggagacatggttaatgaggcttgtttagttggatctaagagtggagttgttagttgtgaagtcgtgggaatgaatgatagcagtactgccaatcaagttgtgcatgtcattgctgaagtgaaagatacagaagtagctccattcaaagattcaagtaaaaatgataatatgatgacttgtacagaaaactcaaacttttctacaatcccaaaaggcattcatctaccaagggttgtcttgtgtttagctcataatggcaaagttgcttgggacatcaaatggaaacctcctctaccgaatcagtcagaacagaagtcacgtttgggttttcttgcaatactgttgggaaatggctcacttgaagtatgggaagttccatctccaagcatgatccagaaaatatatttctcttcttcagtggagggtactgatcctcgctttctaaagctgcaacctgtatttagatgtgccaaagtgaagtgtggaaacagacaaagcattcccttgacagttgattggtcgccttctcctcatgatatgatactggcaggatgtcatgatggaacggttgctttatggaatttctctgcagacttaccatcacaagattcaaagccttttatgtgtgtcactgctgaatctgctcccatcagagccctttcatgggcaccatatgcaagtgaggaaaacacacatacctttgtcactgctggagaggatggtctaaaattctgggatttaagagatccataccgtcctctgtgggagctaactactgccccaagggccgtattaagtcttcattggttaaaggatgcaagaggtattgtcatctcactggaagatggtacattgaagttcctcagcttacccagaattgccagtgatgttccggtcactggaaggcccttctctgggactaaaactcagggtgtctctacgtatcaactgtcagaatatttgatctggaatgtccatgtctcagaaattactggttatgcagcttactgtggggcagatggaaccgctgtgcgcttccagcttacttcaagattctgggagaaggaacccgggaggaaccgtgtaccttatttcctttgtggttcattagcagaggagggaacagtcattaagattggcggcacgttgcaaagctctcctttatcaaatgttcctctggttgcaaagaagggtccaaaatctttccaaaatgtggatcaagcacatcatatagaaaaagagaaactgcaaaatctcaccaactcaggacttggagatccagaactaagagagggtcaaccggatagacctgatgaagggcgagaaactaacgcgttagttttagctgatcctttaatgcaagagaactatgggatatgcaatggcagcgttgatgaatcccctgaagactttgaggtcttccctcccaaagctgtagcactgcatcgattgagatggaacatgaacaaaggtagtgagaaatggttatgctgcggaggggctgcaggcattattcgatgtcagaggatctaaaaaaacaaagcataattggggaatgtttgttgcgagcctgaatcatctgcgtgtattggcctacacaataaactgctgcggcatctgctgatactttccctgactgctgagctggtcgctggtgtccttttctcagctatgcatgaactactaattctgaccatgaagagttgcctaactggattcaacaaatccgtatagtttaggaactcaagttcaggcaatatgagctaccaggtcctgcatatcttggacttatagaataatcagctcagcaattcatcaaggggcctcagtctggaatgaattgcgggttggaattgaccctgttgtaagttgtagctgactggttcttttgttatttcctgtaacatatgtacatgtattgtcgatgcagtcaacaaactgaacaacgtagca

SEQ ID NO: 3342 - DNA, 2249 bp, Oryza sativa
aacgaggttcaaaaccttttatgtgtgtaactgctgaatctgctcccatcagaaccgtgtcgtgggcaccatctgtgagtaaggaaaacgtgaatacctttgtcactggtggagaggatggtctgaaattcggggatttaagagatccatatcgtcatctttgggagttaactactgctcgaagggccgtaataagtcttcaatggttgaaggatgcaagaggtattgtcatatcattggaagatggcgcattaaagttcgttagcttgttaagaatcgcaaatgatgttcctgttactggaaggccatttgttggaacgaaaactcagggtgtttctacctatcaattgcctgaatatttgatctggagtgtccatgcctcagaaattacaggctatgcggcttattgtgtggctgatggaactgctgtttgctttgaggaaaaggaacctgggagaaaccgtgtaccatattttctttgtggttcattatcagagggaacaaccattaaaattggtatcgcattaccaaactctcctttgtcaaatgttcctctggagaccaaacgggctactaaaacttgcaaagatgtagctcaattgcatgttatagaagaagggaaacttcttaccaactcaggtaatcgctgtcacctgcaacttgtatcattttgcttgtacctgacatgcctgcttaaccaccatacagaatgcaattgtgctataaatccgagcatcagagatggtcaacaagatgaacctgatgaaggacaagaaactggtgccatagttttagctgctccttcaatgcaagagaactttggcacaagcaccagcaggggtagcgaatcccctgaaaattttgaggtatttcctcctaaagctgtagcaatgcatcggttgagatggaccatgaataaaggtagcgagaaatggttgtgctatggaggtgctgcaggcattatccggtgtcagaggatctaaggaacaagagcacacttgaggaatctccttgtatatcaggaaaatctgcatgtgtccatctacacaataaactgttgcatgctgtggtatgtttcatccgtttctttcctctactgttattttgatcaccatgtccattttgggttatatgtattaacttcttgcactgtgcttgcaatataacagattatggccctgtttggttcatgggctaatatttagccctcaccttttagcctcaaattagccctcagagatccaaacaggtgagctaattttgagctaatatgaattagcccccctcaaaacattagcccctctaaggggtactaatggggctaatttcgtgtggggaccatcaaaaagcagctctctctctctctccttctctctctcctctctttctactctctctccaccttttagccttgaattagcccatggatctaaacataccaccctaggctaatgtttagcctaccaattcatgactaaacattagctctcaaaattagccctgggctaatctttcaaagagggcctatctttggaactcccgacggagctgtatagccttatggactgaagctttacctgagctgcgaggttctctgtgttttgggaccagcaattcattgcatgttggttcgaaaatagaaaatattgtcactccatgcgattcttcctccacattactctgaaataagtgcaatatgtgcctttggcgatccagattcgcaaaatctgttgtaattgtaattgtaattgatagctattcttattcatttcctgtaacatatgtaagatcgcacagattattgatgcagctaaaaaactgcacgatattaggtgggatttcatgcatcgctgtttaagttttggaagtcatacagccttgttgcttcataatatgtactactctttttaaggattgttgagttgttaggctgtcgaagcttttttaaacaaatcaacagcaatgtgttgaggcatttcttcgctgctgtgctcaagttctcgtagggagcacgaccctacgacataggagcatttctgtccttgctccttaccagataaagagaagatctgatgtatctttgttaacacgatatcataacagttgggtaaacacgatataggagcattttcattattggagagagaatttggcatatttacatttcacttagctgtctttatcaaagtgatatttcgggtgaaactgcaggatgaagtactgtacaatagtaataaacgtggcttccc

SEQ ID NO: 3343 - DNA, 4357 bp, Sorghum bicolor
cgcttagcccccctctccggtgatggccgcggcaccgccgggagccggagaagatattaaagacggcgttgaggtgtgcgtgttcgatgagtcagcagatgggttcttgagaactgtgcgcgccatctcggagctcgtcgacaaagagcccgaaccagacttccccgaggcggaagttgagcggctctcctcttcaataacgttcctcagagaatggaggcacttctcttatgagccaaaaagtgtaactttcactagtggcactgagtcaacttcatctagagatgacatgcacagtgtaaccttgccacagttttcatctgcttctgttccccagtatcttgctgtttctgcgcaccctcctggttcttcttaccataaacttggcatgcccttaaccgggagaggtatcattcaagtctggtgtctgttagcaccatttgaagatgcacatgctcgccggtcaataaatgtatgcaataatagtaagcgaagaggaaggcctagaaaaataccttgtagtgataagctggaacctattccaaaaggaccaagggggaggccaagaaagagaccttgcagtgatcagttagaacctgttccaaaaagaccaaggggcagaccaagaaagtgtccattgccagatgcaaaattagaaggttcatcccaaaacgggcaaagtcaggatatcattctttttgatagttcaagtgttatttcagatgaccttccattggcttatgtcatgccaactgtgaagtctgtgcaatcaactcctaaaagaggtgctgatgttgaattagggaaagggacaacttgtcaacctgcttcatttggctgcagtttggaccacaatgcttgcacagagtttaatgctaatttaagtattgttgcagttgatgcagcattgccgcttattgacaaaccgacctgttcatctggcactgtatcaggagatgtgtgtacagccccatctccaaaaactgtgatctgtacaaaacctaagaaaccacggggaagacctcgaaagtatccagttccaatcaatgctagatctgtatctggcactgtatcaggagatttgtggacagccccatccccaacaactgcaatctgtacaaaacctaagaaaccacgggggagacctcggaagtatccagttccaatcaatggtagatctgtttcaggtactgatgctgaattagggcaagagacaacttgtcagcctgtttcatttggctgtagtttggagcacactgtttgcacagagcttaatgctaatttaagtattgttccggttgatgcagcattgccaattgttgacgaactgtgcagttcatctggtgctgtagtaaaagaaagtgtgtgtaccgaaccagctccagcaactgcaactcgtaagcaaccaaagagaacaagggtgatgccacaaaaatactcagacactatgattgaactggggaaagatacaactagtcagcctgttttatccagtatgggtcacactgcttgcacagagtctaactctagttttagcattgttgcagttgatgcatcatcatcatttacatctccatctactgcaacttgtgataagaagtcaaaagatgattctgtacttcctatccacatttcacctaaatcaagtaataaaagagagtcaagtggcaagaggggaagaggaaggcctaaaacgataccactttctgctggaactggtcgttttgtggcttctggtgccagcctcccaaagacaacctctgtactgactggttcaaacaatctcacatctttgaacaagagtggtggcaaatttatagtaagtagccttggttcatgtgggtgtgatattgagaaatgcagtgttcattcaggtgttttgttgtctgatgatgcatcaccagcacatggcttacacaatgcaaattgtaaggaagaattaaataccaaaataggaaaagggggatgtagaaagaagcctgtttcagctgagcacagtcattttactgattttaatgtcaaagaacaaaaaatgcagacaactccaaagtcaggcgattctgtggtcttggttgaaaattgtatggaaggacaaggccccagaaaggctggggggcaacttcaaaggatacctgcttcaaatgagagtagtggcaaatctgttggtgttgaaacgcataaaatagagacattatctacaccaatgactaaaggatcatctaaaaatgatgacatgggtcatggggctggtttgaatcagtctaagaatgcaattgctggttgcgaaggcatgaaagttactgaaagcaacactgccaattatacttctcattgtaatgaaaatgcacgagcaaatcaagttgcacctagtttcaagaacagtgatagggtcattgatgaaacggaagctgcggaacttgtgccactcaaggaatcatgggaagatgacaatatgtttagttgtgtaaactcaaactcatcttcaattacaagggacattgctcaaccaagagttgtcttgtgtttagctcacaatggcaaagtcgcttgggacatcaaatggaagcctcctttactaagtcagcctgaacagaaatcacgactgggtttccttgcagtattgttggggaatggcattcttgaagtgtgggaagttccatcaccatgcatgatccagaaaatatattcgtcctctaaggtggagggttctgaccctcgttttctaaagctacaacctgtatttaggtgtgtcaaagtgaagtgcaggaacaggcaaagcattcccttgacagttgattggtcacctactcctcctcatgatatgatattggcgggttgtcatgatggaacggttgctctatggaacttctcgatgaatttgccaacacaagattcaaaaccttttatgtgtgtcactgctgattctgttcccattagagctctctcttgggcaccatatataagtgaagaaagcacaaatacttttgtcactgctggagaggatggtctaaagttctgggatttaagagatccgtaccgtcctctttgggagctaactactgctccaaaggctgtattaagtcttcattggctaaaggatggaagggggatcgttatctgtttggaagatggtacattgaagtttctaagcttgcctcggattgcaaatgatgttccagccactggaaggccatttgctggaacaaaaactcagggtgttggaacttatcagttgtcagaatatttgatttggagtgtccatgcctcagaacctacaggttgtgtggcttactgcggggcagatggtactgctgtgtacttccagcttaattcgagattctgggataaagaacctgggcgtaaccgcgttccttatttcctctctggatcattatcagaggagggagaaaatattaagattggcagcaggctgcaaacatctccattacctaatgttcctgtgatgaccaaaaagggttcaaaaccatgccaaaatatagttcaggggctcgctacaaacaatgtcactggcctgctgacatgtcagctcaactcccccacaagaaacagtgacgctgtaaatccagaagttcatgatgatcaagataatggacaaagcgaagagcaaggagcaggtgctgtaaatcaagaacacgacggtgatcgagatgatggacacagtgaagaacatgcagcagacatggtaaacacagaatttggcgatgaccaagacgatggacacagtgaagaacaaggaaccggtgcaataattttagccagtcctacaaaggaagagaatgatggaacatggaacagcaagggtggtgaatccccaaaagaccttaaagtcgtccctccgaattctgtcgctttgcatcaagtgcgatggaacatgaacaagggtagcgagagatggctgtgctatggaggtgctgcaggcatcatacgatgccagaggatctgaagaagagcgcaatctggaatgctcctcgagaaacaggggcctgtaacacagatagtggtactgtggtattattctactctattcttttattctacttttgaccgggtcaccgaaggtggttggcttagctgtgcatagctatagaagagagctggtgcaatagacctttgcgttctagaattgaagccctcaggttctgaatacattaggtatgaaagtctggttctgatagttgcggtagtaccagtgcatgcgaacctgagctttagaataagcccgttggcgttccatcttctgtgtaactgttcccatgagaatgtgaacagaacatgatttcccgatgcattcgggaggaaataataaatgccataatgctagagattctggtttcct

SEQ ID NO: 3344 - DNA, 771 bp, Saccharum officinarum
agattctgggataaagaacctgggcgtaaccgtgttccttatttcctctctggatcattgtcagaggagggagaaaatattaagattggcagcaggctgcaaacatctccattaccaaatgttcctgtggtgaccaaaaagggttcaaaaccatgccaaaatatagttcaggcgctcgctacaagcgatgtcactggcctgctgacatgtcagctcaactcccccacaggaaacggtgacgctgtaaatccagaagttcatgatgatcaagatgatggacgaagcgaagagcaaggagcaggtgctgtaaatcaagaacttgacggtgatcgagatgatggacacagtgaagaacatgcagcaggcatggtaaacacagaatttggcgatgatcaagacgatggacacagtgaagaacaaggagccggtgcaataattttagccagtcctacaaaggaagagaatgatggaacatggaacagcaagggtggtgaatcccctaaagaccttaaagtcgtccctccgaattctgtcgctttgcatcaagtgcgatggaacatgaacaagggtagcgagagatggctgtgctatggaggtgctgcaggcatcatacgatgccagaggatctgaagaagagcgcaatctggaacgctcctctagaaacagaggcctgtaacacagatagtggtactgtggtaggttctactctattcttttatgctacttttgaccgggtcactgagggtgcttggcttagctgtgcataactat

SEQ ID NO: 3345 - DNA, 874 bp, Aquilegia formosa
gtaattatcatgttccctgcagggatccacaccgtcctctttgggacgttaatccagtgcgcaggttcatatacagcctggattggctgcaagatccaagatgtgtcataatgtcctttgatgatggtacgctgaggatccttagcttatcaaaggctgcatatgatgttcctgtaaccggaaaaccctttgttgggacacagcagcaagggctgcacagttatttttgctcatcgtatccaatctggagtgttcaagcatcgagattaaaaggtcaggtggtatactgcactgcagatggttctgttcttcattttcaacttacaagcaaagcagtggataaggatccttcacgcaatcgagctccacattttctgtgtgggtcattgacagaagaggatggaggtctcactctcaacactcccttgccagacatccccttgccgatccagaagcccctaaaggaatatggggagagatccatctacggcttattaacagattcaaaacaagcaaaaagagcaaatgatcaaacacctgaccgtgaacccttggatctgctatatgatggtgatccctcctttcaaattggctctggagatacagagactgctcaagaaagtaaaactacatcgaagaagagcaagaagagaataccggataaaggagacaatcaggagcaatcacagactgaatttgaagttttaagtccgaagattgttgcaatgcatagagtaagatggaatatgaacaagggtagtgaaagatggctgtgttatgggggagctgctggaatcatacggtgccaagaaatctctgcatcttcaactggagggcgttcactagtgaaaaagtgacaaccagactaggcttt

SEQ ID NO: 3346 - DNA, 3858 bp, Setaria italica
ttcatgtattctatcctttgcagtatcttgctgttgctgctcaccctcctggttcttcttaccataaaattggtatgcccttaaccgggagaggtattattcaagtttggtgtctcttagcaccatttgaagacgcacattctcgtcggccactggatgcatgcaatagtattagtcggagaggaagacctagaaaaataccagatgggactaattctgttggttgttcatccaacccaccaaagccaagggggaggccaagaaagagaccttgtaatgatcagatggaacctgttccaaaaagaccaagaggcagaccgagaaaatatccactgccaattggtaaattggaagattcatcccaaaatagtggatgtcaggatattgttctgtttgatcctcttgccacttcaacaggtattcccgacgaccttccattggcttatgccttgccaaccatgaatcctgtggaatcaactccaaaaagaggtagagggcgacctaggaaaatcccaagtgacaaactgacaggttcatctggtgctgtatccaaagatgagtgtacagagccttctccaacaactgcaacctgtgccaaaccaaagagaccacgtgggaggcctcgaaagtatccggttccgatcaacgacaaatctgcttcaggcgctgatgttgatttaggggaagagacaacttgtcagcctctaacaggtccatctggtgctgtatcaaaagaagatgtgtgcagagagccatctccaacaactgcaatctgtgcaaaaccaaagagacaatgtgggaggcctcgaaagtatccagttccaatcaactataaatctgtttcaggcgctgatgttgatttagggcaagagacagtttgcacagagtttaatgctaatttaagtattgttgcagttgatgcagctttgccaattgttcaaaaagtgaccagttcgcctgccactgtagtaaaagaaagtgcatgcatagaaccatctccaaatactgccactcgtaagcaaccaaagaggacacgggtgaggcctcaaaagtattcagatactgatattgaattagggacagcctgtttcatcagaatgcagtttggaccacactgcttgcacagagtctaatttaagcattgttgcagttgattcagcatcactatttacatcttcaactactgcaacttgtcagaagtcgaaaggtgattctttacagcctatcaagatttcacctaaatcaagggagtcaagtggtaggaagggaagaggaaggcctaagaagagtctgctttctgttggaactagttgtttagtggcttctgatgccaacttcccagtgacaacatctgtacttcccagtgacaacaatctcacatctttggtcaagagtgatggtgaatttatagcaagtaatcttggttcgattggttcaagtgggcttggtgttgagaaatctggtgttcatgggtgttgtaccatctgatgctgcatcaccagggcatggcttatataatgcaaattttaaggaagaatcaagtaccaaaagaggaagtggttctaggaagaagcttgtttcaactgtgcacagtcattttacagattttagtggcaaagaacaaaaaacaaagacaactcaaaagtcgagcgatcctgtgatcttggttgaaaattgtatgaatggaccatgccccaggaaaggtggggggcaacctcaaaggatacctgcttcaaatgagagtactagcacatctgttggtgatgaaacacacacaatggagagatttctcacacctatgacaaccggaccacctagaagtgaagacatggctgatgaggctggtttgattcaagctaacaatggaattgttaattgtgaaggcatgaaactaaatgaaaggattgcagccaatgttacttctcattgtaacgaaaatgcacaaacaaatcaagttgcacccaatttcaagaacagtgataggcttattgatgaagtggaagctacagaactcgtaccactcaaggaaccaagggaagatgtcaatatgttttgtagtgtagaaaactcaaactcttctccaatcccaaaagacattgctctaccaaggcttgtcttgtgtttagctcacaacggcaaagttgcttgggatatcaaatggaagcctcctgtagtaagtcagcctgaacagaaatcacgcctgggtttccttgcagtattgttggggaatggctctcttgaagtgtgggaagttccatcaccatgcatgatccagaaaatatattccccctctaaggtagagggttccgaccctcgttttctaaagctacaacctgtatttaggtgtgtcaaagtgaagtgcgggaacagacaaagcattcccttgacagttgattggtcaccttctcctcctcatgatatgatattggcgggttgtcatgatggaacggttgctttatggaacttctcaatgaacctgtcatcacaagattcaaaaccttttatgtgcgtcattgctgaatctgttcccattagagctctttcttgggcaccttatataagcgacgaaaacataaatacctttgttactgctggagcagatggtctaaagttctgggatttaagagatccataccgtcctctttgggagctaactactgctccaagggctgtattaagtcttcagtggttaaaggatggaagggggattgtcatctcaatggaagatggtacattgaagtttctgagcttgccccggattgcaaatgatgtcccagccactggaaggccatttgttggaacaaaaaatcagggcgttgcaacttatcagttatcagaatatttgatttggagtgtccacgcctcagacactacaggttgtgctgcttactgtggggcagatggtactgctgtgtgcttccagcttactccgaggttctgggagaaggaacctgggcggaaccgtgttccttatttcctctgtggatcattatcagaggatggagaaaatattaagattggcagcagaccgcaaacatctccattaccaaatgttcctgtggcgaacaaaaagggtccaaaaccgtgccaaaatatagttcaggccctgcctgcaggcaatgtcattggtaatccagcacttggcgatgatcaaaatgatggacacaacgaagaacaaggagcaggtgctgaaaatccagaacctggcgataattttgatgatggacagaatgaaggaggagcaggtgttgtcaatcctgaacttggcgatcaagatggacacagcgaagaacaagaagcaggtgctatagttttagttggccctacagagcaagaggatgatggcacattgaacagcaagggcagtgaatcccctaaagactttgaggtcttccctcccaaatccgtcgcattgcatcgagtgcgatggaacatgaacaaaggtagtgagagatggctgtgctacggaggtgctgcaggcatcgtgcggtgtcagaggatctaaagacaaaggcccagttggctaatgctccccgcgaaacaggataatatgctcacatccttagtaactgatggaagtaggctctgttgcattctttccgctacttttaacctggtcgtctaggttggttttcttggttgctccaaactgttcaatgtaatcatgcaactatgcaagagaaccaatacaacagatcttcctatcctaggaactcgtgggggagctatgtaggaatagaagccacctgttctgaatacactgggatggaaaataaagtcccggttctgaccaccatgcgaacctgatctttgaaataagcgagctgatgcattcggggaggaaaaagatcggaagag

SEQ ID NO: 3347 - DNA, 788 bp, Zea mays
gccgtaaatctagaagctcatgatgatcaaggtgatggacgcagcaaagagcaaggagcaggtgctgtaaatcaagaacttgatggtgaacaagatgatggacaccgcgaagaacaagcagcaggcatggtaaccacagaatttggcgatgatcaagccgatggacacagcgaagaacaaggagctggtgcaataatctcagccactcctgcaaaggaagagaatgatggaacatggaacgacaagggtgttcaatcccctaaagaccttaatgtcgtccctccgaattctgtcgctttgaatcaagtgcggtggaacatgaacaagggtagccagagatggctgtgctatggaggtgctgcaggcatcatacgatgccagagaatctgaagagccgcaatctggaatgctcttcgagaaacagaggcttgtcacacagatggtggtaggttctactctattcttttctgctacttttgaccgggtcaccgagggtggttggcttagctgtgcataactgtagaggagagccgatgcaatagacctttgcatcttagaattgcagcccccaggttctgaatacatatggtatggaacctgggtcctgatagttgcggtagtaccagtgcatgcgaacctgagctttggaataagcccatttgcgttcccttctgtgtaagggtgtgttcgtttgtccaggaatggacttggaagcgttccagctaatcaaaacttatataacttagggtctggtttcgcatggagtgaaggggtggaataaatcgtgg

SEQ ID NO: 3348 - DNA, 4294 bp, Zea mays
ccccctcgccggtgatggccgcggccccgccggtagccggagaagatattaaagacggcgttgaggtgtgcctgttcgatgaatcagcagatgggttctcgagaactgtgcgcgccatctcggagctcgtcgacatagagcccgaaacagacttccctgaggcggaagttgagcggctctcctcctcaataacgttcctcagagaatggaggcacttctcgtatgagccaaaaagtgtaacattcactaatggcaccgagtccacttcatatagagatgacatgcacagtgtaactttaccacagttttcatctgcttctgttccccagtatcttgctgtttctgcgcatcctcctggttcttcttaccataaacttggcatgcccttaaccgggagaggtatcattcaagtttggtgtctgttagcaccatttgaagattcacattctcaccagccagtgaatgcattcaataatggtaagcaaagaggaaggcctagaaaaataccttgtagtgataagctggtacctgttccaaaaggaccaagggggaggccaaaaaagagatcttacgatgatcagttagaacctgttccgaaaagaccaaggggcagaccaagaaagtatccattaccagttgcaaaatttgaaggttcatctcaaaacggtgaaagtcaggatattattctttttgatcccctttctacttcaagttttattccagatgacctttcattggcttctgtcatgccaactgaaaagtctgtgcaatcaacacctaaaagaggcgctgatgttgaattagggaaagagacaacttgtcagactgcttcatttggctgcagtttggaccacactgcttgcacagagtttaatgccaagttatgtattgttgcagttgatgcagcattgccacctattgacaaactgacctgttcacctggtactgtatcaggagatgtgtgtacagccccaactctaacaactgcaatctgtacaaaacctaagagaccacgggggagacctcgaaagtatccagttcaaatcaatggtagatctgtttcaggcactgttgctgaattaggacaagagtcaacttgtcagccagtttcatttggccacactgtttgcacagagtttaatgctaatttaagtattgttccagttgatgcagcattgccaattgtcgacaaactgtgcagttcatctggtactgtagtaaaagaaagtgtgtgtaccgaaccatctccagcaactgcaactcgtaagcaaccaaagagaacacgggggatgcctcgaaagtattcagacactatgattgacctggggaaagatacaactggtcatcctgttttatttggacgcagtatggatcacactgcttgcacagagtctaactctagttttagcattgttgcagttgatgcatcatcactgtttgcatcttcatctactgcaacttgtgatgataagtcaaaagatgattctgaactgcctatccacatttcacctaaatcaagtaataaaagagagtcaagtggcaggaggggaagaggaaggcctaaaacgataccactttctgctggaactggtcattttgtggcttctgttgccagtctcccaaagacaacctgtgtactgactagttcaagcaatctcacgtcgttgaacaagagtggtggcaaatttatagtaagtagcgttagttcatgtggctgtgatgttgagaaatgcagtgttcattcaggtgttttgttgtctgatgatgcaccaccagcacatggcttacaaaatacaaattgtaaggaagaatcgaataccaaaataggaaaagcgggatctagaaataagcctgttgcagttgagcacaatcattttactgatcttaatgtaaaagaacaaaaagtgcagacaactccaatgtcaggtgatcctgtgatcttggttgaaaattgtatggaaggacaaggccccagaaaggctggggggcaacttcaaaggatacctgcttcaaacaagagtagtggcgcatctgttggtggtggaacatataaaatagagacattatccacaccaatgactaaaggatcatctaaaaataatgacatggcttatggggctggtttgaatcagtctcagaatgcaattgttggttgtgaaggcatggaagttattgaaagcaacactgccaattatacttctcattgtaatgaaaatgcacgagcaaatcaagttgcacccagtttcaagaacagtgatagggtcattgatgaaacggaagctgcggaacttgggccactcaaggaaccaagggaagatgacaatttgtttacttgtgtaaactcaaactcagcttcaattacaagtgacattgctcaaccaagagttgtcttgtgtttagctcacaacggcaaagtcgcttgggacatcaaatggaagcctcctttactaagtcaacctgaacagaaatcacgacttggttttcttgcagtattgttggggaatggcgctcttgaagtgtgggaagttccatcaccatgtatgatccagaaaatatattccccctctaaggtggagggttctgaccctcgttttctaaagctccaacctgtatttaggtgtgtcaaagtgaagtgcaggaacaggcaaagcattcccttgacagttgattggtcaccttctcctcctcatgatatgatattggcgggttgtcatgatggaacggttgctttatggaacttctcgatgaatttgccaacacaagattcaaaaccttttatgtgtgtcactgctgattctgttcccattagagctctctcttgggcaccatatataagtgaagaaagcacagatacctttgtcactgctggagaggatggtctaaagttctgggatttaagagatccataccatcctctttgggagctaactactgctccaagggctgtattaagtcttcattggctaaaagatggaagggggatcattatctcactggaagatggtacattgaagtttctaagcttgcctcggattgcaaatgatgttccagccactggaaggccattttccggaacaaaaactcagggtgttgcaacttatcagttgtcagaatatttgatttggagtgtccatgcttcagaacctacaggttgtgtggcttactgtggggcagatggtactgctgtgtacttccagctaaaatcgagattctgggataaggagcctgggcgtaaccgtgttccttatttcctctgtggatcattatcagaggatggagaaaatattaagattggcagcaggctgcaaacatctccattaccaaatgtgcctgtggggaccaaaaagggttcaaaaccatcccaaagtatagttcaggcgcttgctacaagcgatgtcactagcctgctgacatatcagctcaactcccccacaggaaacaatgatgccgtaaatctagaagctcatgatgatcaagatgatggacgcagcaaagagcaaggagcaggtgctgtaaatcaagaacttgatggtgaacaagatgatggacaccgtgaagaacaagcagcaggcatggtaaccacagaatttggcgatgatcaagccgatggacacagcgaagaacaaggagctggtgcaataatctcagccactcctgcaaaggaagagaatgatggaacatggaacgacaagggtgttcaatcccctaaagaccttaatgtcgtccctccgaattctgtcgctttgaatcaagtgcggtggaacatgaacaagggtagccagagatggctgtgctatggaggtgctgcaggcatcatacgatgccagagaatctgaagagccgcaatctggaatgctcttcgagaaacagaggcttgtcacacagatggtggtaggttctactctattcttttctgctacttttgaccgggtcgccgagggtggttggcttagctgtgcataggggagaaccgatgcaatagacctttgcatcttagaattgcagtccccaggttctgaatacatatggtatggaacctgggtcctgatagttgcggtagtaccagtgcatgcgaacctgagcttttgcgttccattctgtgtaagggcttgttcgtttgtctaggaatggatttggaatcgtttcagctaatcaaaacttatataacttagagaagaaatccagctagaaattgttccctaatgtggttcctaactgttaccttatgatgtgaacagaacatgatgcattcgggaggaaataataaatgccatagtgctcgagattctggttt

SEQ ID NO: 3349 - DNA, 711 bp, Avena sativa
gggcgtttctacttaccagttgtcagaacatttgatatggaatgtccatgtttcagaaattactggttatgcagcttattgcggggcagatggtaccactgtgcgcttccagcttacttcgagattctgggagaaggaacctgggaagaaccgtgtaccttatttcctttgtggttcgttagcagaagagggatccgtcattaagattggtggtacgttgcaacactctcctctaccaaatgttcctcttgttgcaaagaagggtccaaaagcgcaagatatacgaaaagagaaactacaaactatcaccaactcagaatttgtagatccagaacccagagagggtcaactagatgggcctgatgaaggtcaagaaagtaatgcgttagttttagctgatcatctaatgcaagaaaatggtggcatatgcaaaaacacagttgatgaataccctaaagactttgaggtcttccctcccaaatctgtagcactgcatcaattgagatggaacttgaacaaaggtagcgagaaatggttatgctacggaggcgctgcaggcattattcgatgccagaagatctaaaaggcaatcacaagtggtgaatgttcgcaacaaaccaggagaatctgcattatccaccacctacacaataagctgttgcggcatctgctgttacttgcagcaatatattgattcttgtctccgacttt

SEQ ID NO: 3350 - DNA, 1417 bp, Panicum virgatum
  misc_feature (271)..(271): n is a, c, g, or t
  misc_feature (302)..(303): n is a, c, g, or t
  misc_feature (309)..(309): n is a, c, g, or t
  misc_feature (331)..(331): n is a, c, g, or t
  misc_feature (343)..(343): n is a, c, g, or t
  misc_feature (409)..(409): n is a, c, g, or t
  misc_feature (518)..(518): n is a, c, g, or t
  misc_feature (522)..(522): n is a, c, g, or t
  misc_feature (903)..(903): n is a, c, g, or t
  misc_feature (1137)..(1137): n is a, c, g, or t
  misc_feature (1140)..(1140): n is a, c, g, or t
caagattcaaaaccttttatgtgtgtcactgctgaatctggtcccattagagctctttgttgggcaccttatataagtgagaacataaatacctttgttactgctggagctgatggtgtaaagttctgggatttaagagatccgtaccgtcctctttgggagctaactactgctccaagggctgtattaagtgttcagtggttaaaggatggaaggggaattgtcatctcaatggaagatggtacactgaaatttctgagcttggcccggnttgcaaatgatgttccagccactggaaggcnntttgtnggaacaaaaactcagggtgttncaacttatcagntgtcagaatatttgatttggagtgtccatgcctcagacactacaggttgtgctgcttactgtgggncagatggtactgctgtgtgcttccagcttactccaaggttctgggagaaggaacctgggcggaaccgtgttccttatttcctttgtggatcattatcagaggagggagnaaanattaagattggcagcgggcagcaaatgtctccattaccaaatgttccagtggtgaacaaaaagagtacaaaaccgtgccaaaatatagttcagggcctccctgcaagcaatgtcactggcccaccggtatgccagcttaacacccccacaggaaacagggatattgtaaatccagaacttggcgatgatcaagatgatggccatagtgaagagcaaggaacaagtgctgtaaatccagaacttgctgatgatcaagatgatggacacagcaaagaacaaggagcaggtgctgtaaatccagaacttggtgatgaccaaggtggacacagtgaagaaccaggagcaggtgcaatagttttagctggtcctacagagcaagangatgcttactcgttgaacttcaagggtggtgaatcccctaaagacttcgaggtcttccctcccaaatctgttgcattgcatcgagtgcggtggaacgtgaacaaaggtagcgagagatggctgtgctatggaggtgctgcaggcatcatacggtgtcagaggatctagagacaagggcacatttgggcacgctccccgtgaaacaggacaatatgcttacatccataataactnatngtaggttctgttgtattctttctgctacttatgacctgatcacctaggtttgttttcttggttgtgccaaactgttatgtaatcatgtaattatgccagagaaccaatacaacagattttcctatcttaggacctcgcgggggtgctatgtagcatagaatagaagccatcggatctgacttcaatacattggacctggttagaagtcccggttgtgacactagtaccagtgcatgtgaaccgtctttgaaataagcgagtatgattccatttcggg

SEQ ID NO: 3351 - DNA, 607 bp, Panicum virgatum
aagatggatacagcgaagaaaaaggagcaggtgcaatagttttagctggtcctacagagcaagaggatgcaggcacgttgaacagcaagggtgttgaattccctaaagactttgaggtcttccctcccaaatctgttgcattgcatcgagtgcgatggaacgtaaacaaaggtagcgagagatggctatgctacggaggtgctgcaggcatcatacggtgtcagaggatataaagacaagggtacatttggccatgctcctcttgaaacaggacaatatgctcacatagtcacatccttagtaactgatggtaggctctgctgtattctttccccaacttttaacctgatcacacctaggttggttttcttggttgccaaactgttacaatgcaactatgcaagagaaccaatacaacagaatttcttatcctaggagcgcgcggggagctatgtagagcttagaatagaagcgatcagttctgacttctgaatacattgggtctagttagaagtcccggttctaacattgtaccagtgcatgtgaaccatcattgaaatatgcgagtttatgcatttccggtgaaaagaacattgtattgctgatt

SEQ ID NO: 3352 - DNA, 3013 bp, Malus domestica
agcattaacaatcgacgactaccagtgcgagggttcgaagcctacactccaaaccaagagaaaagaaaaaagcagaatattcgaattcgaaaactcggcggcgaggcatgaataatgcagtggaggaggaggtggaagttgaacctccacttgcggtgctattggctccaaaacgcgggaaaacaaccaagaccaagcgaaaatcccaaccagcaacaacatccaatcagcagaacccagagccggagccagttcgaatcgagccggagcctgttcgaattgagccggagcctgttggagttgagccggagggagttcgaattgaggcggagccagttcgaattggggaagaaggctcgaggaatgggtctacggttagagtttcgatgttcgacgactcggtggagaatcacttcagagttatggacaccattgccaaactctgcggcgaggcggaggaggatcgcggcgtcgaagacggcgagattcaacccttatcgtcctcaattacttttctaagggaatgggcagattttaagtacgaacctcgagatgttcgatttgcttgtggagttggaagtcctgagggggaggatgtcgtcggtgggataaacttgcggcaattttcttctgcaacagttcctaagaacgaggcactttctggggtcgcacaatctccggagttgagccaagactttttgatgtatgttggagggcctgtttgggcgttagattggtgtcctagagttcatcaaagtagcgatggtcatccaaaatgcgagtttattgccgtagctgctcatcctcctggatcttcttatcacaaattaggcgagccactgactgggagaggtgccattcagatatggtgtcttttaaatgctggtgtaaataaggaagacgaacattcaatagcggaaaagcaaaagcagggccgtaagaacagtggagctagacaagaaaattcaactgaaccaaagaagcctttagggaggcctagaaagaagccaatagaagaaaaatcaactgaaccaaagaggcctagaggaagacctagaaagaagccaattgaagaatctgctgacaaagaggccacagaagaaaaatcaactcgaccaaagaggcctagaggaagacctaaaaagtatgcagtagaagattatgttgacaacttggatgagagcaatgattatgttgaggttcttgccatcgaatatccagagggatcactagagttgccttctatggattgtgttcctgcaaatactcatgtgcatgttgtacaagaagatcatggtaaaaaacgaaagaatcatcacacacagcagaattctggacatgatcctcaaacaagcaaaaatgttcaaaataatggttactctgaaactggctcaaccaggtgttcagttccgacagatgtagcattgccacgaattgtattatgcctggctcaccatggaaaggttgcttgggatgtgaaatggcgtcctcttaatgaacgtgattccaaaagcaagtatcggatgggctatcttgctgtgctgtcaggaaatgggtctctggaagtgtgggatgttcctcttcctcgtgcaattgaagttatttattcttcttcatgtggtgagggcactgatcctcgctttgtaaaattagcaccagttttcagatgctcaatgttgaagtgtggtggtgaaaagagcatccctcttactgtggaatggtcaccttcaccaccttatgattacctacttgttggatgccatgatggaacggttgctttatggaagttttcagcaagtaatgcatctcaagatacaaggcctttactttgcttcagtgcagatacaaatccaattagggcacttgcttgggccccggctgaaagcaattcagagggtgcccatcttatagctactggtggacatggaggcctaaaattttgggacctgcgtgatccattccgtccgttgtgggacctcgatcatttaccaaggttcatatatagtctgaattggcttccagatccaaggtgtgttcttttatcctttgatgatggaacaatgaaagctatcagcttggtgaaggctgcatccgatgaccctgtaacaggaagggttgggacaaaacaacctggcctgcataatctcagctgtttgccttttgctatctggagtgttcatgcctcgcaattaacaggtatggttgcatattgtggtgcagacggaactgttcttcgcttccagacacttttcagtcgtggaggtaaattcttgagttatagacgctatttgagtgtgtctaaaatttttagtaacatcagacctgcgcttacaactaaatctctggagaaagatcctcgacgaaaccgagccccgcattttctgtgtgtgtcattgacaatggaggaatctgctgtaatcatcaatactccagtatcaaattcccctttcccactgaaggtagctcgtaacaatgccgagtcaaacaaagtgaaaactactaatgataagatggcaaaagataacacatctgaagatcaaagtttagctctttgttacggtgatgatccaggtattgaattggaaggtgggggagaagtggcacctctcaaaagcaaaaaaacacagaaatccaagtccagtacgaaaaagccagatgatgaccaggcattggtatgcatagatgaagagccgactgctgcacaggaagaagaaactggggtggcttctctcgacggcaaaaaaacaaagaaatcaaagtccagtaagaaaaatgcggatgatgaccaagcattggtatgcatggatgaagagccgactaatcgagaagaagaaaccgtgaaagagccagaagtttttcctgacaagacagtagcaatgcatagagtgagatggaacatgaacaagggtagtgagagatggctgtgttatggaggggcagccggaattattcggtgtcaagagatagttttgtccgacgtcgatagggcgtgggcagcaaagagatgagaagc

SEQ ID NO: 3353 - DNA, 4293 bp, Theobroma cacao
acaatcggtcttgggttcgaatctggaaaccctaacaaaagaaagaagaagcttcccgcatttcaaaaagaagtcacgattttccctccattttcttttctcgttgcatatctatctcctaacagaaattccactacaagtcgagtggccggggcaagtcgcggttcgtgtcttacggaaagctctctcccgtttctcaggttaatgttgggcactctaagtcttacttacacacacacacacacaccactgaggaactaatggactatggagagagatagctgtcaaggaagctggggaaacagatggagtagacccttcaatctttttttcccctaagctaaagactcttaaattgttgaacaacaatttatattacagcttaaatatgcatcttagtaattaccaacattctgttaccatcgttaacacaattggggcaggatgtagtttttcaaaattaatgtccttgaatgtaattatagtcaaaactcaaggagttctttgtaatttgcgcaaaattcaacatcaaactatattgtttattgcctattagagttaggctcctgcatatcatctctataacaatgctttgcattatagttaaggtaccacatcaaacaatttttttttaattaattctttttgaaagttcaaatacgaaatttagcattagattttagtttatgtactatttcttataatcaattctttagcattatatgccttgtatttgagtggttgacaatagatgcgttgtgatgttgtggataaaagagaaagagaaagagaaaatggaagaacccttaaaaggcaggccaggagttagggtctctatatttgattgttcaatagagaatcattttagggcgatggatacaatctctaagctttgtgaagagcctgagagtgatggtcccgatgaaactgatatccagcgattctcttcttcaatcactttcttaagggaatggaggcatttcaattatgaaccaaggatcattaagtttgctagtgaagtaggagactcacagggtaaagatgtttctgattgcatacagttacctcaattttcatcagcaactgttctcaaggtgaaagaaaatcttcaacgggaaggactaaatggaaaagcatctccaaaatcctgcctgtattacaacaccattgcaaatgaggtctgtcatatacattttttgaataacatgattaaagttcaatctacttgcagcaaggacttcgtgatgtatgttggagggtctgtttgggcattagattggtgtcctagagttcatgagaatcctaacagtactgtcaaatgcgagttcattgctgtcgctgctcatcctcctgattcttattatcacaagataggtaccccacttactggtagaggcatcattcaaatatggtgtatgctaaatgttggggtggaggaggaagaggctcctctttcaaagaaaaggccaaaatggagatctcaaactacagaagccatggaggagagcccatcaaagaggcctagaggaagacctagaaagaatccaatagatgaatctcaaccagataaggttaagaggccaaaaggtagacctagaaagaaaccaattggtgaatctcttaatgatgatcagaatgaacagtctttcctgcctcttgctgttcagtacccagaaggttcctttaagccagttgctatagacagtgcacttggaaatacacaagaaaatgctccaaataagagccatcatgaaaaagaaaaaggtgaaaaagagggagcatttacatctgatgcaacccctacgacttctgtgcagagtagaaaattgaaaagtaaggtgcaggcaaaaactaatactcatggttcttctattccaagggacattgagctgccaagaactgtcctctgcctagcacacaatggaaaagttgcttgggatgtaaaatggcagccttatgacataaatgattgtgaatgcaatcagcggatgggctatcttgctgtcttactgggaaatggatctctggaagtgtgggaggttcctcttcctcatatgatcagcattgtttattcatcttcacctaagcagggtactgatcctcgctttgtaaagttggagccagttttcaagtgctcaaagttaaaatgtggtgatgtacagaggcgaaagaacaatagcaatgaaaggctctgctatgttgttcagtgttcaccctgtcctattttatggctagttgatatattggatgcacctagaggctcggacttgttatacagcatccctttgacagttgagtggtcaacctcacctccacacaattacttactggctgggtgccatgatggaatggttgctttgtggaagttctctgcaagtggttcacctacagatacaagacctctactttgttttagtgcagatacagttccaattagatcggttgcatgggccccatctggaagtgacatggagagtgcaaatgttgttcttactgctggacatggaggtctaaagttttgggacatacgtgatccattccttcccttgtgggatgtccatccagcaccaaagttcatatatagcctggattggctgccagaaccaagatgtgttattctatccttcgatgatggaacaatgaaaatgctcagcttaattcaggcagcatgtgatgtacctgtcactggaaaacctttcactgggaccaagcaacaaggactgcacctttataattgttcatcctttgctatctggaatgtacaagtgtcacgattaacaggcatggttgcatattgcggtgcagatggtaatgttacccgctttcagcttacatcgaaagcagtggacaaagatttttcacgaaatcgagccccgcattttgtctgtggatccttgactgaggaggaatctgctattgtagttaacactccattaccagatattcctttgacgttgaagaagcagactaatgattatggagagggcccaagatccatgcgggccttcttaactgagtcaaatcaggctaaaaatgccaaggataataaggcaaaagttccaactcctgataaacaaactttagccctttgttatggcaatgatcctggtgtggaatctgaatctgaggaaaccttaaccttggcagctcttaaaggcaaaataaaacaaaaatcaaagagtgacaggatgaagaaagcaggtgacgatcaagcattggcagtcaggattaatgaaccagcaaatacacagaaagaagaagctgggaatgaaatagaagtatttcctcccaagattgtggcgatgcatcgagtgagatggaacatgaacaagggtagtgagaggtggttgtgctatggaggagcagctgggattgttcgatgccaagagattatagtgcctgatgttgctaagaaatcagcaagaaaaagttaaaaagggttaggagcttcaacattttggcaaagtcaactggcaacggtaacgtccatattcataatagcagcccttctttttcctctttattttcattcaagaacctctttgtcacaagctttcagacgacaataaccatttagctaactaaaacagaaacaatgttacatatgcctcacatcaatgatcaatcgattagataattagaaaggaacatttacagctgaaggtgtgccttgttttacttggatttgtgattaagggggaagaacatggtcatccttaactctatcttgtacctctatggtggcaacaacaatcacattttcttcaaatcaacctccccaggtccaatattcacatctatacagacattgtggttttatcacaatcacaggtcatttgaagtttaaactttcatagaatcaatcattttaatgagaaagtagagcataaatacctttacgattgcattccacttggtcagatgcttgttgaaaagaaccgctatgaggagctaaccggagagggtgaccaaggatttctctaaggtggttagggatgctgaaaactttgtaaatacaagcaacttaattagaggcttaccctgtatgtgactttctcggaaccatcataatggtctcgcatgtctaaagatgcaatggacaggacaggagaatcagagtaaacatattcttgagcttaattggcacaagatttgttcacctacttatatcaactgctaagcgcagagtttgacatgcagggcaggaaactccataatgatcatactgactactatccttttagtttggaggtctttgtcatggtacgatcccaatatagccaaaaattaaag

SEQ ID NO: 3354 - DNA, 2513 bp, Citrus clementina
tttctttttttggacgctaaagaaagaaaatggaggaagaatcctcaggaggcaatgatacaggagttcgagtatcaatatttgattattcggttgataagcattttaatgcactcgacactatttctaaactctgtgaagagccagaaagtgaaggccttgatgaaagcgatgttcaacgattatcctccacggttacttttttaagagaatggagatatttcaattacagaccaagaaccgttaggtttgcaaacgagatgggaagttgtggggaaaagaatgttttaagtgagattaacttgcctcaattttcatctgcagcagttcctgaggtacatcagttgagattttttatgttcttttacaaagactttgtgatatatgctggggggtctgtctgggcattggattggtgtcccagagttcatgaaaagcctgactgccaggtcaaatgtgagtttattgctgttgctgctcatcctcctgaatcatgttatcacaaattaggtgctccacttactggcagaggcatgattcagatttggtgtatgctaaatgttggtgtaaatgaggaagaggcacggtcacccaagagaaacctaaaacgaaaatctcaaaattttgaagactcagatgacaaaacaaagagaccaagagggagaccaagaaaaaagccaacagatgaagctcttgatgattatgctacaaaggacaagttaacgcaatcaaagaggccaagaggaagacctagaaaaaaaccaaaagatgaatctagtggcaacttggatggtgttgaacaagcagaaagattgaaacaactttctgtgattttctttccaaaccaagcttggtttcttgtcctataccaaaggacattgctcttcctagggttgtattgtgcctggcccacaatggaaaagttgcatgggatgtgaaatggaagccatataatgcagtagattgcaagtgcaagcaacggctggggtatcttgctgtcttgctgggaaatggatcccttgaagtttgggaggttcctcttctccggacaatgaaagctatttatttgtcttccatgaaagaggggactgatcctcgcttcgtaaaattggaaccagtattcagatgctccatgttaaaatgtggtggcactcagagcatccctttgacaatggagtggtcaacctcacctccacatgattacttactggcagggtgccatgatgggacggtcgctttgtggaaatttgttgcaagtgattcatctatagattcaagacctttgctctgttttagtgccgatacacttcctattagagcagtttcatgggccccggctgagagtgattcggatagtgcaaatgttatactcactgctggacatggaggcctaaagttttgggacatacgtgacccattccgtcccttgtgggacatccatccagcgccaaagttcatatatggtctggattggttgccagatccaggatgtgttattttatcctttgatgatggagcaatgaggatagtcagcttgttgaaggctgcatatgatgtccccgctacaggaaaaccttttgctgggacaaagcagcaagggttgcaccttgttaattgttcatcctttgctatctggagtgtgcaagtgtcacggctaacaggcatggtcgcatactgcagtgcagatggtaccgttcatcgtttccagctcacagcgaaagcagttgaaaaagatcattcacgaaaccgccccatgcattttctgtgtggatccgtgactgaggatgaatcagctattacagtgaacactccattagacaatactccagtaccactgaagaagacagttcatgatgctggggaaagatccatgcgaagtttcttgattgagtcaaattcatccaaaagtccaaatgataagaaggggaaaaatgttttaagctcagataatcaacctttagccctttgttatggcaatgaaccaggtgaagaatctgaaggtgatatgacattggcagctcttaagaacaaacaaaaaccaaaatccagaagtagcagtaaaaaaaaggaggaagatgatcaagcgatggtgtgtatagatgaagaggcaatggatatacaggggaaggaaaatgaaaaaggagaagctgggaacggaatagaagttttacctcctaaagttgtagccatgcatcgagtgagatggaacatgaacaaaggcagtgagagatggctatgctacggaggagctggtggaattattcgatgtcaggaaattagagtacctgatattgataagaagatggggaagaagatacagaaatgatcatgaacattaacgtccgggtattttattatcatgcccacaagtggtcttcttatcacgtttatcctgatttttattttcaattgaatctcttaacaaaaattctttaaagtttatgatgatgtagctgttggtttatgtaagtaatatatatattttagtaaatgaataatcctacatttacaaa

SEQ ID NO: 3355 - DNA, 907 bp, Gossypium hirsutum
aggcatggttgcatattgtggggcagatggtactgccacgtactttcagctaacctcaaaagcagtggacaaagatttttcacgaaatcgatcgccgcattttgcatgtggatccttgaccgaggaggaacctgctgtaatagttaacactccattaccagataatcctttgccgttgaagaagccgagtagtgagtgcggggacggccaaagatccatgcgttacttcttaaccgagtcacttggcaaaaatgcaaaggataggaaagcgaaggttccaacttccaatcagcgaactttagccctttatgatggcaacgatcccagcgtggaatctgaacccgaggaaacattggcagctctgaaaagcaaaatgaaaccaaaatctaaaagtgagcgaactttagccctttgttctggcaacgatcccagcttggaatctgaacccgaggaaacattggcagctctgaaaagcaaaatgaacccaaactctaaaagtgacggcaagaagaaagccaacgatagtcaagcattggcacaaggaaccaaagaagcaacgaataaagagagagaagaaaccgaaaaagaaggtgaaagccaaatggagacatttcctcccaagattgtggcaatgcatagagtgagatggaacatgaacaagggtagtgagagatggttgtgctatggcggagcagccgggattgttcgatgtcaagaaattacagtgcgtgatgttgatacgaagttaaccagaaaacgttaaaacaacgctacgaactgtgcctgtagcattgtggcaattatgtacatatttaatttaatggcccttttcccccctttatttcttttaggtcaaattgagctagccttgggaagcctagtgtgcattccttgaattgaagtggat

SEQ ID NO: 3356 - DNA, 1340 bp, Eucalyptus grandis
atggttgcctatagtggtgctgatggaaacgtttgccaattccagctcacctccaaggcagtggacaaggatccatcacgacatcgagccccacatttcctgtgtgtgtctgttgcagaggagggatcggccattgtacttaacatgtcaccatcagatactcctgtcacactaggaaaacaacttaagggaaccccaagttcaacgcatgaaatgctatctgcatctcctgaggtggaagaagccatggaaaacgaggataaaggaccaactcctgatgaccaaatactagcactgtgctatggtgatgatccaagtgtggaaacgggatgggaggagacattggcatctttcaagagcaaaaagaaccaaacatctgggaagcttaataagaaaaggccgcgggttgagatgcaaagggacaaagagccagagacagttcctgagggagcagaaaatgcggttactttgacagaatttgagacttttcctcctaagattgtggcgatgcacagggtgagatggaacatgaataaaggcagtgagaaatggttatgctctggtggtgctgccggaatattgaggtgtcaacagataaatacgttgagtacagatcgtaaatcaaaatggaaatgaggaaacagagattttcaccagtctggtaatttgaggcttcatattcagtttttggtgccgatgcaaatacgtgatatagcgtttccctctttgggtcagtaaatatgcatcaaagcttatcttggaggtttcttgaagattatagttaagcttgcccgttgtcggcatggaacaacacttgctacagtggaagatttcttattgtatctcattgatttttcagaaaggctatgaccgtcggttgtaaatgggtctatataagactaagaggatgcgtctggcaatgtcgagagatacagagcccaacttagctcattgtgactcaggttacgacaggcaagataatttttttaagtcacttgccaatacatattcaggtatgctacatgaaacaagatgaagggattggaagaagtctcttatatcattggcataaagatccatagagatagatctcaaagatcattaggaatatctcgaaagggtctccattcaacgtaggattcttttcctaagttactggaattttgatcggttataaagtaggatcatgtggagcatatggaaattgttatttcatcaagtatttgccgtacatttttttatcgtggggacgttatgtcgatgttctcggaactaaatattactacgccaacgtttatttgcctgagttcatttcccaacttttctatgaaattacttgc

SEQ ID NO: 3357 - DNA, 2613 bp, Eucalyptus grandis
tccgtattatttcgcagcaaggattttgtcatatatgttggaggttcaatttgggctctggattggtgtcccagagtttgccacagacctgaatatcagactaaaaatgagttcatagctgttgctgctcatcctcggggatcttctcagcacaaattgggtgccccgcttactggcagaggtgtcattcaaatatggtctcttcttaacataagtggagatggggaagaggcatctttagtggacaagcctagacaaaggcgtgcaaattcacaatccctaaaagagaaatcatctcagcctccaagacctaggggaagacctagaaagaagcccttagaaagaccttctgatgactcgaattgcaacagtcaattcggtcagcctctggctggtgactttccggagaagacaccggtatcatatactttagatggggtttctggggttctcagtgcacaaattgcagggaaagattctggccaaaaaagaagaagtagcgaagcagcagcatccccaaatactggtagaaggttagataatgtcggtggtgtggaaagctgtcatgtcaatgaacatgtgtcaataatgacggaaaatgaggaaagattcttgccctgcataaatcagcaaggtcaatctggctttagagcgtgttctgcaggaaataatgctgttggaagttatagcagatcgagttctggtactttaatatcggaggatgttgccgcaccaaggttggtgttttgcttttctcacaatggaaaagttgcgtgggatgtgaaatggcggccatttgatatgcatgaaaccaaatgcacacatctgatgggctatctagccgttgtgctggggaatgggtctatagaagtgtgggaggttccattgcctcaaacggtgaaagttatttattcttctactcagagggaggatactgatcctcgctttataaaactggagccagtatttagatgctcgacacttaaatctggtggcatacagagcatcccgctgtctgtggaatggtcgacttctcacccacatgaatatttgcttgttgggtgccatgatggaacggtagctttgtggaaattctttgcaagtaattcatccaaagatacaaggcctttgcttcatttcactgcagatacagttcctgtcagagcagttgcttgggccccttttggaagtgatcccgagagtgtaaatgtcatagtcactgctggacatggaggcattaagttctgggacatgcgtgatccatttcatcccttgtggcacattcattctgcacccaagaatatccttagcattgattggctgccagatcctagatgtgttcttttatcatttgatgatggaacagtgagattgcttagcttgtcaaggtctgcatatgatggtcctgtcactggaaaacctctcagtagcacgaaacaaaggttgcatacattgtactgttcatcttttgccatctggagtgttcacgtctcaagacatactgggatggttgcctatagtggtgctgatggaaacgtttgccaattccagctcacctccaaggcagtggacaaggatccatcacgacatcgagccccacatttcctgtgtgtgtctgttgcagaggagggatcggccattgtacttaacatgtcgccatcagatactcctgtcacactaggaaaacaacttaaggggaccccaagttcaacgcatgaaatgctatctgcatctcttgaggtggaagaagccatggaaaacgaggaggaaggaccaactcctgatgaccaaatactagcactgtgctatggtgatgatccaagtgtggaaacgggctgggaggagacattggcatctttcaagagcaaaaagaaccaatcctctgggaagcttaataagaaaaggccgcgggttgagatccaaagggccaaagagccagagacagttcctgagggagcagaaaatgcggttacttcgacagaatttgagacttttcctcctaagattgtggcgatgcacagggtgagatggaacatgaataaaggcagtgagaaatggttatgctctggtggtgctgctggaatattgaggtgtcaacagataaatacgttgagtacagatcgtaaatcaaaatggaaatgaggaaacagagattttcaccagtctggtaatttgaggcttcatattcagtttttggtgccgatgcaaatacgtgatatagcgtttccctctttgggtcagtaaatatgcatcaaagcttatcttggaggtttcttgaagattatagttaagcttgcccgttgtcggcatggaacaacacttgctacagtggaagatttcttattgtatctcattgatttttcagaaaggctatgaccgtcggttgtaaatgggtctatataagactaagaggatgcgtctggcaatgtcgagagatacagagcccaacttagctcattgtgactcaggttacgacaggcaagataatttttttaagtcacttgccaatacatattcaggtatgctacatgaaacaagatgaagggattggaagaagtctcttatatcattggcataaagatccatagagatagatctcaaagatcattagga

SEQ ID NO: 3358 - DNA, 2512 bp, Citrus sinensis
tttctttttttggacgctaaagaaagaaaatggaggaagaatcctcaggaggcaatgatacaggagttcgagtatcaatatttgattattcggttgataagcattttaatgcactcgacactatttctaaactctgtgaagagccagaaagtgaaggccttgatgaaagcgatgttcaacaattatcctccacggttacttttttaagagaatggagatatttcaattacagaccaagaaccgttaggtttgcaaaagagatgggaagttgtggggaaaagaatgttttaagtgagattaacttgcctcaattttcatctgcagcagttcctgaggtacatcagttgagattttttatgttcttttacaaagactttgtgatatatgctggggggtctgtctgggcattggattggtgtcccagagttcatgaaaagcctgactgccaggtcaaatgtgagtttattgctgttgctgctcatcctcctgaatcatgttatcacaaattaggtgctccacttactggcagaggcatgattcagatttggtgtatgctaaatgttggtgtaaatgaggaagaggcacggtcacccaagagaaacctaaaacaaaaatctcaaaattttgaagactcagatgacaaaacaaagagaccaagagggagaccaagaaaaaagccaacagatgaagctcttgatgattatgctacaaaggacaagttaacgcaatcaaagaggccaagaggaagacctagaaaaaaaccaaaagatgaatctagtggcaacttggatggtgttgaacaagcagaatattgaaacaactttctgtgattttctttccaaaccaagcttggtttcttgtcctataccaaaggacattgctcttcctagggttgtattgtgcctggcccacaatggaaaagttgcatgggatgtgaaatggaagccatataatgcagtagattgcaagtgcaagcaacggctggggtatcttgctgtcttgctgggaaatggatcccttgaagtttgggaggttcctcttctccggacaatgaaagctatttatttgtcttccatgaaagaggggactgatcctcgcttcgtaaaattggaaccagtattcagatgctccatgttaaaatgtggtggcacacagagcatccctttgacaatggagtggtcaacctcacctccacatgattacttactggcagggtgccatgatgggacggtcgctttgtggaaatttgttgcaagtgattcatctatagattcaagacctttgctctgttttagtgccgatacacttcctattagagcagtttcatgggccccggctgagagtgattcggatagtgcaaatgttatactcactgctggacatggaggcctaaagttttgggacatacgtgacccattccgtcccttgtgggacatccatccagctccaaagttcatatatggtctggattggttgccagatccagggtgtgttattttatcctttgatgatggagcaatgaggatagtcagcttgttgaaggctgcatatgatgtccccgctacaggaaaaccttttgctgggacaaagcagcaagggttgcaccttgttaattgttcatcctttgctatctggagtgtgcaagtgtcacggctaacaggcatggtcgcatactgcagtgcagatggcaccgttcatcgtttccagctcacagcgaaagcagttgaaaaagatcattcacgaaaccgccccatgcattttctgtgtggatccgtgactgaggatgaatcagctattacagtgaacactccattagacaatactccagtaccactgaagaagacagttcatgatgctggggaaagatccatgcgaagtttcttgattgagtcaaattcatccaaaagtccaaatgataagaaggggaaaaatgttttaagctcagataatcaacctttagccctttgttatggcaatgaaccaggtgaagaatctgaaggtgatatgacattggcagctcttaagaacaaacaaaaaccaaaatccagaagtagcagtaaaaaaaaggaggaagatgatcaagcgatggtgtgtatagatgaagaggcaacggatatacaggggaaggaaaatgaaaaaggagaagctgggaacggaatagaagttctacctcctaaagttgtagccatgcatcgagtgagatggaacatgaacaaaggcagtgagagatggctatgctacggaggagctggtggaattattcgatgtcaggaaattagagtacctgatattgataagaagatggggaagaagatacagaaatgatcatgaacattaacgtccgggtattttattatcatgcccacaagtggtcttcttatcacgtttatcctgatttttattttcaattgaatctcttaacaaaaattctttaaagtttatgatgatgtagctgttggtttatgtaagtaatatatatattttagtaaatgaataatcctacatttacaaa

SEQ ID NO: 3359 - DNA, 649 bp, Silene vulgaris
gccatatggagcattctaggttgcacgagaaccagggtctgtagtcagattgcggtgctgatggagctgggtagatttcagggaacccacaaagcagttgataaagatcccataaggaaccgggcaccacactttctctggggttctgtggcagtgtaaggattcagcagttacagtaaatactgaattaccaagttctccacataaaatgaagaagtcagctacggaatggtcaaatacgcctagatctgctcggactgttgcatctggtttacattatggaaaaagagttaagaaaggcgctgagaaaaaccctaatcaaggtgaagaagttcttgcattgtgtgatggtgatgatgctgaacctggagtggcaaatgatgccggaaagaaggataaagcacagagtgaagttgaagagccacctccgaagttgcaggccatgtatagagtaagatggaatatgaataaggggagtgagagatggttatgttatggtggtgccgcaggtattgtgcggtgccaggagattgtaatccctcaatttgataagaaactttaaagaggtgatctctatatgtacattattgccttattggcatgtaactgactaacttctacacaatttggtaatttatgggctataaaa

SEQ ID NO: 3360 - DNA, 3574 bp, Fragaria vesca
ctactcttggcctctcttctcttcatcttcatcatcatcatcaggtctccaacaagcccaagaccaagaccacttgctcagcctcacaagatattggtcataaaccgcaacaagaagccgaattagatgtgtttgatcagttcagtccaaatgaaaaaccctttgatcttcattcagtataaagaagaaccctcgttttgagtatagtccaaaatagagctttgaatggtaaagcagaggcctttgaattcacaaatgtttggactgtgtttagctttaacttggctcctgtagaaatgctcagcagtgtgagagtgtatctagtaatggcatcaccacgcctctcatccgggttcgacatctaagcctcaatcaagcaaggctgcttggcaatttgatatagggtacagaagattggactatgtttccggcgagcccagagcttgatggtggctttttctggaagctctcttccttctaaacacattccttgcagttggaaggtggattgaggttcctccttgcaggcggcgactgtggacgattccggccaattccgactgaattggtttgactcccagggtttgaacccggatcctgaaacaaatagagtaaaagctatacttgtcaaagaagaagagagggagatataaatgaagagggagtggaacctccccttggggttctgttgggtcgcaagcgcaggaaaaccaagttggccaagagaccaagccaggcaactgagcctgttcaaatggcaccggaaggggcggagccggttcaaattgagccggtgcctgttcctgttgagccggaaaactcgagaaatggccctcctagggttagtgtttccatgttcgatgactcagtggagaatcacttcagagtcatgcacaagatttctgagctctgtggtgaagccgaagatgagctgctgccagagaccgagcttcaacgcttacaatcgtccaccactttcctctgggagtgggcagattttaagtatgaacccagggatgttcaattcgcttgcgaagcaggaagcccaaatgaggaggatgttatcagtgggataaacttgcggcagttttcctctgcatctgttccacagaatgaggcgtgggacacatcctctccagagttgagccaagactttgtgatgtatgttggagggcctgtttgggcattggattggtgtcctagagttcatgaaagtcatgactgtcctgccaaatgtgagtttattgccgtagctgcccatcccccaggatcttcttatcacaagttaggtgagccgcttactggcagaggtgccattcagatttggtgtcttctaaatgctagtgtaaatgatgaaggtgttcctataggagagaaaccaaaaggaggaactaaaaggagtgcagctataactgaacaaataaggcctttaggaagacccataaagaagccaatagaagaatctgttggcaaaaaggccacagaagaaaagctaactgagccaaaaaggcctagaggaagacctagaaagaagccaatagaagaagctattgacaaagaggccaaggaaaaaaaatcaactgaaccaaagaagcctagaagacccagaaagaaatcaatagaagaatatgttgacaacttggatgggacaaccaattgtgttgaggttcttgctattgattttccaaatgaatcatccaagttgcattctacggattgtgttcctgcaactactcaaggaaatgatatacaagatcatgacaaaaaactatcaactcatgatggaaaacaagaaagttctggatggaaaccaaataataatgttaccaataatggttatgctgaaaatggctcaaccagttgttcagttccaaaggatgtagcagtgccaagaatcatattctgcctagctcaccatggaaaggttgcttgggatgtgaaatggcgtcctcttaatgatgattccagatgcaagcatcgattgggctatcttgctgttttgttagggaatggatctctggaagtgtgggaggttcctgttcctcgtgcaattgaagttatttattcttcttcatctggagagggaactgatcctcgctttgtaaaactagcaccagtatttagatgctcaatgttgaagtctggtgacaaaaaaagcatccctcttactgtggaatggtcagcttcaccacctcacgattacttaatggctggatgccatgatggaactgtcgctatgtggaagttttcagctagtaatgcatctcaagatacaagacctttactttgtttcagtgcagatacaaatcctattagggcactttcttgggccccagttgaaagcaattcagatggtgcaaatgttatagctactgctggccatggaggcctaaaattttgggacctacgtgatccattccgtcccttgtgggacatcgatcatataccaaggttcatatatagtctggattggctttcagatccaaggtgtgttctgctctcctttgatgacggaacaatgaggcttctcagcttgacgaaggttgcctctgatgcccctgcgacagggaaaccctttgctggaacaaaacagcagggcctgcacaatcttggttgtttgccttttgctatctggagtgttcaagtatcaagactaacaggtatggttgcatattgtggtgcagatggaactgttctgcgcttccagcttacgtccaaagctgtggagaaagatgcttcatgaaaccgggccccacattttctgtgcgtgtcagtgactgaagaggactctgtcataaccatcaaaaccccagtaccaaataatcctttcccattgaaaacatctcgtaaagctgagccaaacaaggtgaagagagaacatgataagatggcaactacatcaggagataaagttctagcatctcttagaagcaaaccacgctcatctggggataaccaagctttagtatgcatggatcaagagcaatttaatactcaggaagaagaaattggagaaaagagtacatctcttaaaagcattataaaacagaaatctaagtctggtcagaaaattacagaggatgatcaagaaccggtgtgcagagatgaagagctgattaatacacagagggaaaaaaatgggacggagtatgaagtttttccttccaatctagtagcaatgcatagagtgagatggaacatgaacaagggtagtgagagatggttgtgctatggaggggcagctggaatcgtacgttgtcaagagattgatttgtctgagattgatacgaaatgggcaaggaagaaatgagaagccatgtttactgtgtttccttcttcttagcctatttatgttggatcgagtggttttgcaggagccaggagagatgacacgataacgagacagctaattgtgggtgtatatagattagaattgtctgttgattgattaacttcctgcatatgtatgtaaatgagtgtagtttgaaattctgtctagttagaaagctatactcgttttacggattttagtggccacatgtgaaatcaaaggcctaccacctgcgttatgaaa

SEQ ID NO: 3361 - DNA, 1549 bp, Tripterygium wilfordii
gcttgggatgtgaaatggagaccacttaaagagtcagattttagatgcatacatcggatgggctatctagctgctttgctagggaatggatctttagaagtgtgggatgtacctcttccgcatgccatgaaatctatatattcttcttcttgcaaggagggaacggatcctcgctttgtaaaactggaacctgtatttagatgctcaatggtgaagtctggcggtattcagagcatacccttgacagtagaatggtcaacttcatccctccaagattacttgcttgctggatgccacgatggaacggttgcattgtggaagttctctgcaggtggttcatctggagatacaaaacctttgctttgtttcagtgcggatacattccccatcagagcagttgcatgggctccagttggaagtgatccagagggtgcaaatgttattttaactgctggacatggaagcatgaagttttgggacattcgtgacccttttcgtcccttgtgggatattcatccagcaccaaggtttatctacagtttggactggctgccagatccaagttgtgttattttgtcccttgacgatggaacgatgaggctccttagctttgtcaagtctgcatatgatgtcccagttcatggaaaacttactgttgggcctaaacaactaggactgcatacgtttaattgctcatcctttgctatctggaatgttcaagtgtcgaggctaactggcatggttgcatactgcagtgcagatggtactgccacccgcttccagctcacacgtaaagcagtggaaaaggatttttcacgaaatcgggcccctcattttgtgtgtggatccctgtgtgtggatgaatctgctcttgtggtttgctcttcgttagcggatacagctttaaccttgaagaagccaacgaatgatagtgcggagaccccaagatccatgcgggatttcttgttaccaccaaatcatcttaaacggtgtaatgataagaaggccaaaggtccaattctagatgatgacacattagccctttgttatggagatgatcctggtacggaatgtggcactgatgaaactttggcctcctgcaagagcaaaacgagaccaaaatccgagagtagtaagaaaaatgcaaaggatgatgaagcattgttatgcagggatgaggatagcagtaagaaaaaggcaaaggacgatcaaggatttgtatgtgaagatgaagagccagatatgcatgacaaagaaaacggaaaagggggaaaagtaatcaaactgaagatttcccttccaaaacggttgcaatgcatagagtgagatggaatatgaacaagggcagtgagagatggttgtgctatggaggagcagcaggcattgtacggtgtcaagagattatgacatctcatgcagcctggagatgagacgagtctccagtgttaaatcatgtcatgtttccagtcgccagtgttagacaactaaggcctgtgtgccttattgttttttttactttgagccttgctcctatttgtttatgctaagg

SEQ ID NO: 3362 - DNA, 397 bp, Malus domestica
atccaggtattgaattggaaggtgggggagaagtggcacctctcaaaagcaaaaaaacacagaaatccaagtccagtacgaaaaagccagatgatgaccaggcattggtatgcatagatgaagagccgactgctgcacaggaagaagaaactggggtggcttctctcgacggcaaaaaaacaaagaaatcaaagtccagtaagaaaaatgcggatgatgaccaagcattggtatgcatggatgaagagccgactaatcgagaagaagaaaccgtgaaagagccagaagtttttcctgacaagacagtagcaatgcatagagtgagatggaacatgaacaagggtagtgagagatggctgtgttatggaggggcagccggaattattcggtgtcaaga

SEQ ID NO: 3363 - DNA, 3934 bp, Arabidopsis lyrata
agaagatataaagcgacggagcagactcttttcctttctccctcctctcctgagaagaagaagtaaagaagtaagatcaattctcagccgtagttagttattctccgattaggtttccgattctctgtttctcctagagtgaatttcaaaaccctaattttgatctttcatatgggagaacaatccccttctcaaccatcgactcaatcccaaagtcgaccacaatcacccaaacccgatacgcataacctaattccgccggaatccaccgatgcatgcatcgattcagccggagtttcgggctcaatcgtctcatcgaccacaatcgacgctggacggatcactgaactaggcaatgtatcgtctccgccgtccaaaatccctctccgccctcggaaaatccggaaacttacactcgacggagacgtctccggtgaagactataaggcggaggatatctcctctcaagtaacctcaccgctcgcgactggaaaatctcccggtaaaggtaaattatcgcagtcacgagttataactgtgccgaggatccaagctcggcctctgacatgtgaaggcgagcttgaaacagcgattcactatctccgtaatgcggatcctttgctcgccgcgttaatcgacgttcatccaccgccgacgtttgagtcgttcaagactccgtttttagcgctgatacgaagcattctctaccaacagcttgctactaaagctgggaattcaatctatacacgatttgttgctctctgtggcggcgaaaatgtggttgtccctgagactgtcttagcattaaatcctcagcagcttcgtcaaatcggcgtctcaggacgtaaggcgagttatcttcatgatctagctagaaagtatcaaaacggaatcttgtcggattcggcgattttgaacatggatgagaagtctttgttcactatgttaacaatggttaatggaattgggtcatggtctgttcatatgttcatgataaattctcttcatagaccagatgttttgccggttaacgatctcggtgttaggaaaggagtgcagatgctgtatggcttagatgacctgcctcggccatcgcagatggagcagcattgtgccaagtggagaccatacagatcagtgggttcgtggtacatgtggcggctcattgaaggtaagggcacaccaacgagtgctgttacacctggagctgctatgtcattgcctccattggaagatattcaacaagaacatcagcagcaacagcttatggaccctcttaatagtgtgttcagtatcggttacgggataaactgttgaaattgattttgttcattcgaatttttgccttctccttatggtagtgtcactttttctggaaaggtatgtctgaacaagtgtggacatatcaatggatgaagaaaggcctccaagaagtggtgaagaagaatgtagtatatcactgtttgattattctgttgagaatcatctaaaagcagtggactctatcagtgatctctgtggtgaagctaatgctgaaattgatgagaatgatatcaacacattctcatcatcagttactttcttgagggaatggaggcattataatttcgaaccaaagatttttgcattctacaacgaggctgggaaaagccgtgaaccaaaggatgcaaactgtcaaaatttgcctcagttttcttcggcacgagctccgaaggttaagatacatgacgatgaatcatcatcatcatctggtgaaatcagcaaggattttgtgatgcatgttggaggctctgtttgggcattggagtggtgtcccagggttcatgggaatccagacgctcaggctaaatgtgagtttctagctgtggctactcatccgcctgactcatacagtcacaagataggtattcctcttacaggtcgaggcatcattcagatatggtgcattataaatgccacttgcaagaaagatagcgcccatttttcagagaagagtaaaaaattgacaggaaagtctcgaaaaataccatctggtgaaactactgaaacaacagaacctaagaagccgagaggcaggcccagaaagcatccaatagagacaatagagacaacagagcctaagaaaccaagaggtagacctcgaaagaagagtactgccgagttacctgttgagcttgatgaaggtgttctttacgttgaagctctgtctgttcggtatccggaaaattcagttgttcccgcaactcctcttcggatactacgagaaactccagtaacagaaactaaggtcaacaatgaaggttcaggacaagtgttgtcttcggaaaatgcaaatatcaagcttcctgtacggagaaagagacaaaaaactaaaggtactgaggaaagttgcaaacccatgctattagaaaatagtgaagctgttggaaatgtaccgggcgaaccgtccccaggtatttctcaaggcatagctcttccaagggttgtcttatgcctggcccacaatggaaaagttgcctgggatatgaaatggcgtcccttatatgccaatgattctcttaagaagcatagaatggggtatttagctgtcttgctggggaatggatctctggaagtgtgggatgttccaatgcctcaggcaacatcaactctatatttatcttcaaagaaagctgcgactgatccccgttttgtgaaactggctcccgtttttaaatgttcaaacttgaagtgtggcgatacaaagagtattcctttgacagttgaatggtcgacttcagggaaccctgatttcttactggctggttgccatgatggcacggttgctctctggaagttttctacaacgaaatcttcagaagatacaagacctttacttttcttcagcgcagatacagctcctattagggcagttgcatgggctcctggtgaaagtgatcaggaaagtgcaaacatagtagctactgctggacatgcaggtctgaagttttgggacttacgtgatccgttccgtcctttatgggatttgcacccagtaccaaggtttatttacagccttgattggttacaagatccaaaatgcgttttattgtcctttgacgatggaacattaagaatcctaagcttggtgaaggttgcgtatgatgttcctgctactggaaggccttatcctaacacgaaacagcaagggttaagcgtttataactgttcaacttttcccatctggagtattcaagtatcaaggctaacaggaatagcagcctattgcactggggatgggtcgattttccatttcgagcttacgaccaaagcagtggaaaaagacacgagaaatcggactccacactttctctgtggacaattgacaatgaaagattccacctttatagtgcatagtccagttccagacatcccgatcgtattgaagaaaccggttggtgagaccggtgaaaaacagagatgccttcgaagtcttttgaatgaatctcctaaccgatacgcatctaatgtttcagatgttcagcctcttgcttttggacacgaagaggatccaggtttagagtctgaattcgaaggaacaaacaacaaagcaccaaagtcaaagtctaaaaagggaacgaagaacattggagaagaggacgagaacagcagggcattggtttgtgttaaagaagatggcggagaaggaagaagaaaagaagctagcaacaataacaatggaacgaaagtagaagggttcccgcctaaactggtggcaatgcatcgcgtgcggtggaacatgaataaaggaagtgagagatggttatgttacggtggagccgccgggattgttcggtgtcaagagattgctccaacctcaaattggaaacctcagagatgacactaaagtcccttgtaacaactatataacatctttaagtatttattccaaaaa

SEQ ID NO: 3364 - DNA, 2586 bp, Arabidopsis thaliana
aatatatcaaagagtttgtacccgccttcgccgcaaccgtcgttcctgtcgccggaacaagtgtggacagatcaatggatggagaagaatgtaatatatcactgtttgattattctgctgagagtcatctaaaggcagtggaatctatcactgatttatgtggtgaagctaatgctgatattgatgagaatgatatcaacatattgtcatcatcagttacattcttgagggaatggaggcattataatttcgaaccaaagagttttgcattctacaacgaggctgagaaaaaccatcaaccaaaggatataaacagtcaaactttgcctcaattttcttccgcacgagctcccaaggttaagatacatgacgatgagtcatcatcatctggtgaaatcagcaaggactttgtgatgcatgttggaggctctgtttgggcaatggagtggtgtcccagagttcatgggaatccagatgctcaagctaaatgtgagtttctagctgtggctactcatccgcctgactcatacagtcacaagattggtattcctcttataggtcgaggcatcattcagatatggtgcattataaatgccacttgcaagaaagatagcggccaagtttcagataagggtaaaaaattgacaggaaagtctcgaaaacaaccatctggtgaaactactgaaacaacagaacctaagaagccgagaggcaggcccagaaagcatccagtagagacaacagagcctaagaaaccaagaggtagacctagaaagaagagtactgccgagttacctgttgagcttgatgatgacgttctgtacgttgaagctctgtctgttcggtatccagaaaattcagttgttcccgcaactcctcttcggatactacgagaaactccagtaacagaaactaaggtcaacaatgaaggttcaggacaagtgttgtcttcggacaatgcaaatatcaagcttccagtacggagaaagagacaaaaaaccaaaagtactgaagaaagttgcacacccatgatattagaatatagtgaagctgttggaaatgtaccgagcaaaccgtcctctggtatttctgaagacatagtagctcttccaagggttgtcttatgcctggcccacaatggaaaagttgtctgggatatgaaatggcgtccctcatatgcgggtgattctcttaataagcatagtatgggatatttagctgtcttgctggggaatggatctctggaagtgtgggatgttccaatgcctaaggcaacatcagctctatatttatcatcaaagaaagctgcgactgatccccgttttgtgaaactggctcccgttttcaaatgttcaaacttgaagtgtggcgacacaaagagtattcctttgacagttgaatggtcgactttagggaaccctgatttcttactggctggttgccacgatggcacggttgctctctggaagttttctacaaccaaatcttcagaagatacaagacctttacttttcttcagcgcagatacagctcctattagggcagttgcatgggctcctggtgaaagtgatcaggaaagtgcaaacatagtagcaactgctggacatgctggtctgaagttttgggacttacgtgatccgttccgtcctctgtgggatttgcacccagtaccaaggtttatttacagccttgattggttacaagatccaagctgcgttctattgtcctttgatgatggaacattaagaatcctaagcttggtgaaggttgcgtatgatgttcctgctactggaaggccttatcctaatacaaaacagcaagggttaagcgtttataactgttcaacttttcccatctggagtattcaagtatcaaggctaacaggcatagcagcgtattgcactgcagatgggtccattttccatttcgagcttacgaccaaagcagtggaaaaagacacgagaaatcggactccacactatctctgtggacagttgacaatgaaagattccaccttcatagtgcatagtccagttccagacatcccgatcgtattgaagaaaccagttggtgagaccggtgaaaaacagagatgccttcgaagtctcttgaacgaatctcctagccgatatgcatctaacgtttcagatgttcagcctctagcttttgcacacgttgaggatccaggtttagagtctgaatccgaaggaacaaataacaaagcagcaaaatcaaaggctaaaaaaggaaagaacaacgcaagagcagaggaggacgagaacagcagagcactggtctgtgtcaaagaagatggcggagaagaagaaggaagaagaaaagcagctagcaacaatagcaatggaatgaaagcagaagggttcccgcctaaaatggtggcgatgcatcgtgtgcggtggaacatgaataaaggaagtgagagatggttatgttatggtggagccgccgggattgttcggtgtcaagagattgctccaacctcagattggaaacctcggagataacaattaagtcccttgtaacaatacacttatataacatcttcaagtgtttattccaaaaagaaaa

SEQ ID NO: 3365 - DNA, 1839 bp, Artemisia annua
ttagctgaagatttttctgacattgttccggaagctttagataaagtagtcccagaaaaggcttctagtcgaaagcggaaaggctatgagaagcaaacttctgtaaagtcagcattaacttcaaagtcaagattagcaaagtgcaaactcagttctgagagtcaggatccaatggggtcatgtgcaacaggttattctgtacccctcgaaactgatccagatagttgcgacatttctgaggatatttctttgcctagacttgttatgtgtttggctcacaatggaaaagttgcatgggatataaaatggagacctgttgacactagtgctaatcttaaacatagaatggggtaccttggtgtcttgcttggaagtggagcccttgaagtgtgggaggttcctcttccgcatgcagctgaagctatgttttctgcttgccaaaaggatggtactgatcctcgctttattaagttgaagccagtattcagatgtgcgatgttgaagtgtggtgatagacaaagcattcctctaacaatggaatggtcaacggcatctccgcatgatcttattctggctggttgtcatgatggaatggttgctctatggaagttttctgcaaattctccactaaaagataccaaacctcttattttctttagtgcggatatacttcctataagggcattagcatgggcaccagtggcatgcgatttcgagagtgcaaatataatcgttactgcaggtcataaaggtgtaaagttctgggacatacgtgatccatttcgtccactttgggatgtgaatccggtccaaagggtcatatatggtgtagactggctgtctgacccaagatgtgttgttttatcttttgatgatggagaaatacggataatcagcttatcaaaggctgcatgtgatgtccctgttactggtaaaccctttgttgggacacaattacaaggactgaacagctatcactgttcttcatcttcaatatggagtgttcaagtttcaaaactaacaggcatggttgcatactgctgctcagatggtagagttctacgttttcagcttacagcaaaatcagtggagaaagaccctcggagaaaccgcgagcctcattatctttgtggagctcttacgacagaaggatcaactcttaatgttttttctccattacccgacgaattgggtgaaacccctagatcaaggcgtgggcatctaaccatctcaaatcaagagaagagagccagggagcaagggttgaaatgccaaatgccagaggatcaagccattcctcaagccagggaacaagggttgagatgttatacgccagaggagcaacctttagctctttgttacaacaatgatccgggagtagactctgggtcagacgatacaatggtggcccaaaagagcaagacttcaaaaacaaaaggcaccagtaagaaaaagccaaaagctgatgccaaacaagcattcacatccacggatgaagttccagatgtggagactattaatgagaaagaagtgtttccttccaagattgttgcaatgcatcgtgtaagatggaatatgaacaaaggcagtgagaggtggctctgctatggtggtgccgcaggaattgtacgctgtcaagagattagtttaggttgaacttgactagtaaaggtaatttttcaaaagctactaccatgacatgtaattttgtgcattagaagctgtattggtagagggtgttccgtgtttgttaatagagtaacattgaagacacaagggaattgctaatgtgtagataacacaacattaatgtttaatgtagtaactgtatggttggtt

SEQ ID NO: 3366 - DNA, 408 bp, Brassica juncea
acaacacaatagaggaggaggaggaggataacagaggagcattggtctgcgttaaagaagatggcgatgcagaagaaggaaggagaaaagaagcaagcaccagtagcagttctgtgaaagcggagaggttcccacctaaaatggtggcgatgcatagagtgcggtggaatatgaacaaaggaagtgagagatggttgtgttatggtggagcagctgggatcgtacggtgtcaagagattgcttcatctggtttggtcggtaaacaaaactggaggcatcaaagataaatatgtagtcccactaataagcaaacaaaactttaacatttgctctcgccttgtaaaacaagaaaactcactgaaaacactactaatcttggatgtgtgtaatactaattaatccaatttt

SEQ ID NO: 3367 - DNA, 2001 bp, Gossypium hirsutum
acggacaatgtcctgggaatacgcaagaaaatgttccacataagaataataaaaaacaaaaagttacgtaaagaggcaacatgcacatctgatgcaacccctcaaacttctaagaagagtataaaattaaaaagtaagacacaggagaaaataacggtgatagtaaaattaaaaaatgaaaaatcagaatcttctgcaatgaaccaacaaattcattttaacactgggcaagaagctactgtgtcaaataatgttttaggttgtaattcgatcaaggtcagcccaggttctctttctattccaggcgacattgccttgccaagagctgtcctctgcctagctcacaatggaaaagttgcttgggatgtaaaatggcagccatatcataaacatgattctaaatgcaaccaacggatgggctatctggctgtcttactgggaaatggatctttggaagtgtgggaggttcctcttctaaatatgataaaaactatttattcaacttcacctaagcagggtaccgaccctcgctttgtaaaattggacccagttttcaagtgctcaaagttaaaatgcggtgatatacagagcattcctttaacagttgagtggtcaacctcacctccacatgattatttactagctggatgccatgatggaatggttgctttgtggaaattctctgcaagtggttcaccaaaaattaatgatacgagacctctgctttgttttagtgcagatacagcaccgattagatcagttgcatgggctccatctggaagtgatatggagagctcaaatgttattcttactgctggacatggaggtgttaaattttgggacatacgtgatccatttcttccattgtgggatgtccatccagcaccaaagttcatatatagcctggattggcttccagaaccaagatgcgttatcatatccttcgatgatggaacaatgagactgctcagcttagttcaagctgcatgtgatgtgcctgtcactggaaaaccttttggtgggtctaagcaacaaggactgcacgtttataattgttcatcctttgcaatctggtgtgtacaagtgtcacgattaacaggcatggttgcatattgtggtgcagatggtactgccacgtgctttcagctaacctcaaaagcagtggacaaagatttttcacgaaatcgatcaccgcattttgcatgtggatccttgaccgaggaggaacctgctgtaatagttaacactccgttaccagataagcctttgccgttgaagaagccaagtagtgagtgtggggatggccaaagatccatgcgttacttcttaaccgagtcactgggcaaaaatgcaaagcataggaaagcgaaggttccaacttccaatcagcgaactttagccctttatgatggcaacgatcccagcgtggaatctgaacccgatgaaacattggcagctctgaaaagcaaaatgaaaccaaaatctaaaagtgagcgaactttagccctttgttatggcaacgatcccagtttggaatctgaacccgaggaaacattggcagctctgaaaagcaaaatgaaaccaaactctaaaagtgacggtaagaagaaagacaatgatcgtcaagcattggcacaaggaaccaaagaagcaacgaataaagagagagaagaaaccgaaaaagaaggtgaaagccaaatggagacatttcctcccaagattgtggcaatgcatagagtgagatggaacatgaacaagggtagtgagagatggttgtgctatggcggagcagccgggattgttcgatgtcaagaaattacagtgcgtgatgttgatacgaagttaaccagaaaacgttaaaacaacgttacgaactgtgcctgtagcattgtggcaattatgtacatatttaatttaatggcctttccccctttatttcttttaggtcaaattgagctagccttgggaagcctagtgtgcattccttgaattgaagtggat

SEQ ID NO: 3368 - DNA, 258 bp, Lactuca sativa
  misc_feature (20)..(20): n is a, c, g, or t
gaggatgagagagaaacacnttcctcccaaaatcgttgcagtgcatcgtgttagatggaacatgaacaaaggtagcgagaaatggctgtgctacgggggcgctgcgggaattttacgttttcaagaaattaatttattgggaaataaaaaggaaaaaagaaaaacgttacatgatttatccgtatctactatctagagtttaattgtaatgaaataaaacaaatgtcattttaaatgaatggaaaaatgatatcttag

SEQ ID NO: 3369 - DNA, 1415 bp, Pennisetum glaucum
ggttgctttatggaacttcgcaatggacctgtcatcacaagattcaaaacctgttatgtgtgtcactgctgaatttgttcccattagagctctttcttgggcaccttatataagtgacgaaaacataaatacctttgttactgctggggcagatggtctaaagttctgggatttaagagatccataccgccctctttgggagctaactactgctccaagggctgtattaagtcttcagtggttaaaggatggaagtgggattatcatctcaatggaagatggtacattgaagtttctcagcttgccccggattgcaaatgatgtcccagccactggaaggccatttgttggaacaaaaaatcagggcgttgcaacttatcagttatcagaatatttgatttggagtgtccatgcctcggacaccacaggttgtgctgcttactgtggggcagatggtactgctgtgtgcttccagcttactccgaggttctgggagaaggaacccgggcggaaccgtgttccttatttcctttgtggatcattatcagaggagggagaaaatattaagattggcagcagaccgcaaacatctccattaccaaatgttcctgtggcgaacaagaagggtccaaaaccacgccaagagatagttcaggccctggctgcgggtgatgtcattgttaatctagcatttggcaatgatcaaaatgatggacacaacgaagaacaaggagcaggtgctgtaaacccagaacttggtgatgatcaagatggtggacagaatgaaggacaaggagcaggtgctgtaaatacagaacttgatgaggatcaagatgggcacagcgaagaacaaggagcaggtgctatagttttagttgtccctacagagcaagaggatgatggtacattggacagcaagggtggtgaatcccctaaagactttgaggtctttcctcccaaatctgtcgcattgcatcgagtgcgatggaacgtgaacaaaggtagtgagagatggctgtgctacggaggtgctgcaggcatcgtgcggtgtcagaggatctaaagacaaaggcccaggtggctaatgctccccgtgaaacaggataatatgctcacatccttagttttgatggtaggttctgttgcattctttctgctacttttaacctggtcgtctaggttggttgtcttggttgctccaaactgtttgtaatcatgcaactatgcaagagaaccaatacaacagatcttcctatcctaggaacttgtggggggagctatgtagggttagaagagaccggttctgaatacattgggatggaaaatagagtcccggttctgacaaccatgcgaacctaatttgtgaaataaggggaacctgatctttgaaataagggagccctgatgcatttggg

SEQ ID NO: 3370 - DNA, 616 bp, Triticum aestivum
tcggcacgaggctgtggttcactggcagaggaggggacagtcattaagatcggtggcacgttgcaaagctctcctttatcgaatgttcctctggtcacgaaaaagggtccagaatcatgccaagatgtagatcaaacggacgatatgcggaaagaggaactacggactctcactaactcagaacatgtagatccagaactcagagatggtgagctagatgaaggccgagaaactagtgctctagttttagctgatgctctaatgcaagagagtgatggcatgcacaacggcccagttgatgaaaacgctaaagacgacttggaggccttccctcccaaatctgtagcgctgcatcggttgagatggaacacaaatagaggcagcgagagatggttatgctatggaggcgccgcaggcattattcgttgtcagaggatctaagggacaagcatatataattgggccgcaaaccaggagaatccgtgggtgtccacccatctacacaataagctgttgcagcagcaatatatggtaggtttgcctgatttttgccgatttccgcagttatggctgacagagctagctgtgtatcttagcaactccaacagcagcagat

SEQ ID NO: 3371 - DNA, 449 bp, Beta vulgaris
taggtgagaagaataagattaagatcagagcactacgataactataatctaaattatctataggtacataataatttacctaggagttcacctccttaacagtttattatcaaacttaggggaaacaatctcttgacaccgcacaattccagctgctccaccatagcacaaccatctctcacttcccttgttcatattccatctgactttgtacatagagacaatctttggaggaggaacttccacttgcttacctgcttcctctttaacctcaggcttcccattcacattgtccccatctccgtcagcgcgtaccagtgctagatcttgattttcctttctcgatttgcttgttttttcttgtccgccttttggattcgtctgagcctctcttgtgtctccatttccagactcttcaccgtaacacagtgcaagagcctgatcatctg

SEQ ID NO: 3372 - DNA, 1422 bp, Aristolochia fimbriata
ataaaccgtggtggtcaccaaagcattcctcttacagtagagtggtcatcttcagcaccttacaccctattattagctggttttccatgatggttgctttatggaagttcattgcaagtgcaacagtggcttctcaagacacaaggccgctgctttgcttcactgcagataatgtccctataagagctgttgcttggggtcctgcagaaaggaatgaagagagtgcaaatttgattgtgactggtgggcatgaaggtttacggttttgggacttacgtgatccataccgacctgtatgggaccttaatccaataagaagggttgtgttaagtatagattggctgcaagatcctggatgtctccttttagcctttgatgatggcacactgaggattcttagcatgtgtcaggcagcaaatgacacacctgtgagtggaaaattttgccgtgggagcaaccagcaaggattgcatttttattgctattctacatttccgatctggaatcttcatatttcacgacttacaggtgtagttgcttactgtgttgcagatggttcagctctctgttttcaggtattcttttctattttatattcccatgttggtccaaccagactagacggacaattttgcagctagtagggatcaaaaggcgagtccaagatgctgagtttctcttggtaatttgccaattaaaaatcacatttcttcttttattctcgtctttctgtttcttttgcatgggatgatattagcttccaagaaaagcagtggaaaaagatccagctagacatcgagcacaagtctttcagtgtgggtctattacagaagaagactcgatattaacaatcaataccccattgtctgggactgctgttgcaatgaggaagccttcaagtggatcaaaggaaactcctcggattactcaagcgaaaataacagatcctcaatcggcagatgcgctggacagtgaacctgtagtcactcccaagtctcatgttgcgtctaaaggcaaaaaattgtcaagccaagtaccagtggggacaacttcagaaggagaaactccactgaaatcaaacattagtggaaaaggtgtagagaaaccgatggctgaatttgaaaccttcccttccaaaaatgttcccatgcaccgaattagatggaatgtgaacaaaggtagtgagaaatggctgtgttatggaggagctgctgggattgttcgttgtcaacagctcagcttgacagctgctcctcgcaaatgatgatgcgcatgtttgatagtcaattaattgtaattattcttttataactcgatttgtagtcaattaagttaatgtagcaatgctgcttagagcagattctgaaatttgtccaatttatcaatcgcagctgccgtacaagagtggcgtttctctaaaaa

SEQ ID NO: 3373 - DNA, 422 bp, Euonymus alatus
gtccagttccagataataacacattagctctttgttatggagatgatcctggtacggaatctggccctgatgaaacattggcctccctcaagagcaaaacgagaccaaaatccaggtctagtaagaaaaaagcaaaggatgatggagcactcttatgctgggatgaggagagcagtaaggaaaagccagaggacgatcaaggatttgcatatgaagacgaggagccagacatgcatggcaaagaaaacagaaatgatggaaaatgtaatcaaactgaagattttccttccaaaacagttgcaatgcatagagtgagatggaatatgaacaagggcagtgagagatggttgtcctatggaggagcagcaggcattgtacggtgtcaagagattatgacatctcatgcagcctggagatgagaa

SEQ ID NO: 3374 - DNA, 461 bp, Olea europaea
agctatatgctatggaaatgatcctggaactgaacttgaacccaacaacccatgcatcattgcccagaagagtaagtcagcaccgaaatcgaaaagagcgataagaataagttgaaagccgaccaacaagctcaaatatctggagacgacatgggaaatttcccaggggaaggaagtgacaaaggacagatgcggcatgagattgaggttttccctccaaaaattgtggccatgcataaagtgagatggaatatgaataaaggcagtgagaggtggctctgctatggaggggctgctggtttgatacgatgtcaagaggtcgacatgtctacttagatgtttacattaatcatattgaaagcttctctagcagtagaaaacgtgcgtatctcgttacatgcttacacatcaagttttagcgcagttcgtatgtttaatccgacgaagaacttggttacatg

SEQ ID NO: 3375 - DNA, 3070 bp, Fragaria vesca
caaataaagtaaaagtcggcgtcaaagaagaagagcgagtgagatatgagtgaggagggagtggaacctccacttgcggttctattgcgttgcaagcgcgggaaaactaagtcggccaagaaaccaagccaatcaactcaaatcgcaccggagccggtcccgatcgatgcgcagccggttcgaattgagccggagccggtttcagttgcgccggagaactcgaggaatggccctcctagggtcagtgtctccatgttcgacgattcggtggagaatcacttcagagtcatgcacacgatttccgagctctgcggcgaagccaaggaagacgagccagtcccggagaccgagcttcaacgcttacagtcatccactacttttctcagggagtgggctgatttcaagtatgaacctagggctgttcgattcgcttgccaagcaccaagccctgatgaggaggatgttatcagtgggataaacttgcggcagttttcctctgcaactgttccacagaacgaggcgggggacacatcctctccggagttgagccaagactttgtgatgtatgttggagggtctgtttgggcattggattggtgtcctagagttcatgaatgtcttgaatctcatgccaaatgcgagtttattgccatagctgcccatccccctggatcttcttatcacaagttaggtgagccacttactggcagaggtgccattcagatatggtgtcttctaaatgctagtgtaaaggacaaaggtggtcctataggagagaaaccaaaaggaggcaagaaaaggagtgcagtcatagaaaaatgcaccgaacaaaaaaggcctagaggaagacctagaaagaagccaatagaagaagctattgacaaagaggccaaagcagaaaaatcaactgaaccaaagaggcctagaggaagacccagaaagaaatcaatagatgaatctgttggcaacttggatgggagaaccaatgcaaagatttctagaggaaaagctggagagaagccaatagaacattctgttgataacttggatgggagcagccattatacagaggttcttgctgtccaatgtatcaaggaaacttcagagttgcattgtgttcctgcacttactcaggcacatgatatacaagaagctcatgatggaaaacaagaaagttctggatggaaaacaaatgatattgtttctaacaatgattatgctgaaaatggatcaaccagttattcagttccaaaggatgtagcattgccaagaatcatattctgcctagctcaccatggaaaggttgcttgggatgtgaaatggcgccccctgaatgaatatgattccagatgcaagcatcgaatgggctatcttgctgttttattagggaacgggtctctggaagtgtgggaggttcctgttcctcgtgcaattgaagtaatttattcttcttcatctggagaaggcactgatcctcgctttgtaaaattggcaccggtatttagatgctcaatgttaaagtctggtgacaaaaaaagcatccctcttactgtggaatggtcagcttcaccacctcacgattacttaattgctggatgccatgatggaactgtcgctatgtggaagttttcagctagtaatgcatctcaagatacaaggcctttactttgtttcagtgcagatacaaatcctattagggcgctttcttgggccccagttgaaagcaattcagacggtgcaaatgttatagctactgctggacatggaggcctaaaattttgggacctacgtgatccattccgtcccttgtgggacattgatcatataccaaggttcatatatagtctggattggcttccagatccgagatgtctacttctctcctttgatgatggaacaatgagacttctcagcctgacgaaggttgcctctgatgcccctacaacagggaaaccctttactggaacaaaacagcaaggcctgcacaatcttggttgtttgccttttgcaatctggagtgttcaagtatcaagactaacaggtatggttgcatattgtggtgcagatggaactgttctgcgcttccagcttacgtccaaagctgtggagaaagatgctatacgaaaccgggctccacattttctgtgtgtgtcactaactgaagaggactctgttgtaaccatcaataccccagtactaaataatcctttcccattgaaaacatctcgtaaagctgagccaaacaaggtgaagagagaacatgataagatggcaactgcatcagaagataaagttttagctctttgttatggtgatgatccggttgttgaattagaatctgggaaagaagcgccatctcttagaagcaaaccacgcacatctggggatgaccaagctttagcatgcatggatcatgagccatttaatactctggaagaagaaattggagaaaagggtgcatctcttaaaagcattgtgaaacagaaatctaagtctagtaagaaaacagaggatgaacaagaactggtatgcagagatgaagagctgaataatatgcagagagagaaaattgggaccgagtatgaagtttttccttcgaagctaatagcaatgcatagagtgagatggaacatgaacaagggtagtgagagatggttgtgctatggaggggcagctggactcgtacgttgtcaagagattgctttgtctgagattgatacgaaatgggcaaggaagaaatgagaagccatgttttctgtagttccttgattcttctgagcctgtttaatgtttatgttagattcagtgattttgcaggacagatgacaccataaagagcagagctaattgtggatgtatatagattaggattgtctgatgatttgtcaacttcctacatgcgtgtaaatgaatgtagattgtaattctatctagttggtggaaagctatactcattttaggattttagcggctacatgtgaaatcaaaggcctaccacctgcattatgaaactaatgcaaagtagctatacactgatcagttctttttgtttctaaaatataaataagat

SEQ ID NO: 3376 - DNA, 2508 bp, Solanum lycopersicum
atggaaaccggcgacgatttttcagtcgccgccgaattgaagcggtgtaagcagaagagaaaatcacaaccaaaatccaacaacattgttcctgaatctcccgccaccgcgccggcaaaagtcgccggcggtgagttttcgtccggaattccagtctcattgttcgattattcagtagagaatcactttaaagcagttgatataatttctaagctcaccggtgtaccagacattgacgatactgatcgaactgaacttaatcgcttagcttcctcaatcacattcttaacagaatggagatttctcaagtacaaaacaagagaagttaaatttgcttgtgagaacgagagttcaaaaggaaaagatgtgattggtgaaataagtttgcctcaattctcttctgccgaagttccaaagaagcagttggtgaatgagcagccagtacccgaaaaatcgagcaaagattttgtgatgtatgttggaggtctagcatgggggatggactggtgtccccaagctcatgaaaatagggatgctcctatgaaaagtgagtttgtcgcaattgctcctcatcctcctgattcatcatatcacaagactgatgcctcacttacaggcagaggtgtaattcagatatggtgcctgccagatctcattcaaaaagatataattgtgaaagaagattattttgctcaggttaacaaaaaaccgtatagaaatttgacaagaagtgaagcaggtacgggagaagtatctggacctcaaaaaccaagaggaagaccaaaaaagaaccctggtaaagcagtccaggcaaaagcatctagaccacaaaatccaagaggaagaccgagaaagaagcctgttactgaatctttaggtgatagagatagtgaagaccacagtttacaacctcttgctatagagtggtcgctgcaatcaacagaactttctgtagatttgtcttgtggaaatatgaataaagcccaagtagatattgggctgagtcaagaaagatgtattaatgcggcatctctagattctccgttaactggagtgagaaacaaggcaacattgaaaggacaaactgagaaatctggtgtgattccgctaacacaagatgttgctgaagagtctccagctgtgagttcccaggcatatactagcaatcgtcttgacataccaaccgatgtttctctacctagaatggtgctgtgtttagctcacaatggaaaaatagctcgggatattaaatggaggccttcaaatcactatgatgtctccagacacagaatgggttatcttgctgtgatactgggaaatggaactttagaagtgtgggaggttccttttcctcatactattaaagctatttatccttctgttcaaaagaagggtactgacccgcgtttcctgaaattacaaccggtattcagatgttcaatgcttaagggctgtgatgggcaaagcattccgttaacagtggagtggtctgcgtcacctctgcatgatatgattctctgtggatgtcatgatggagtggttgccttgtggaaattttcagccaataattcatctaaagacacgaggcctttgctttgcttcaaggcagatacaggtcgtattcgggcgctttcctgggcaccattggaaagtgattccgggaatacaaatattatcatcgtagcaggtgacaagggtctgaaattttgggacttaagggaccccttccgtccgttgcgggagtatcatgtaggctcgggagttcatatatgcagtgtggactggttgccagagccaagatttattgtaatatcatgtgatgatgggacactaaagatccttggcttgccgaaggctgcatatgatgcacctgtcacaggaaaccttttagttggaactaaacaacagggatttcatagtttcactcggtctcgacttgggatatggagtgtgcaagcttctcgaataacaggcatggttgcatactgtggggtagatggtacagctgctcggtttcagatgtctagcaaaatgtataatgatcccttgagaactcgtgcaccacattttctctgtggatcattttccgaggatgaatcaggtatcagcgtcgttactccagtgccaaatactcccttccgaatgatctactcagggaaacaatggcgtgatgctatcccaagatctcctcatggtctggacaaacgaatgatagaacaatcagatgaacaacccctggctctatgttatggcgatgatccaaacgttgaaggaggatcagatgatgagttagcatctcaatcatccaaaactaaaacaaaatccacgagcaagaaaccggaagctgctgaagaagaagcaacacgattgagacagaaatttgaaaagttacctcccaaaattttgtcgatccaccggataagatggaatatgaacaaaggcagtgagagatggctatgttacggaggagctgcggggctggtacgttgtcaacagattgatttataa

SEQ ID NO: 3377 - DNA, 709 bp, Hordeum vulgare
gaactactgactcttgctaactcagaacatgtagattcagaagtcggagatggtgaactagatgaaggccaagaaactggtgctctagttttagctgatgctctaatgcaagagaatgatggcatgcacaacggcccagttgatgaaaaggctaaagacgactttgaggtcttccctcccaaagctgtagcgctgcatcggttgagatggaatacaaacagaggcagcgagagatggttatgctatggaggcgccgcaggcattgttcgttgtcagaggatctaagagacaagcatatataattgggccgcaaaccaggagaatctgtgggtgtccacccacctagaaaataagctgttgcagcagccaacagcaatatatggtagatttgcccggttctttcgtcggccttaccgagttccacagttatgcctgagctactactcattctgcaacagcaacagatccttgtagtttaggaactcaggttgaggcaatatgagcttcatatcttgggctaagaaaacaataggaaatacctgtgagaagtcagctcagcaactgactgatgtttttcttaggctgtaacatgtgtacatgtattgattgacacaatcagacaaattgcgcctatttgtaagtaatattgacaaactgaacaatgttccgccaaatatgtaagtaatagatgaataataatggaaatcat

SEQ ID NO: 3378 - DNA, 709 bp, Hordeum vulgare
gaactactgactcttgctaactcagaacatgtagattcagaactcggagatggtgaactagatgaaggccaagaaactggtgctctagttttagctgatgctctaatgcaagagaatgatggcatgcacaacggcccagttgatgaaaaggctaaagacgactttgaggtcttccctcccaaagctgtagcgctgcatcggttgagatggaatacaaacagaggcagcgagagatggttatgctatggaggcgccgcaggcattgttcgttgtcagaggatctaagagacaagcatatataattgggccgcaaaccaggagaatctgtgggtgtccacccacctagaaaataagctgttgcagcagccaacagcaatatatggtagatttgcccggttctttcgtcggccttaccgagttccacagttatgcctgagctactactcattctgcaacagcaacagatccttgtagtttaggaactcaggttgaggcaatatgagcttcatatcttgggctaagaaaacaataggaaatacctgtgagaagtcagctcagcaactgactgatgtttttcttaggctgtaacatgtgtacatgtattgattgacacaatcagacaaattgcgccgatttgtaagtaatattgacaaactgaacaatgttccgccaaatatgtaagtaatagatgaataataatggaaatcat

SEQ ID NO: 3379 - DNA, 490 bp, Brassica napus
tgaggatccgggtttagagtctgaaacggagggaactagcaacaaagggtcaagatcaaaggctaagaaagggaagaacaacacaatagaggaggaagataacagaggagcactggtttgtgttaaagaagatggcgatgaagaagaaagaagaagaaaagaagcaagcaacagtagcagttctgtgaaagcggaaacgtttccacctaaaatggtggcgatgcatagagtgcggtggaacatgaacaaaggaagtgagagatggttgtcttatggtggagcggctgggatcgttcggtgtcaagagattgcttcatctggtttggtcggtaaacaaaactggaggcatcagagataaatatgtagtcccactaataagcaaacaaataaccctaaatcttacaatggtttaacatttgctctcgccttgtaaaacaagataactcactgaaaacaacactaatcttggatgcgtataataataattaat

SEQ ID NO: 3380 - DNA, 1547 bp, Brassica napus
gcatcaggttgctctctggaagttttctataactaaatcttcagaaggtattacaatctgatatgtttttttccttgccagatagtttcctttttcacattggggctagagaagtgatttgttggtttcacatttgcttttcaattattttgtttttgggtgcagatacaagacctttgcttgtctttagcgcagatacctctcctataagggcagttgcatgggctcctggtgaaaggtcagtgacatgaaatcacacccataagattagtaattctcgttctttttttgcttcacttagttggagactaagtgggcatatataattctaatgggaaataatcgaattaatttcttcaataaaaaacagtgatcaggaaagtgcaaacgtaatagctactactggacatggaggcctaaagttttgggacttacggtacacgtcatatatatcagctacatcgcttttctttaagttttgaatatttattttgcgttactacatatcttattgcttgcttcctatgttttttttttttttctgtagtgatccatgccgtcctttatgggatttgcatccagtaccaaggtttatttacagcctcgattggttacaagacccaaaatgtgtgttattgtcctttgaagatggaacaatgagaatcctaagcttggtgaagattgcgtacgatgttccagcaaccggaaggccgtatcccaacacaaaacaacaagggttaagcgtctataactgttcatcttaccccatctggagtatccaagtatcaaggctaacaggcatggcagcttactgcactgcagatgggtccgttgtccatttccagcttacgaccaaagcagtggaaaaagacccgagaaaccggacacctcacttcctctgtggacgactgacaatgaacgattccacctttatagtgcatagtccagcgcctaacgtgccaatcatgttgaagaagctgattagtgagaacggtgaaaaacagagatgccttaaaagtctactgaacgaatctcctaaccgacacacgtctcctgtttcagatggtcagcctctagcttttgcacaggatgaggaaccggggttagagtctgaacccgaggaaactaacaagaagggatcaaaatcgaaggctaaaaagggaaaggggaacacaatagaggaggacgagaacagaggagcgctggtttgtgttaaagaagatggcgatgaaggagaagaaggaagaagaaaggaaggaagcaacagtagcagcagagtgaaagtagaaaggctcccacctaaaatggtggcgatgcacagagtgcggtggaatatgaacaaaggaagcgagagattattgtgttatggtggagctgctgggatcgttcggtgtcaagagattgcttcttttggttcggtcggtaaaccaaacttgaggcctcatcgataaatcatatgtagtccccatgtagtacaggatcttggatggtttttaataatttaatcatttagtcacaaaataattataatcactgcgtctattccg

SEQ ID NO: 3381 - DNA, 2828 bp, Populus trichocarpa
agacagcaacgttttcgaggcttatatttctcagcgatagtctgtccctacaatacttacaaacataaacctgactataacgacgaagagaaggtgttgaagctccggctaaacgatcccgagttgcggtttaacccatgaagaattagtagaatggaagaacaagaagaattattaggaggcaatggtgttggcattagagtttcaacattcgattattcagttgagaatcactttaaagaaatggacatgatttctaaactttgtggagaagcacaaactgattccgtggatgaaattgaaattcagtgctataagtcctctatcacttttttgaggtcatggaagctttataagtacgacccgagaataattaggtttgctagtgaaacggataattctctggagaagtgtgttctcagtggaataaatctaccgctgttctcatctgcaactgttcctaaggtacttaaagattttgtgatgcatgttggagggtctgtttgggcattggattggtgtcctagggttcatgaaaggcctgacaatcatatcaaacgcgagtttgttgctatttctgcccatcctcctgaatcttactatcacagaataggtgtaccacttactggcagaggcatggtccagatatggtgtgttttaaatgctttagttaagatgccaaaaggaagacctagaaaaagaccaatagaagaatcaccctgtaacgaagccacggagttgatttcagctaagaggcctaaaggaagacctagaaaaaagccaatagaagaatcacccattaagaggggaggacggcctagaaagaacccaacaaatgaatctcttgatagtttggatagcagcaaccagtatgtccaagctctctctgttgaatacccacaagattcacctggactgctttctatagaagggatttctcaaaacagccaagacgaggccaaacaaaaacacaagggaagtgattctggtgatgttgcatgtccactgttattgattcataatgaagatgataatgtttctttggatatcaactctacatcttcaactgtaaactaccaaacacatgagaattctggactcaacactgcaatgccagcttatggttctgataatgtttctttggatatcaatcctacttcttccattccgaaggatgctgatttgccaagagttgtattatgcctagctcacaatggaaaagttgcatgggatgtcaaatggcagccttgtaatgcacccccttccaaattccagcatcgcatgggttatcttgctgtcttgctgggaaatggatctttggaagtatgggatgttcctctcccccatgctatgaaatcagtttattcttcgtctaatttagaaggcacagatcctcgctttgtaaagataaagccagtattcagatgttcaactctgaagtgtggaggtatacagagcatccctttggcagtagagtggtcaacttcataccctcatgattacctacttgctggatgccatgatggaacagttgctttgtggaaattctctgcaagtggcgcatctggtgatacaaggcctttgctttgtttcagcgcagatacagttcctattagagcaattgcatgggtcccatctgaaagtgaccaagagagtccaaatcttatcctcactgctggacatttgggcctgaagttttgggacatacgtgatccattccgacctttgtgggacctccatccagcaccaaaactcatatatagcctggattggctgccggatccaagatgtataattttatcctttgatgatggaacaatgagactcctcagcctggcaagggctgcatatgatgctgccgtcaatggaaaaccttctgttggaccaaaacaactagggatgcacgttgttaattgttcttcctttgctatctggagcgttcaagtgtcaaggcttacaggcatggttgcatattgcagtgcagatggtactgtttgccgcttccagctcacaacaaaagcagtggagaaagatccatcgagacatagggccccacattttggttgtgggtccttgagtgaggatgaatcagctattatagtgggcactccattaccagatactcctttacctttgaagaagccagttaacgatgttgggaacaatccaaaatccaagcagcgtttgtctgtgtcaaataaggccgcaaaaattcctacttcagatgatccaccattagctctttgctatggtgatgatcctggtatggatcatggatcagatgaaacattgacagctacaaaaagcaagaggaaaccaaaatcaaaaagtgggagtaagcaaatggaaggagaggatcaagcattggtatgcattgatgacgagcaagatgtcaaacagaaaggtggcggaaaggagggagctgggaatgtagttgaaagcatcccacctaaaatggttgcaatgcatagagttagatggaatatgaacaaaggtagtgagagatggctctgctctggtggagcagccggaatcgtacggtgtcaagaaatcaaaatgtttgatgctgatatatgcttggcaaggaagagatagtagcctgtaaaacgttaatcataatctatggatatttattgttattttcgatagatttggcttaaaaaaaagtgagctacaaagggacatttacatcaactagtctaattaagaattcttgagaaaaataattgaaacaaataagatttttcggcaatgttacaagactggtccagcagttaatccggtgactcgctcatccagatcaatgaaaaaacccgatcttttgttta

SEQ ID NO: 3382 - DNA, 2719 bp, Prunus persica
atgaataaggcagtggaagagggagtggaacctccactcgcggcacttttggatggaaaaagcgggaaaaaaacgaaggcgaagagaaaaagcaaagcaacatcatcaaaggatcacgacacagagctagagccagttcaagctgcgccagagccagttcaaattgagccagagccagagccaattcagattgagccagaaccagttcaaattgagcctgagccagttcggattgagccagagccagttcagaatgacgaagagagctcaagggatggccctagggttagtgtttcgatgttcgatgactcggtggagaatcacttcagagtcatggacaccattgccaagctctgtggcgaggctgaggaggatcatcgaatcgaagacagtgagattcaaagcttatcgtcctcgatcactttcttaagggaatgggcagattttaaatatgaacctagagatgttcgatttgcttgtggaggtggaagccctgatgggaaagatgtgttcactgggataaccttgcgtcaattttcttctgcgacagttcccaaggttatatctattaatctgaatttctgccaagactttgtgatgtatgttggagggcctgtttgggcattggattggtgtcctagagtccatcaaagtcctgactatcatccaaaatgtgagtttgttgctatagctgctcatcctcctggatcctcttatcacaaattaggccagccactaactggaagaggtgcgattcagatatggtgtcttctaaatgttggtgtaaatgaggaaaacagtcatcccataggagaaaagccaaagcgggaccctaaaaaaagtggagccagagaagaaaattcagctgaaccaaagagaccaatcggaagacctagaaagaagccattagaagaaaaatcaactgaaccaaaaaggcctagaggaagacctagaaagaatccaattgaagaatctgttgacaaagaggccacagaagaaaaatcaactcgaccgaagaggcctagaggaagacctttaaagaagccaatagaagaatctgttgacaacttggatgggagcagcaattatgttgaggctctttccattcaacatccagagggatcaccggagttgcattctacgggttgtgttcctgcaaatacccaagagcatggtaaaaaacgaaaaaattacaatcatgcagcatctgaatagttctggacaggatcctcaaacaagtaataatgttcaagacaatgattaccctaaaattggctcaaccaggtgttcagttccggaggatgtagcattgccaagaattgtatcatgcctagctcaccatggaaaggttgcatgggatgtgaaatggcgtcctcctagtgaacatgattccaagtgcaagcatcgaatgggctatcttgctgtgttgtcaggaaatggatctctggaagtgtgggatgttcctcttcctcatgcaattgaagttatttattcttcttcttgtcgtgagggcacagatcctcgctttataaaattagcaccagttttcagatgctcaatgttgaagtgtggcagtgaaaagagtatccctcttactgtggaatggtcagcttcgccagctcatgattacttacttgccggatgtcatgatggaactgttgctttatggaagttttcagctagtaatgcatctcaagatacaaggcctttactttgcttcagtgcagatacaaatcctattagggcacttgcttgggcgccggttgacagctcttcagagggcgcgaatgttatagctacagctggacatggaggcctaaaattttgggacctgcgtgatccattccgtcccttgtgggacctcgatcatttaccaaagttcatatatagtctagattggcttccagatccaaggtgtgttattttatcctttgatgatggaacaatgaaagttatcagcttggtgaaggctgcatctgatgacccggtaacaggaatggctggaacaaaacaaccgggcctgcataatctcagttgtttgccttttgctatctggagtgttcatgtatcacgactaacaggtatggctgcatattgtggtgcagacggaactgttctccgcttccagcttacgtccaaatctgtggagaaagatcctagacgacatcgggccccacattttctgtgtgtatcactgacaatggaggaatctgctgtaaccatcaatactacagtatcaaacacccctttcccattgaaggtcgttcgcaataaccctgagtcaaacaaggtgaaaagtgcaaatgataagagggcaaaagatagtgcatctgaagatcaaactttagctctttgttatggtgttgatcctgatatccaatcagaatctggggaaaaagtggcatcgctcagaagaaaaaaaacaaagaaatctgggtctagtgagacaacaccagaggatgaccaagcattggtatgcatagatgaagagccgactagtacgcaggaacaagaaattggggaaaaagtggcttctgaagaagaagacgggaaagagcttgaaatatttcctgacaaaatagtagcaatgcatagagtgaggtggaacatgaacaagggtagtgagagatggttgtgctatggaggggcagctggacttgttcgatgtcaagagattgttttgtctgacaccgaaaaagcatgggcaatgaagagatga

SEQ ID NO: 3383 - DNA, 812 bp, Solanum phureja
ccctaccttgtatttctaacagggatcccttccgtccgttccgggagtatcatgtaggctcgggagttcatatatgcagtgtggactggttgccagagccaagatttattgtaatatcatgtgacgatgggacactaaagatccttggcttgccgaaggctgcatatgatgcacctgtcacaggaaactttttagctggaaccaaacaacagggatttcatagtttcactcggtctctacttgggatatggagtgtgcaagcttctcgagtaacaggcatggttgcatactgtggggtagatggtacagctgctcggtttcagattgctagcaaaatgtataatgatcccatgagaactcgtgcaccacattttctctgtggatcattttccgaggatgaatcaggtatcagcgttgttactccagtgccaaatactcccttccgaatgatatactcagggaaacaatggcgtgatgctatcccgagatctcctcatggtcaggataaacgagtgatagagcaatcagatgaacaacccctggctctatgttacggcaatgatccaaacgttgaaggaggatccgatgacgagttagcatctcaaacatccaaaacaaaaacaaaatccacgagccagaaaccggaagctgctgaagaagaaggaacacaatcgagacagaaatttgaaaagttaactcccaaaattttgtcgatccaccggataagatggaatatgaacaaaggcagtgagagatggctatgctacggaggagctgcggggctggtacgctgtcaacagattgatttatag

SEQ ID NO: 3384 - DNA, 1224 bp, Solanum lycopersicum
aatggttctgatgtactgcaggacataccaaccgatgtttctctacctagaatggtgctgtgtttagctcacaatggaaaaatagctcgggatattaaatggaggccttcaaatcactatgatgtctccagacacagaatgggttatcttgctgtgatactgggaaatggaactttagaagtcattccgttaacagtggagtggtctgcgtcacctctgcatgatatgattctctgtggatgtcatgatggagtggttgccttgtggaaattttcagccaataattcatctaaagacacgaggcctttgctttgcttcaaggcagatacaggtcgtattcgggcgctttcctgggcaccattggaaagtgattccgggaatacaaatattatcatcgtagcaggtgacaagggtctgaaattttgggacttaagggaccccttccgtccgttgcgggagtatcatgtaggctcgggagttcatatatgcagtgtggactggttgccagagccaagatttattgtaatatcatgtgatgatgggacactaaagatccttggcttgccgaaggctgcatatgatgcacctgtcacaggaaaccttttagttggaactaaacaacagggatttcatagtttcactcggtctcgacttgggatatggagtgtgcaagcttctcgaataacaggcatggttgcatactgtggggtagatggtacagctgctcggtttcagatgtctagcaaaatgtataatgatcccttgagaactcgtgcaccacattttctctgtggatcattttccgaggatgaatcaggtatcagcgtcgttactccagtgccaaatactcccttccgaatgatctactcagggaaacaatggcgtgatgctatcccaagatctcctcatggtctggacaaacgaatgatagaacaatcagatgaacaacccctggctctatgttatggcgatgatccaaacgttgaaggaggatcagatgatgagttagcatctcaatcatccaaaactaaaacaaaatccacgagcaagaaaccggaagctgctgaagaagaagcaacacgattgagacagaaatttgaaaagttacctcccaaaattttgtcgatccaccggataagatggaatatgaacaaaggcagtgagagatggctatgttacggaggagctgcggggctggtacgttgtcaacagattgatttataa

SEQ ID NO: 3385 - DNA, 617 bp, Cucurbita pepo
ccccaaatcagttgcattgcatagactgagatggaacatgaacattgggagtgaaagatggttgtgctatgggggagcagctggaattctacgctgtcaggagattgtgctgtctgctctcgataagaagttgatggcgaagaaatgaactttactaaaaaaatggctttgccaaaatgtttgtgcagctgatttcatgaggcgacgcttgctcaattcactgtacagtcaattagatcagaaaccatggtgccttcatccttgaggggccaaattatgggagcagccaaaggaatcagagagcatgaccttaggataactgaagaccattaactgtggaaattagatgaaaggagttcaagagccgaagcagatgatttgatctgggtttggttcagttgaaaaggaacgggaaaagaattgttggaggaacctcagcagccatgattagataaactgtatcttttagccaattgtgtattctaaaattagtgactcaaagctcatctccttagcttacaggaggagttatgagacagtttggctactaccgggctcgatcacctgaggaagagatggggtttgttttcatctatgaacttcctttttcatatgac

SEQ ID NO: 3386 - DNA, 579 bp, Thellungiella halophila
agtgcatagtccattgcccaacataccgatatcttgaagaagccggtcagtgagaccggtggtgaaaaacaaagatgtcttcgatcccttgtgaatgaaactcccaagcgatacgcatctcccgtttcagatgttcagcctctagcttttgcacacgatgaggacccggggttagagtgtgaaactgagggaacaaaaaaacaaaaaaagatcaaaaataaaggcgaagataggagagaacacaatagaagaggacgagaacagaggagcattggtctgtgttcaagaagatggcgatgaagaagaagagggaagaagaagaaaggaagcaagcaacagtagtagcagcggagtgaaagcggaagtgttcccgcctaaaatggtggcgatgcaccgagtgcggtggaacatgaataaaggaagtgagagattgttgtgttatggcggagctgctgggatcgttcgttgtcaagagattgcttcacttggtttggttgctaaacaaaaccggagacctcagagataaatgtagtcccaagatgttccatacttttaatatcttaatcatttgatcaggat

SEQ ID NO: 3387 - DNA, 1118 bp, Arnica chamissonis
aacttaaggttaccgttaatccgttaaataacggaacgttagaaccgttttacgtacgtcttaggctttcgtaactagtcacgagtaaccttagtccgttctaagggtcgacttaatgggcgtccactggccacgtgatctcgagagtgcaaatacaatcgttacttgtctggtcgtataaggtttaaagtttttagggtacgatacgtgatccatttcaccctctttgggatataccttctcaaaaaatcataaatagtttggattggctgccagatccaagatgtgttgttttatctcatgatgatggtgaaataaaaataatcagcttatcaaaagctgcatgtgatgtccctgttactggtatgccatctgaataaaaaaccacaacatggatcttatagttattattgttcatcatcttcaatttggagcgttcaagtgtccagattcaatggtatggttgcatattgctgttcagatggtaaagttattcattccagcttacaatcaaagcagtggagaaagatcctcacagaaaccgtgaacctcattatctttgtgggtccctaacagaggaagattcaattcttaccgtgttatctccgttgctagacatccccattccgatgaagaaatcgtccactgaatgggtgatacccccaaaaccagtcgcggctttaagtcaaggtcaaatcaagaaaagagagccaagggccaaatctcaaaatgccaaacaccacccaaacaatcctcagaaggaacattgaagaacaacgacgcctcactggaaacccaaacgagtcaggaattggtgtgtatagacaatgacagtaagatcgaagaagagaatgttaaagaggaggaaactgaagtttttcctccgaaaatcgttgcaatgcatcgtgcaacatggaacatgaacaaaggtagtgagaggttggtgtgctatggcggtgctgcgggaatcgtacggtgtcaggaaattaggtgattcaaaacttggtgtgttaaataggtagatttcgttagttagggggtgtttgttgaagtgtatgattccttttatgtgtgttacgtttgtaggtatgtaatatgttgtctaaaaataagaaaaa

SEQ ID NO: 3388 - DNA, 1813 bp, Cephalotaxus harringtonia
agcattcctcttactttggagtggtcgacttcaacaccacatgaccttctgttagctggctgtcatgatggaacggttgctgtatggaaattcactccaaaagctttaccttcacaagatgtaagacctctaattttcttcacagcggatgctgttcctattaggtcattagcatgggctcctaatgagggtgatgctgaaagcaaaaatataattgttactggcggtcatggtggcagtcttcgattttgggatttgcgggatcctttccggcctttgtgggatcttcatttgtcgagaggaattattacgagtcttgattggttgcatgagccaagatgtatattttgtcgatggatgatggcacactacacattctcactttatgcaaagttgcattagatactccagtgacaggaagagcattccgtggaactcagtttcaaggactacaaagttactattgctcatcatttacaatttggagtgtccaagcttctagactgacaggtttggttgcatattgcagtgttgacggttctgttcttcattttcagcttactgcaaaagctgtggagaaagataaaatgcgacaccgtaccccccactatacttgtggatcatttgtggaagagggaagcaggacattcaagataatttccccaacaattctcactcctgtgccaatgaagaaatctcttaatgaatggagtgatactccaagatccatccgtggttttctttctgagtcaaatcaggctttaagaactaatatacatgctgcagcagaaaacaagtgcattcagtctggctcatttgaactagtagcagtagcagatgaagatactgtgacaccttccaagaagcgaattgcaaagaaatcgaaaaaggccacaattgggaagcattctacaaaacatatgaaaaaggacgtgggcaatctttccttggtccctgcaggtcagtgtagtagtacaggtgctgaagggattggttgtggtgggttcgaaaaatacccgtcaaaacaagtttcagtacatagagtcagatggaattataacccgggcagtgaaagatggttgtgctatggaggagctgcaggtattgtgaggtgccaagaaatcacttcagtgttcgctgtgcaataacacattcaaaaggattttggatatggaaatggtcgcatgactttctaaggcatcccctagcatttggaatcaagagaattcaagtttgaacaatcaaagttatcccatgtgggaaatgcattggaggttttctccgttgtatttttagcaatattattcaatccaaattcatattgccaatttattctgcatgtacagtctccacactatcattcccaatgatgacctgatttatattaatattttcattcaacttttcaacaatgtgaatctatcttaggatagatgaacatgaagatggtatagtttggatgagaaatagattggcatgctcccataaagaaccatccaggccatacaaaacaataaactgtgaattcatcactgttttcttaagtatcaaaccctcttcactaagaagatttacaatcatactaagttgacaaaatagagctatattagcatatagtactcttagaggccgaagataactaaccataaggccacatatagcaatagaattgacatgtaattagaacttttcttagggattcaactgctaatggcttcaccggctgatttgtaaaagaacattggtgattcttgaacaatgttccctcttgtaaggtgtaactccaatgagttgttcactctctatcaattcc

SEQ ID NO: 3389 - DNA, 447 bp, Pinus pinaster
cgccttccaaaagcaaaattacaaagaaatcaaaaaagactaccagtggaaagcattctacagcagatgtgacagaggacatggaagatcttccattagttccatcagtgaatgcaggtcgatgtagttcaggtgttgaagggttgagggatatgactagccctattgaaaaatcccttcaaaactagttgctgtacatagagttcgatggaatttcaacaaaggtagtgagagatggttgtgctattcaggagctgcaggcattgtgaggtgccaggaaatcacatcagtgtttctgcataacagttttcaaattgtcaaacaactacaggagatggtcacatgatattaaattaaatttatggttacttggccatttaaatcttgcctctaaatgttgtctttgtcctcctgcgacattgagcatcagctcagtagtcattgagt

SEQ ID NO: 3390 - DNA, 3170 bp, Pinus taeda
gcagccgaaggtagtagtagccggagctggagctgtcgcaggagcagaaactgcagctaaagctgaaggaatataataatggtaatgacaatggaagaagagacagaggtcaaggccagggataggggcaggggcaggggcaggggtagaggcagagggcggggcaagggcaggggcaaaaagaatgttacttttgacgacgaggacgaggagaatatggtaggagaagacatgaacagcatggatagctgggagcatgaccacgaactgcgtaaaactaaagagagaaagaggggaaagtccaaagagaaaccacccgctgtggcggtcgccagattcgatctcagcatcgacaatcatctcagattttgtgctaattattttccagaatttgggagactggaggaaggaggtggcaagttcaagtcactggagcgtattcaatccggtatcacttttgtaagagattggcagtcgtattgccgatatggcgttgattcaaaattagtgaaattcgcttgcgagaccaaggattctgaaatcaaggataatagtctttcggcggttatgcctcagttttctgccgctgctgttccacagtgggatagagggcctaccaacaatcccaacctctccaactctcggaatgactttgtgctaaatgtgggtggatctgtctgggcattggattggtgccctaaaggaaatcaaggtgctggaaaccaaattaactgtgagtaccttgcagttggagcacatccacctggctgttcatatcacagacttggtgtacctgtagctgggaaaggtgtcgttcaaatctggtccattttcaacactaatgtaagtgtaaaggatccaccttccaaacggcagaaagtaagagcaaaaaagcaaatggataaaagtgaacctgattatgaagacgacaaagtatctacagtgcctgtcctatttaaggagcatgtggttgggcaatactctgttcctgaaccagtagaagtgccggaaaaaagtgttcatgagggatccagccggatagaattggttgaaaagatagaggaaaatgggaatctagaaaatacacccaccacaatatcaattgattgtcgttatcaagagatgactgataatgatgctgaatggactgctcaaaaaagtaggaagaaaatgaaagataaagctcgatctaagcttattgatgatactggtgtgcttgtaccagaaaatatggttgaaaagtctgagtcttgtatggatattgttgcagcaaatgacatcattagaaaggacattgggtcaataggtataagagcaaaatcttctgctgtatcattggctgttgatgagaccagtatcattccaactgcagagtttggtttgcccagaatggttttgtgtttggcacatgatggggaaattgcttgggatgtgaagtggcaacccttaactgacaaggaccatcgaaatcaacatcgtcttggatttctagccgtcttactaggagacgggtcaatgcaagtatgggaggttcccgtcccaagtgcagtaaatttcttatttacttctagttatgctagaggtggcttggatcctcgatttgtgaaactagatcctgtctttaaatgctctaagcttcaaagtggaggtcgccaaagcattcctcttactttggagtggtctacttcagcacctcatgatctattgttagctggctgtcatgatggaatggttgctgtatggaaattctcccctaaggcttcttctcaagatgcaagacctctaatttgcttcatagcagatacacttgctattaggacattagcatgggctccaagtgatggtgattctgaaagcaaaaatgtatttgttactggtggtcatggtggcagtctgcgattttgggacttgcgggaccatttccggcctttatgggatcttcatctgtcaagaggaattattttgagccttgattggctgcatgagccaagatgtatcattttgtcaatggatgatggaacactgcgactccttagcttgacgaaagctgcattagacactccagtgacaggaagatcattttgtggaactcagtttcaagggttacaaagttattattgctcatcattttcaatttggagtgtccaagtatctagattgacaggcttggttgcatattgcagcgttgatggttctgctcttcattttcagcttactcagaaagctgttgataaagacaaaatgagacatcggaccccacattatatttgtggagcatttgttgaagaaggaagcaaggcattcaaagtcatttctccatcaaccctgacaccagtacgaatgaagaaatctctgaatgaatggagtgacactccaaggtccatacgaggttttttatctgagtcaaatcaggccataagagctaatatacaagctgcagataacaaatacatgcgatccagctcaatggagttagcagtagtatcagatgctgacactatcacgccttccaaaagcaaaattacaaagaaatcaaaaaagactaccagtggaaagcattctacagcagatgtgacagaggacatggaagatcttccattagttccatcagtgaatgcaggtcgatgtagttcaggtgttgaagggttgagggatatgactagccctattgaaaaatacccttcaaaactagttgctgtacatagagttcgatggaatttcaacaaaggtagtgagagatggttgtgctattcaggagctgcagggattgtgaggtgccaggaaatcacatcagtgttttctgcataacagttttcaaattgtcaaacaactacaggagatggtcacatgaaattaaaattaaaattttatggttacttggccatttaaatcttgcctctaaatgttgtctttgtcctcctgcgacattgagcatcagatcagtagtcattgagtgttaggctccaatcctccaggattttatttatatagatagattgatagtgcaagatgtcctcttgataaataatctgtatgacagagatccttgctggattttctgcattttgtcttgtatatagcaatataaatcaattgtccagttttcttgtttgcatatattctgaatttctttgaacagattcaacaatatgaatatagctttgaagtca

SEQ ID NO: 3391 - DNA, 631 bp, Podocarpus macrophillus
aactcctttgaagaaccaaagtggaaagaaatcaaagaagaccacgagtcggaagcattctgcaaaagatatgagagatgtggatggtctggccttggttcctgcaaatcaatacagtaattcaggtgttgatgcggctggtgggatcgaaaagtaccctccaaaaactagtagcagtacataaaattagatggaattttaacagggggagtgagagatggctgtgctatgggggagctgcaggcattgtaagatgccaggaaattacttcagcaattggtatgcaatagtattttccagaggcgcttggatgctcagatggcttcccttagcagatacgcaaccatcccattcatatttgtaactaaagcttctatggcaataaatagtgtattggatccacctttcaggatgcaatcacaactctatgggagaactaaatagcagataatgatcgatatctatgtgaaagaaataaggaaaaacacatatatggttttgaggaacaagagatttattatttacatagagacaaaagggaaaaacatgacataaatgtcataaaggtaaatgccacattcaggttacagtaaatcagttggttgagaataaaatgacagcatggaactta

SEQ ID NO: 3392 - DNA, 697 bp, Pseudotsuga menziesii
gaaagctgtcgataaagacaaaatgagacatcggacccacattatatttgtggagcatttattgaagaaggaagcaagacattcaaagttatttctccatcgaccctgactcctgtacgaatgaagaaatctcttaatgaatggagtgacactccaagatccatacgagggtttttatctgagtcaaatcaagccataagagctaatatacaagctgcagataacaaatacatgcgatccagctcgatggaattagcagtggtgtcagatgctgacactatcacaccttgcaagagcaaagttacaaagaaatcgagaaagactaccagtgggaagcattctacagcagatgtgacagaggacatggatgatctttcattagttccgtcagcgaatgcaggtaggtgtagttcaggtgttgaaggattgagggatgtgactagccccattgagaaatacccttcaaagctagttgctgtacatagagttcgatggaatttcaacaaaggtagtgagagatggttgtgctattcaggagctgcaggcattgtaaggtgccaggaaattacttcagtgtttgctacataacactattcaagtagtcaaaaagctactggagatgatcacatgaaattatatggccagttggccacctaaaacttgcttctatatgttgtgttaatatttagtcttgacc

SEQ ID NO: 3393 - DNA, 516 bp, Sciadopitys verticillata
aagaaatcgcttaatgaatggagtgatactccaagatccatacgtggttttttatctgagtcaaatcaggctttaagaactaatatacaagctgcagcagagaacaaatacatccagtctggctcatctgaattagtagcagtatcggatggagatactgtgataccttccaagtacacaatcccaaagaaatcgaaaaagggaaagagtgggaagcgctctaaaacagaggatgtgggtgatctgcccatggtttctgcaggtcaatgtagtagttcaggtgttgaagggattggttgcggttggatcgaaaaatacccttcaaaacaagtagcagtacacagagtcagatggaattctaacccaggaagtgagagatggttgtgctatggaggagccgcaggcattgtgaggtgccaagaaattacttcagtgttttctatggaatagttcaaaaagattttggatatggatatattcccaggactcttaaggctttttcctggcagatggaat

SEQ ID NO: 3394 - DNA, 716 bp, Artemisia annua
atgactggcatggtcgcatattgctgttcagatggtaaagttattcattttcagcttacagccagagcactgggaaaagaccatcacagaaaccgtgagcctcattatctttgtgggtctctatctgtggaagaatcgactcttactgttttttctcctttacccaatgtcccgtttacattaaagagatcattgaatgaatggggtaataccccaagatccaaacgtgggtttttatctcactgcaatcaagaaaagagagccaagaaagaaatctcaaaatgccaaacaacaggtaataactcggattcagaaggcaccatggtgacagcccaaaagaaaaagacctctcagaaaaccataaccagcaaagcattagtgtgcatagatgacgacgataagagtgaagaagagaatgtcatagaagaggaaaaggaaactcttcctcccaagattattgcaatgcatcgtgtaagatggaacatgaacaaaggtagcgagagattattgtgctatggaggtgcttctggaatcgtacgatgtcagctgattagatgacccagattatttacaaagtaatgtaagagaagtataatgaaaaatagtgcttcgatttttttaataaagtgcttcgtaagaggtggttagctaatattactcgtaagtcatcagctgttgttttttcaggtttttgtcacgaatgtctggttaatatt

SEQ ID NO: 3395 - DNA, 3002 bp, Manihot esculenta
atggaagaagaagaagtattagaaggcaatggtgctggaattagggtctcattgtttgattattcagtagaaaatcacttcaaggcaatggacacgatttctaagctatgtgaagaggcagagtctgattctctacaagaagctgaaattcagcgcttgtcctcttcaataacttttctaaaagaatggcgccagtttaagtaccaaccaagagttgttaggtttgcctgtgaaactgaaaattctcaggaaaaatgttttcttggtgacacaaatttaccgcagttttcatcagcgactgttccagaggagggactacatggggatgctgcatctgtagaacctagcaaagactttgtgatgtatgttggaggttctgtttgggcattggattggtgtcctaggtttcatgacaggcctgccagttgtgtcaaatgcgagtttgttgctattgctgcccatcctcctgactcttattatcacaaggttggcactttgcttacgggcagaggtcttgttcagatatggtgcattctaaatgtcagtgagaatgatgaggcaccaccttcactaaaaaagccaaaacggggacatcacagtagtcattccgtgggtgataaatcaagtctaataataaaggggccgaaaggcagacctagtaagaagcaagtagaatctcccaatggcaacggcacagaggagaattctattcaattcaagaggccaagaggtagacctagaaagcagcaaatagaaaaacctcccagtgatgaagccacaaaggagtcttcaactcaatttaaaaggccaagaggacgacctagaaagaaggaaataaatgaatctcttgataattcagattgcaaaaatcaatgtgttgaagcccttgctgttcaatatccagaagattcatctcaattacttgctatagaatgggtttctggaaatactcaagaacaaaccatacaggaaaacaagggtagaaaacggaaggcttctaccaaggcactgtctgcatgtaattcagctgcagaaactactgggagtagaaggcagaaaaccaaggcaagtgcagctggtaaatgtgctggtgaaacatgcccgccattgttgactcaaaatgatgatgatcaatcttccccagcaatccaccaaatacatgaaaacactatacaggatcctgcagtgcttaattgtagttcagataatgttcctcaggagaacaactctgattctttttctattcccaaggatattgctttgccaagactagtattatgcctagctcataatggaaaagtggtgtgggatgtgaaatggcagccttgccattcatcggattccaaatgccagcatcgcatgggttatcttgctgtcttattgggaaatgggacactggaagtatgggatgttcctcttcctcatatattgaaagttatttattcttcttctcatagagaaggtactgatcctcgctttgttaaattggagccagtattcagatgttcaattgccaagtgtggggaaatacagagcattcctttgacagtggaatggtcaacgtcatgtccccatgattacttgcttgctggatgccatgatggaacgtatcttcttccaaactacaataatacaaggcctttgctacgtttcagtgcagatactcttgctattagagcagttgcttgggccccagttgggaggtcatatccaagagagtgcaaatgtcatagttactgctggacatggagggctgaagttttgggacttacgtgatccatttcgacctttgtgggagctccatcctgcaccgaaattcatttatagtctggattggttgccagatccaagatgtattctcttatccttcgatgatggaacgatgagactcctcagcttgacgaaggctgcatatgatggtcatgttaatggaaaacctacagttgggcctaaacaacaaggaatacatgtttttaattcttcatcctttgctatatggagcgttcaagtgtcgagaaaaacaggtcaactgaaaatgcttgcttctctttttttattttaaaaaattgccttcattgataaacttattgatgaatttcaataggcatggttgcatattgcagtgcagatggtactgttaaccgcttccagcttacatggaaagcagtagagaaagaagcatcaagacatcgagctccgcattttatggttgggtccttgagcaaggatgaatcatctattacagtaaatactccattgctggattctcctctaaatttgaggaagccatttagtgttggggacaatccaagaactatgcggagtttattggagtttaatcagacaaaaagagcaaatgataagaaagcaaaagcaccagctgcggaaaatcaaccattagctctatgttgtggcaatgatccaggtacgcaatctggacctgatgaaacattggctgctctcaaaaaccgaattaaaccaaaatccaaaaatgccagtactaaaatggccggagagaatctggcattagtatgcgtagatgaacgaaaagacagaggggagaaagacggcgaaaaggcagaagctgcaaaagaaagagaagttatgcctcccaaaattgtggcaatgcatagagttagatggaatataaacaagggtagtgagagatggttgtgctcaggaggagcagcaggtattgtacggtgtcaagaaattatattttctgatacagataaatatttggccagcaaaagataagatttggtcatgttgtcctaatttatacgtaattgttagtgtttatgagaggttttcaaagctaaaagctccctctatgcaaattttgtcgacccatttcctacaagtctctgtgttatgaatccctgtaacgaagtttcctcttatgtagttgctgccttacagttaattgaggcgaagcattaatacatggaatgtgaagttcaaatttcaatcaatttgaaaaaaaaagaaaattggagatt

SEQ ID NO: 3396 - DNA, 647 bp, Ricinus communis
attatttttgaattttaataggcttggctgcatattgcagtgctgatggtactgtttgccgcttccagctcacaacaaaagctgtagagaaaagcccatccaggcatcgaactccacattttacggttgggtccctgagtaaagatgaggcagccattaccattaacattccattaccagatacccctttaactttgaaaaagccagttaacattgttggggacaatccaagatctatgaggagtttattagagtcgaatcagacaaaaagagctaatagtagcaaggcaaatgcaccagctgcagataatcaactattagccctttgtgatgtcaatgatccaggtgtgcaatctgaatcagatgaaagtcttgcagctttcagaagtcgaactaaatcaaaatcgaaaagtatcagcaagaaaatgacaggagaggacctagcattggtttgcatagacgaaggacaaaataacagatggcagaaagagattgtaaaagcagaagttgcaaatgaaattgaggttatccctccaaaaataattgcaatgcatagagttagatggaatataaacaaaggtagtgagagatggctgtgctctggaggagcagcaggaattgtgcggtgtcaagaaattatattgtag

SEQ ID NO: 3397 - DNA, 2609 bp, Ricinus communis
atggtgaaagaagcagaagaatcattagaacgcaataatgatacagaaattagggtttcgctgtttgataattcaattgataattacctcaatgcaatcgacaaaatttctaagctatgtggagagacggtgactgattctcctgaaattcaacaattatcttcctcaataactttcttaagagaatggaagtattattattgtgaacctaaaacaattaggttctcttgtgaattggaaagttgtcaagagaaaggttttcttggtgaagtaaatttacctcagttttcatcagtagctgttccaaggaaagagaaactatatgggggtagtgcatcgtcagaatctagtaatgactttattatgcatgttggagggtctgtttgggcattggattggtgtcctaggactcatgaaaggcctgctgaccatatcaaatgcgagtttgttgctgttgctgctcatcctcctgactcttactatcacaagataggcgcttcacttactggcagaggtatagttcagatatggtgtattctaaatgtcagtggcaatgatgaagagacaccactaccactaaaaaagtcaaaacagggaactcaaaatgaggatgcttgcaatggcgaatcagctctggtaaagcggcccaaaggacgacctagaaagaagcaactagatgaatcttcgaatgatgaggccacaaagcagaactgcactcaattcaagaggccaagaggtagacccagaaagaagcaaatagaagaagctcttaatgctgaagccacgaacgagagtttaactaaacttaagaagacaagaggacgacctagaaagaaggcaaacgatgatcttgataatatattttgcaacaaccaatatgttcaagcccttgctgttgaatacccagaagattcatctcaagtgcttgctatagaagggatttctgagaatacccaaagacagatcattgggaaaaacaagggaaagaaacgaaaaagttgtaccgaagcttttgtacaggatcctgctgtgcttaattgtggtttagataatgtttctggagaaatcaacactggtttttgttctatcccaaaggatgttgctttgccaagagttgtcttatgcatagctcatgatgcaaaagttgtatgggatgtaaaatggcagccgtgttatggatccgactccaagtgccagcatcggatgggttatcttgccgtcttgctaggaaatggattccttgaagtatgggatgttcctcttcctcatgtaacaaaagttatttattcttcttctaatagagaaggtactgatcctcgatatgtcaaattgaagccagtatttagaggttcaattgctaagcgtggggaaatacagagcattcctttgacagtggagtggtcaacttcataccctcatgattacttacttgctggatgccatgatggcacggttgctctatggaagttctctgcgagtggcttatctggagatacaaggcctttgctgtgcttcagtgcagatacagttgctattagagcagttgcatgggcaccagctggaagtgatcaagagagtgacaatgttatagttactggtggacatggaggcctgaagttttgggacatacgtgatccgtttcgacctttgtgggacctccatccagcaccaaaattcatttatagtctagattggcttccagatccaagatgtattatcctctcctttgatgatggaacattgagactccttagcttggtgaaggcggcatatgacgcccatgttaatggacaaccatctgttgggcctaaacaacaaggaatccaaaatatttttaatttttcatcctttgctatctggagtgttcaagtgtcaagaaaaacaggcttggctgcgtatagcagtgctgatggtactgtttgccgcttccagctcacaacaaaagctgtagagaaaagcccatccaggcatcgaactccacattttatggttgggtccctgagtaaagatgaggcagccattaccgttaacattccattaccagatacccctttaactttgaaaaagccagttaacactgttggggacaatccaagatctatgcggagtttattagagtcgaatcagacaaaaagagctaatattaacaaggcaaatgcactggctgcagataatcaactattagccctttgtgatgtcaatgatccaggtgtgcaatctgaatcagatgaaagtcttgcagctttcagaagtcgaactaaatcaaaatcaaaaagtatcagcaagaaaatgacaggagaggacctagcattggtttgcatagatgaaggacaaaataacagacggcagaaagaaattgtaaaagcagaagttgcaaatgaaattgaggttatccctccaaaaataattgcaatgcatagagttagatggaatataaacaaaggtagtgagagatggctgtgctctggaggagcagcaggaattgtgcggtgtcaagaaattatattgtctgatacagataaacttttggctaggaaacgataataggcaacaagatgtacatttgattatgttgttgttactgtaatttacatagatcgtagttagtg

SEQ ID NO: 3398 - DNA, 831 bp, Centaurea maculosa
cgggagcaagttttgggatctcgtgatccgtttcgtcctctttgggacataaacccgaacgagaggatcataaatagtctggactggcatcccgatcctagatgtgttgttttatcatttgacgatggagaaatacagataatcagcatatcaaggtctgcgtgtgatgtccctgttaccggtggatccttggtttcggcacacaaacatgcatcacatagctatcattgttccttgtcttcaattacgagtattcaagtgtcaagactaacaggcatggttgcatactgctgttcagatggtaaagctctatatttccagcttacaatcaaagcagcggagaaagacccatcgagaaatcgggagccccattatctttgcggagctgtgaccatggaagaatcaactcttaccgttttatctccattacccaatgtaccatttccgatgaagaaatcatcaaacaaatgggacgacaccccgagatcgagacgtggctataaatcccgctcgaatcaggagaagagagccaaggagcagatgttgaaatgccaaccaccagaggaacaacaacctttagcgctttgttacgatggcaatgatggcaatggtggagggagcgattcggggtcggatgagagcagttcgaaaaaaggaaaaaaagaaagagaagaagaggtagaagtgcttccttgtaagaaggttggaatgcatggtgtaagatggaatacgaacaagggcagcgagcggtggttgtgttacggtggtgccgccggaattctacgatgtcaggaggtttctacaccttattaattatttaaaggcacataa

SEQ ID NO: 3399 - DNA, 213 bp, Castanea mollissima
taccagaggatgacctagccttggtatgcagagatgaagagccaccaaatacacagggaaaagaaaatggaaaagctgaagctcgaactattgaagttttccctccaaagattgtagcaatgcgtagggtgaggtggaacatgaacaagggtagtgaaagatggttgtgctatggtggagaggccggagttgtacgttgtcaggagattgttt

SEQ ID NO: 3400 - DNA, 544 bp, Cryptomeria japonica
agaacaagtatatacagtctggctcatctgaattagtagcagtatcagatgaatataatgtgacaccctccaagaaccgaattgcaaagaaatcaaaaaaggtcaccagtggaaagcatactacaaagcatatgaaagagagcatgggtgatctttccttggttcctgcaggtgcaggtcaatgtcatagttcaggtgttgaagggattggttgcagtaggattgaaaaatacccgtcaaaacaagtttcgatacataaagtcagatggaattctaacccaggtagtgagagatggctgtgctacggaggagctgcgggtatcgtgaggtgccaagaaataacttcagtattcgctgttcagtaacacattcaaaaggattttgaatatggaaacagtcatgactcagtaaggcttcccctggcatatggaatcgaaggatgttaagttttaacaatcaaagttattcaacgtgggaaatacattggaggttttctccattgttgtattttaagcagcagaattcaatctaatcacttttcagc

SEQ ID NO: 3401 - DNA, 2213 bp, Mimulus guttatus
tcatcatctactaaattaatcataggggtggaggacgaaggagatgtggagttcaacaccgatgctcccatttcccaatcatttaatcgaaagagaaaaacaatcaacgagaaccctgcccaattgccgcccgccgatggtccaccggaaatcgcagtttctgaattcgaatactctgtcgagaatcacttcaaatacgttgacaaagtagccaaactctgttcacaccccgaaacactcgaccctcccgaccaagccgacattaaacggatctccaattctataactttcttgagggagtggagggattttaattatggcccgcgaattgtgaggtttgcttgccaatatagttccaaggagaaagatgtaattggtggggctaccttgcaccaattttcatctgcatctgttccaaagaaggagacacgaaatggcgacgaatctggtactgaattcagcaaagactttgtaatgcatgtcggcggtgcagtctgggcgttagactggtgtaattgtcacttggttctctcgtgtttgctatcccatcttttgagcgtggcctcgtcgaaattgcttattgggtttgtcgctgtggctgctcatccgcccgaatcttcacatcacaagatcggtgcccctttaactggcagaggtgcaatccagatatggtgtttgttaactctatacgtaaaagaagatgcggcttcgaaagggacaaaaaagccaaaaccgatttcccaagaactggcaacagtcaacgatccgaataaagtactaaagccaagagggagaccaagaaagaaacccattaccgatactgtcgagaagattgataggccaagagggcgaccaagaaaaaatccgattaacgatactagagaatctgcccttgtgaatccactagtatctgcaacgagcttcggtttagattccatgagccctcctaagaacgttggatcttgtgatgctaatacttttaagcattcgattcccgtggatgttgagttgcctagaatgatgctatgtttagctcacaatggaaaggttgcatgggatttaaagtggcggccggtcgatgttcatggccctgcttcgaggaatataatgggttatcttgctgtcttgcttgggaatggtgcactagaagttattcctctaacattggagtggtctgtgtcggctccctatgatacgattgtagctggatgtcatgatggagtggtggctttatggaagttttcggctaccgattcattaacagaaacgagacctttgctttccttcagtgcagacaccggtcctattagaacactggcatgggcacctaatcaaaccgatctcgagagtgcaaatgtaattgtcactgcgggtcataaaggcttcaaattttgggacatacgtgatccgttccgtccattgtgggaccatgctatgcagggggtcacttacggtttgtcttggctgcgtgatccaagatgtgtctttggttccgtcgatgacggaacactgtggtttcaccgtctagagaacacagcctctgatattccaattactggcaaatgtgttgctgcagcaacaaagcagggtttccacagtttcgactgttcctcgttctcaatatggaatgttcaagcttctccgctgacaggcgtggttgcatattgtggtgaggcaggaacaaccctttgcttccagccaacagccagatcggtgaaggacccttcgcgaaaccgtagaacccacttgctctgtggatcactgttggaggaggaagatgcccttattgtagcaactccatcgactagtacttctcactctagaagatacccgggcatgaaacgagaagtttttcccgggaaaaacgtggccattcatagagtgagatggaatgcgaataaaggcagtgagaattggctgtgctacggaggagctgctggtttgctacgctgtcaacagatcgattcgtctcttctccaatagtcgtagggttagttatgcttctgttgtactatagtgttgtaccagtatgaatatttatttgtgttaggctttttagataattttagaaaatacagtcaattttattcaagtaagttaatatactaatatagtatctatatttacgaatactgtatattaagagtagaggtggcattaaaatgttcatcaagttggaatcaagtaattaattttactagcaatatattttc

SEQ ID NO: 3402 - DNA, 1276 bp, Tropaeolum majus
attcctctgacattggagtggtcgcctttgagccgacctgatttcattcttgttgggtgccatgatgggacggttgctatgtggaagttctctccaagtagttcaccaaaagatacaaggcctttactccgtttcagcgctgatacagctccgattagggccatctcatgggccccagccgagagtgatccggaaaatgcaaatgtgatactcactggtggacagggaggtttaaagttttgggacatacgtgacccgtttcgacctttgtgggacatcacaatgacaaggttcatatatagtctggattggctgccggatccaagatgtgtagttatatcctttgatgacggaacactgaggatcatcagtttggctaatgtgctaaatgacgttcctgtccctggaaaacgttgtactggggcaaaaccaaccctgagtcttttcaattattcatctttcgctacctggagtgttcaagtttcacgacaaacaggcgttgctgcgtattgctctgcggatggaactgttctatgcttccagcttaccgtcaatgcagtggaaaaagattcaaggtatcgaccctctcattttctgtcatggtttctgacggaagaagaatccacttacatagtcaacactccattacccaataatccattgaaaatgaagaagatgccaatcagtgaatcaggcgaagccccaagatccatgcgaagcttgttggctgattcaaaccagacaaaaaacataaacaataagaagccaaacaacactcaagcccgagatactcaacacttaggtgtttgctatgatagtgatcccactgtagaagaacaacgcggacataagaagaatcaaaagacgaaagatgttaatgccgaggtgaaagagaaagataaaaaagaaacgagaatgaaacattagtatttccttcgaaaatggtagcgatgcagagagtgagatggaacatgaacaaaggtagcgagagatggttatgctccggaggcgcggctggaattcttcgagttcaaaagattatactgcctcaaattaaaacgaatctcaaccgaaaaaatagtcaactaaattagacttgtacaaaatgctaagttatatgttaaatcttattttgcttctcttcttttagttgaataaactgttttacgagatgctaaataacctatgtatccttagattgctatacaacgacattttttaggttgccctccaatgaacaaattttaggtgcaccaaactaataaaaagttgaata

SEQ ID NO: 3403 - DNA, 2370 bp, Quercus alba
cagatcttgctgcagcaaagactttgttatctatgttggagggcatgtttgggctttggattggtgtcctagaatttgtgaaatgccagactatcataataaatgtgagtttatcgctgttgctgctcatcctccgggaacttcatatcacaagatgggtgccccacttactggtagaggtgtcattcaaatatggtgtcttatgaatgtcggcgtgaatgaggaagaggtgccaccttcattagcaaagccaaaacagggaaccaaaaataatggggccgtgacagatgattcaactttatcaaagaggcctagaggaagacctagaaagaggccagtagaagacacaactcaatcaaagaggcctagaggaagacctagaaagaatttgatcgaacaatctcttgataatttggctgttcaagctctggctgttaaacacgcagaagattcattggaatcacatgctgtggatgaggttcctgggaatgccaaagaaggttctgtacaagaagacactggcaaaaaacacaaacgacagaagcgagccgtatctgcatgtaaactagcacttgaaactcctatgcagagcagaagattgaaacataagaagcgggcagtgagccacagtgataatacaagtccactgttattaacacaaaatgaagacatgggatcttctgttacaaataatcaaatacaacattactctggacaggaacttgctgcaagtgataatgtgtctgacaaaggttccttaggaactagctcagctagttccttgatttcaaaggatgttgctttgccaagagttgtattatgcctagctcataatgggaaggttgcatgggatgttaagtggcgaccttctaatgcatgtcaatccaaatgtaagcatcggatgggctatcttgctgtcttgctggggaacggatctctggaagtttgggaggttcctcttcctcgtacaatgaaagttatctattcctctgtgcatcaggagggtacagatccccgttttgtaaaattagagcctgtattcagaggttcattattgaaatgcggtggcatacaaagcatccctctgacagtggagtggtcagcttcacccccacatgattacctacttgctggatgccatgatggaacagttgctttatggaagttttctgcaagctgttcatctgaagatactaggccgctgctttgcttcagtgcagatacagttcctattagagcacttgcctgggctccacttgaaagtgatccagagagtgcaaatgttatagttactgctggacatgggggcctaaagttttgggacctacgtgatccataccgtcctttgtgggacctccatcctgtgccaaggatcatatacagtctggattggctgtcaaatccaagatgtgttattctatcctttgatgatggaacaatgagaatcctcagcttgcttaaggctgcatatgatgttcctgtcactggaaaaccctttggtgggacaaaacaacaagggttgcacagttattactgttcatcatttgctatctggagtgttcaagtgtcacgaataacaggcatggctgcatattgcactgcagatgggactgttctccgtttccagcttacaagcaaagcagtagacaaagatccctcacgaaatcggaccccacattttctttgtgggtcactaaccgaagaggaatcacttatcactattaacactccggtaccaaatacccctttcccattgaagaagtcactgaacaagagcggggacacccctttatccatgcgggagttttcatctgagccacagcatgtgaaaagagcaaatgataagatggcaaaaggtcctagtacggatgccaaaactttagccctttgttatggcgatgaccctggtacagaatctggaactgaggaagcattgacatgtcccaagagcaaaaagagaccaaattctgcaataaaaaaaatccagaggatgacctagccttggtatgcagagatgaagagccaccaaatacacaggaaaaagaaaatggaaaagctgaagctcgaactattgaagttttcccgccgaaaattgtagcaatgcgtagggtgaggtggaacatgaacaagggtagtgaaagatggttgtgctatggtggagaggccggagttgtacgttgtcaggagattgttttgtctgatgttgataggaaattggccttgaagagatgagacgagtccctaatctgtatatatttgttcctcttcttaaccaatctatttatttttgtttaattttctcaactagctatttaatgtaatttccctattcaattccgcgtgggtgaatgtataggtttcttttgttgc

SEQ ID NO: 3404 - DNA, 2282 bp, Cajanus cajan
ggggtgtgacgttcaaattgcacaaaattctaccgagtttcctgcttccgatgggaattttgaaaagaatgaagaaatacttcttattacatacaaaagaaaaagaggagctaaaagaaataatgagacaaatgaaaaatcagcagtaataaagaggcctagaagaagacctaaatcaaattcaagaggagtaatggaagatggttcagattgtgaggatgaatctatgcctcttgatgtttcaagtactagaagattcaactaaattgctttctccagatgtggctcatgacaatgaatatgctatgcaacaatattctgttacaaagcaaaggcacgccaaggaagctgtttctgcctgcaatactatttcaacaactcttgttaaaagcagtggattaaaaaataatcatactgaggagatatatggccatgacataagtcagccagtacagtatgaaaatgaggcaaatcatcaaccaaattgtacctctgaattggaagctcgaccagctacttgttctattccagaagatataactttgcctagattagtctcttgcctagctcataatggaaaagtggcatgggatgtgaaatggcgacctactaacatttctgattcttttggaaaataccgaatgggccatctggctgtcttgttgggcaatggatctttggaagtttgggaggttcctcttcctcatgttatgagagaaatttatatgcatagagagggcactgatccacgttttataaaacttgaacctgtatttaaatgctcaatgttaaagcgtggtggcttgctaagcattccactgacagtggagtggtcagttaagccgcctcatgactatttacttgctggctgccatgatggaatggtggctttgtggaaattttgtacaaattcttcatccaaatgcgaggattcaaagcccgtgctttgttttggtgcggatacagttcctattagaactgttgcctgggctccatttgaaggtgatccagagagtcctaatatagtagtaactgccggacatgaaggccttaagttttgggatctacgtaatccatttcgtcctttgaggagcctccatcctgcgccaagaatgatatatagtctagattggctgtcaaacccaagttgcatcgttatgtcctttgaggatggaacaatgagaaccattagcttggtgaaggctgcaaatgacctccccgtcactggagaaatatacagtggaaaaaagcaatttgggttgcatggttcttcatattcatcttttgccatttggagtgttcaagtgtcacgtataacaggcatggttgcgtattgtggtacagatggtgctgtctttcgttttcagcttactactaaagaagtggagacagatcatgtgcgcagtcgatccccacgcttcctctgtgggttggtaactgaggaagattcaactatcgttatcaacactcctgtgtcaaacactcctttcctatggaaaaagccacaagacaaaggtcgatatgcagaatctttccgagacctattatccaagacaaatgcaagcaaaagtgcaaataatcaaatggcagaaactccaaattctgactctcagactttagcaattggtgctggtgagaatgcgggtttggaagttgtttctgtggaagctttatcttctgtgaagcagcccaaaaggccaaaactgaatagtggcagcaagaaaaaaactgtagaaaaaccagatctggtatgcaaagatgatgatgatgtgtcagcaatgactcccgggactgatgatgaaaagtcagattttgggaatatacctgaagtcttccctcccaaaatggcagcattgcacagagtgagatggaacatgaacaaaggtagtgaaaaatggctgtgctttggaggagctagtggacttgtacgatgccaggagattgtttactctcatattgataagaaattggccttgaagagatgacagtttcttatccattaaatcacagtagggaaaaaatagacaatatgtaacatcttttattcattcaaaaaagtaaaaggacttggcttttttagcaagtccacctgtgtaaatttaatttgtaatatttgacaatagtgaataaaaccaccacctaggacaatggctgctcatgtcatataataagagaaaggtttatgttcctgtaccttcagtcatatggaagatggaagattggtctcatttgacaagaaccatttatttactgttgaaaatgttttatatatcgaaagacat

SEQ ID NO: 3405 - DNA, 1300 bp, Pinus taeda
gggctggtggtcatggtggcagtctgcgattttgggacttgcgggaccatttccggcctttatgggatcttcatctgtcaagaggaattattttgagccttgattggctgcatgagccaagatgtatcattttgtcaatggatgatggaacactgcgactccttagcttgacgaaagctgcattagacactccagtgacaggaagatcattttgtggaactcagtttcaagggttacaaagttattattgctcatcattttcaatttggagtgtccaagtatctagattgacaggcttggttgcatattgcagcgttgatggttctgctcttcattttcagcttactcagaaagctgttgataaagacaaaatgagacatcggaccccacattatatttgtggagcatttgttgaagaaggaagcaaggcattcaaagtcatttctccatcaaccctgacaccagtacgaatgaagaaatctctgaatgaatggagtgacactccaaggtccatacgaggttttttatctgagtcaaatcaggccataagagctaatatacaagctgcagataacaaatacatgcgatccagctcaatggagttagcagtagtatcagatgctgacactatcacgccttccaaaagcaaaattacaaagaaatcaaaaaagactaccagtggaaagcattctacagcagatgtgacagaggacatggaagatcttccattagttccatcagtgaatgcaggtcgatgtagttcaggtgttgaagggttgagggatatgactagccctattgaaaaatacccttcaaaactagttgctgtacatagagttcgatggaatttcaacaaaggtagtgagagatggttgtgctattcaggagctgcaggcattgtgaggtgccaggaaatcacatcagtgttttctgcataacagttttcaaattgtcaaacaactacaggagatggtcacatgaaattaaaattaaaagcttatggttacttggccatttaaatcttgcctctaaatgttgtctttgtcctcctgcgacattgagcatcagatcagtagtcattgagtgttaggctccaatcctccaggattttatttatatagatagattgatagtgcaagacgtcctcttgataaataatctgtatgacagagatccttgctggattttctgcattttgtcttgtatatagcaatataaatcaattgtccagttttcttgtttgcatatattctgaatttctttgaacagattcaacaatatgaatatagctttgaagtca

SEQ ID NO: 3406 - DNA, 257 bp, Rhizophora mangle
caagacaaaagcaaagacaaagcgaagtctaaaaccgaaacaagaaaagttgggagaggatcgagcactgatactcagagatgaagagcaggacaatgtaccaaagaaagagggtgaaatgggtggagccggaaatgagatcaaagttatccctcccaaactcgttgccattcatagtgttagatggaatatgaacaagggaagtgagagatggttgtgctccgggggagcagcaggaattgtgcgatgccaagagg

SEQ ID NO: 3407 - DNA, 880 bp, Picea glauca
  misc_feature (380)..(380): n is a, c, g, or t
  misc_feature (728)..(728): n is a, c, g, or t
caaaatgagacatcggacgccacattatatttgtggagcatttgtgaaagaagaaagcaagacattcaaagtcatttctccatcgactctgacgcctgtacgaatgaagaaatctctgaatgaatggagtgacactccaaggtccatacgaggttttttatctgagtcaaatcaggccataagagctaatatacaagctgcagataacaaatacatgcgatccagctcaatggaattagcagtagtatcagatgctgacactatcacgccttccaaaagcaaaattacaaagaaatcgaaaaagactaccagtggaaagcattctacagcagatgtgagagaggacatggatgatcttccattagttccatccatgaatncaggtcgatgtagttcaggtgttgaagggttgagggatatgactagtcctattgaaaaatacccttcaaaactagttgctgtacatagagttcgatggaatttcaacaaaggtagcgagagatggttgtgctattcaggagctgcaggcattgtgaggtgccaggaaatcacttcagtgtttactgcataacacttttcaagttgtcaaacagctacaggaaatagtcacatgaagtttaaattaaaattttaggatcagttggccacctaaatcttgcctatatatgttgtgttaatattcagtctttgacctcctgagacattgagccatgacctcagaccggtgntcatggagtgttaggctccaatccttcaggattttatttatatagataaatagatagtccaagacgtcctcttggtaaatagtctctatgacagagatccttgctggattttctgcatgttgtcttcttgtatatagcaatataaattaatt

SEQ ID NO: 3408 - DNA, 306 bp, Glycyrrhiza uralensis
ccattgcatagagtgagatggaacatgaacaagggtagtgagagatggttgtgctttggaggagctaatggaattgtacggtgtcaggagattgtttacaataatactgataagaaatgggccttgaagagatgacaccatttcattcacttaaatttgaagtcttaaaatgttgccttgaatgagaatgtgtaaatttgtataaaaagacggtaggaaaaaatcgtagtcaatggtgacgagtcatcatgtaacagaattcactatattcattattaaatttgtatctaaataacattatgtaga

SEQ ID NO: 3409 - DNA, 1938 bp, Triticum aestivum
  misc_feature (4)..(4): n is a, c, g, or t
  misc_feature (6)..(7): n is a, c, g, or t
  misc_feature (23)..(23): n is a, c, g, or t
  misc_feature (26)..(26): n is a, c, g, or t
  misc_feature (39)..(39): n is a, c, g, or t
  misc_feature (146)..(146): n is a, c, g, or t
  misc_feature (212)..(212): n is a, c, g, or t
  misc_feature (245)..(245): n is a, c, g, or t
  misc_feature (285)..(285): n is a, c, g, or t
  misc_feature (287)..(287): n is a, c, g, or t
  misc_feature (314)..(314): n is a, c, g, or t
  misc_feature (588)..(588): n is a, c, g, or t
  misc_feature (603)..(603): n is a, c, g, or t
  misc_feature (1631)..(1631): n is a, c, g, or t
  misc_feature (1726)..(1726): n is a, c, g, or t
  misc_feature (1733)..(1733): n is a, c, g, or t
  misc_feature (1745)..(1745): n is a, c, g, or t
  misc_feature (1851)..(1851): n is a, c, g, or t
  misc_feature (1907)..(1907): n is a, c, g, or t
tttntnntcagaaggttgacagngangaggagaatgaancggctcagtctgatgttgctgataaatttgcgcagaaattagctaaagacacatcccttactagttggcactcaggatttcatgtatcattggacatgttgccggantatatccacatgcgagttgcagaatcaattctattcgctggcaaagcaataagggttcttagaaancctagtcctggtgctacattgctggaaccaacnaaccaaagtcagacattgaaaggatctcatagaatgcaangnttcacggggggctccggtgctctgaangagctgccaaacttctctaacattagtgcagaagaattattgccacaggctgaagcagataaagttgatgccatgcttaagcagctaaagcatgcttccgagttccataaaaggttgtttgagtctgctgttagctcaatacgtacaattgcagctaaccatctttggcagttagtggttgtacgcgctgatctcaatggccacttgaaggcacttaaagattattttcttttggcgaaaggtgattttttccagtgttttcttgaggaaagcngtcaattaatgcgcntaccacctcgtcaatctacagctgaagcagatctcattgtcccatttcagttggctgcgctgaaaactataggtgatgaagacaaatacttcaccagggtatctctaaggatgccactgtttggtatgaaatctagtacatcacagaaagatcttcagaagtccaacacatcagatatttccttgcatggaaaggctagctcagagttggcacttgatggttggcatagtattgccctggaatattccgtcgattggccactacaactcttctttactcctgacgttctttctaagtatcgcaaagtttttcagtatctcattcggttgaagaggacacaaatggaattggagaaatcctggacagctgtaatgcatcaagatcatgttgatttttctgattattgcaaggatcggaagaattcctctgcaacacaactgcgtcggttacgcacgaagcctttttggcgagtaagggagcatatggctttcttgatcagaaacctacagttctacatccaggttgatgtaattgaatcacagtggaatgtcttacaaactcacgttcaagactcacatgattttacagaactagtgacctttcatcaagactatttgtcggcattgatatcacagtccttcttggatataggatcagtgtctagaatactggacagtataatgaagctctgcttgcagttctgctggagtatcgagcaatacgaaacaggctcaaacatgtttgagattgatcacataactgaggagttcaacaagaaatcaaattcgctgtacaccatcctaaggagtagtcgacttgctggaagtcagagagcacctttcctgaggcagtttctgatgagactaaacttcaactctttctttgagacaactgcgaggggtgtgatgaattcaggcaggctgcggccaggcacagcgagtacccagctgtaagcctatcgccacagcggctgttctcgccgtgatttgcacgacaatgctgctacgtactgacaatggcgcaaaccngtcacacaagaaggggaggaagaatctgtaggatctgtaaattagctgtagcatgtgagttgttttgccctgggaagtaaacacttggtgatgtntgtttgnctagtgttgtgntgtgcacgtctttgcgttgcttgcctaccttccccatgttattggtatctctattgggaacatggtgtgtggccttagatgaaatggtagcgaacccgttcagtanttcagcaacactgcaaggtttacattgcaactgttctggaaggatgaatgcaacantgaaatgaatcccaaagaatatggggattta

SEQ ID NO: 3410 - DNA, 1326 bp, Saccharum officinarum
gccttttgagtctgctgtcggctcaatacgtacaattgcagctaatcatctctggcagctagtggtggtacgtgctgatctcaacggtcatttgaaggcattgaaagattattttcttttagcaaaaggtgactttttccagtgttttcttgaggaaagccgccaattaatgcgtttaccacctcgtcaatctacagccgaagcagatctcatgatcccatttcagctggctgcactgaagactatcggtgaggaagacaagtactttaccagagtctcattaaggatgctatcatatggtatgaaaagtagcacatctcagaaagatctccaaaaacccaatgcttcggagctttcttcacaaggaaaagctacatcagaattagcacttgatgggtgggatagtattgctctggaatattctgtcgactggcctctgcagctcttcttcactcctgatgttctgtccaagtatcgcaaggttttccagtatctcatccgattgaagaggacacaaatggaacttgagaaatcctgggcagctgtaatgcataaagaccatgctgatttttccgattactggaaggatcggaaaaataactctgcaacacaactgcgtcgacaacgctctaagcctttgtggcgagtaagggagcatatggcattcttgatcagaaacctacaattttacatccaggttgatgtaattgagtcgcagtggaatgttttacaaatctcatgtgcaagattcacatgattttacagagctagtgagctttcatcaagaatatttgtcagcgctgatttcacaatccttcctggatattggatcagtctctaggatactagacagcataatgaagctttgcttgcagttctgctggagcattgagcaatatgaaactcgccgaaatatttctgagattgatcacataactgaggaattcaacaagaagtcaaattcgctgtatactatcttgaggagcagtcgccttgcgggtagtcaaagagcacctttcctgaggcaatttctgatgaggctaaatttcaactctttctttgagaccaccgcaaggggagtgatgaattcaggaaggctgcgcccaagcactgcaggttctcagctgtaacagtgactgttgacgtgtgactttgcatcctgtggtttacacgggagtgatgggattggggacctggtgtagtgcctgcaagagacatgcggcggagtcttcgttggttatgtaaattatgaatcggccgcggggtgccctgtctggtacatggactaatagatgattcatgcttggggctggtgggtttttctgg

SEQ ID NO: 3411 - DNA, 1551 bp, Panicum virgatum
  misc_feature (629)..(629): n is a, c, g, or t
  misc_feature (769)..(769): n is a, c, g, or t
  misc_feature (778)..(778): n is a, c, g, or t
  misc_feature (1256)..(1256): n is a, c, g, or t
  misc_feature (1281)..(1281): n is a, c, g, or t
  misc_feature (1290)..(1290): n is a, c, g, or t
  misc_feature (1296)..(1296): n is a, c, g, or t
  misc_feature (1299)..(1299): n is a, c, g, or t
  misc_feature (1305)..(1305): n is a, c, g, or t
  misc_feature (1315)..(1316): n is a, c, g, or t
  misc_feature (1333)..(1333): n is a, c, g, or t
  misc_feature (1350)..(1350): n is a, c, g, or t
  misc_feature (1355)..(1355): n is a, c, g, or t
  misc_feature (1380)..(1380): n is a, c, g, or t
  misc_feature (1389)..(1389): n is a, c, g, or t
  misc_feature (1441)..(1441): n is a, c, g, or t
  misc_feature (1456)..(1456): n is a, c, g, or t
gcgcagaagaactgttgccactagctgaagctgataaaattgatgctatgctcaaggagctaaagcattcttcggagttccacaaatggctttttgagtctgctgtcgggtcaatacgtacaattgctgctaatcatctctggcagctagtggtggtacgtgctgatctgaatggtcatttgaaggcattgaaagattattttcttttagcgaaaggtgattttttccagtgttttctagaggaaagccgccaattaatgcgtctaccaccgcgtcaatctacagctgaagcagatctcatgatcccatttcagttggctgcactgaagactataggtgaggaagacgagtatttcaccagagtctcattaaggatgttatcgtatggtatgaaaagtagtacatcgcagaaagatctccaaaagcctaatgctttggagcttccttcacaaggaaaagctgcatcagaattggcacttgatggatgggatagtattgctctggaatattctgttgactggccactgcagctcttcttcactcctgatgttctgtcaaagtatcgcaaggttttccagtatctcatccgattgaagaggacacaaatggaactggagaaatcctgggcngcagtaatgcataaagatcatgctgatttttccgattattgcaaggatcgaaaaaatggatctgcaacacaactgcgtcggcaacgctctaagcctttgtggcgagtaagggagcacatggctttcttgatcagaaactncagttttanatccaggttgatgtaatagagtcccaatggaatgttttgcaatctcacgtgcaagattcacatgatttcacagagctagtgagctttcatcaagagtacttgtcagcactggtttcacaatcattcttggatattggatcagtctctagaatactcgacagcataatgaagctatgcttgcagttttgttggagcattgagcaatatgaaacccgcccaaacatatctgagattgatcacataactgaggaattcaacaagaaatcaaattcgctgtacactatcttgaggagcagccgcctcgcgggtagccaaagagcacctttcctgaggcaattcctgatgagactaaacttcaactcattcttcgagaccactgcaaggggagtgatgaattctggcaggctgcgcccaagcactgcaggtgcccagctgtaacgatgactattgacgtgcgacttaatcccttgaggtttanacggggatgctggcacggtgctacngctggctgncatggngcntgtgtnaagcatgagnngagtttgtagtttgtgnagatcatgatagcgtgnaggtnatgtcctggaaagtggagtataggngaatttatncttgtcgtgatgttgtgttgtgcgcatcttaccttgtgtatattttacatgntgccatttgatgatnctatccggttcttggggccttaattgtctggctgcaacccgcaggcttgttcacattcttgatatattcatctaagtgccatcaaactcaaacgc

SEQ ID NO: 3412 - DNA, 1714 bp, Pennisetum glaucum
aagacacatccctggctagttggcatacaggatttcacgtatcattggacatgttgcctgagtatatccacatgcgagttgcagagtccattctctttgctggcaaagcaataagggttcttcgaaacccaagtcctggtgctatgttgcaggaacctgtcagccaaagccagaactctaaaggatctcatagaatacaaagctttatcggaggttctggtgctccaaaaggcatgccaaacttctctagcatcagcgcagaagaactgttgccacaagctgaagctgataaaattgatgctatgctcaaggagttaaagcattcttctgagtttcacaaacggctgtttgagtctgctgtggggtcaatacgtacaattgcagctaatcatctctggcagctagtggtggtacgtgctgatctcaatggccatttgaaggcattgaaagattattttcttttagcgaaaggtgattttttccagtgttttcttgaggaaagccgccaattaatgcgtttaccacctcgtcaatctacagctgaagcagatctcatgatcccatttcagttggctgcactgaagacaattggtgaggaagacaagtacttcactagagtctcgttaaggatgttatcttatggtatgaaaaatagtacatcacagaaagatctccaaaagcctaatgcttctgaggttccttcacaaggaaaagctgcatcagaattggcacttgatgggtgggatagtattgctctggaatattctgttgactggccactgcagctcttcttcactcctgacgttctgtcgaagtatcgcaaggttttccaatatctcatccgattgaagaggacacaaatggaactggagaaatcctgggcagcagtaatgcataaagatcatgctgatttttctgattattgcaaggatcgaaaaaatggatctgcaacacaactgcgtcggcaacgctctaagcctttgtggcgagttagggagcatatggctttcttgatcagaaacctacagttttacatccaggttgatgtaatcgagtcccagtggaatgttctacaatctcacgtgcaagattcacatgattttacggagctagtgagctttcatcaagagtatttgtcagcactggtttcacaatccttcttggatattggatcagtctctagaatactcgacagtataatgaagctgtgcttgcagttctgctggagtatcgagcaatacgatactcgcccaaatatatctgagattgatcacataaccgaggaattcaacaagaaatcaaattcgctgtacactatcttgaggagcagccgcctcgcgggtagccaaagagcacctttcctgaggcagttcctgatgagactaaattttaactctttctttgagaccactgcaaggggcgtgatgaactctggtaggctgcgtcccagcagtgtgagtgcccagctgtgacgatgactggcttcatccctttgtggttcacacgaggatactggtacggtgctagcactcgttaacatgtgcttgcgtaaagcatgaggggagattgtatttgcgtaaatcatgatagcgtgatggttctgttgtgtatagtggattatagtatacacatgcttgtgcagttgtgttggtttgtttagaatctggtatttctaatctagattgcaacgggctgaaatgctggtacaaattat

SEQ ID NO: 3413 - DNA, 2767 bp, Triticum aestivum
  misc_feature (1009)..(1009): n is a, c, g, or t
  misc_feature (1096)..(1096): n is a, c, g, or t
  misc_feature (1115)..(1115): n is a, c, g, or t
  misc_feature (1212)..(1212): n is a, c, g, or t
  misc_feature (1224)..(1224): n is a, c, g, or t
  misc_feature (1667)..(1667): n is a, c, g, or t
  misc_feature (1669)..(1669): n is a, c, g, or t
  misc_feature (1685)..(1686): n is a, c, g, or t
  misc_feature (1726)..(1726): n is a, c, g, or t
  misc_feature (1755)..(1755): n is a, c, g, or t
  misc_feature (1761)..(1761): n is a, c, g, or t
  misc_feature (1797)..(1797): n is a, c, g, or t
  misc_feature (1814)..(1814): n is a, c, g, or t
  misc_feature (1824)..(1824): n is a, c, g, or t
  misc_feature (1855)..(1855): n is a, c, g, or t
  misc_feature (1905)..(1905): n is a, c, g, or t
  misc_feature (1919)..(1919): n is a, c, g, or t
  misc_feature (1949)..(1949): n is a, c, g, or t
  misc_feature (1957)..(1957): n is a, c, g, or t
  misc_feature (1981)..(1982): n is a, c, g, or t
  misc_feature (2011)..(2012): n is a, c, g, or t
  misc_feature (2435)..(2435): n is a, c, g, or t
  misc_feature (2438)..(2438): n is a, c, g, or t
  misc_feature (2450)..(2450): n is a, c, g, or t
  misc_feature (2453)..(2453): n is a, c, g, or t
  misc_feature (2456)..(2456): n is a, c, g, or t
  misc_feature (2494)..(2494): n is a, c, g, or t
  misc_feature (2501)..(2501): n is a, c, g, or t
  misc_feature (2512)..(2512): n is a, c, g, or t
  misc_feature (2527)..(2527): n is a, c, g, or t
  misc_feature (2538)..(2538): n is a, c, g, or t
  misc_feature (2543)..(2543): n is a, c, g, or t
  misc_feature (2545)..(2545): n is a, c, g, or t
  misc_feature (2637)..(2637): n is a, c, g, or t
  misc_feature (2644)..(2644): n is a, c, g, or t
  misc_feature (2655)..(2655): n is a, c, g, or t
  misc_feature (2660)..(2660): n is a, c, g, or t
  misc_feature (2714)..(2714): n is a, c, g, or t
cccacgcttccgcccacgcgtccgcaagatgtagctttatgaactttgcccgaaatgcaatgtgccttgagtgcgggggggatcggccaaagaagatgttgactggcggagagtgggaatgccctcagtgtgaattctataattatgggaggaacatgtcatgcttaagatgtgcttgcaaaagaccagcgacaactgcatctgctggtgctggtttaggcggtgtagcagagcttcttagtgtaactaatgctggtagatctgaaattgagagaggggttgggggggcgatgagaaggcagaaaggtgcttgagcaaagtatctcaacttgacgattctgctgatttaagtagtctggcagctgatgaggattttcctgagattatgcctatgaggaagggagtcaataaatttgtagttagcacacgcaagacaccattggagagaagactggcaagtgcacagtacagcagtaacaatagccctcaagcaacagcatccgactccaagattagtcaaactttagacaggatacttgggcgttcggcatccacttctgccccaaacaatcagtctgataatgggggtgtaaatgctgagactcccaggaaattaacaggccatcttggtgatatcgaccccgttccttttgtgccattatctgctgatctgtttaccaagccacagaatgcaaagagtaatgaacaggcagatagggactgtcaaataaatagggaaactggtagttccacacccggtatcacacaggcctcaactgagaggaaagatgttgatagatcattagatactgctgagaaatggtccaagaaagtcgcagaactcgacagtgtaaatgacctttcaagtgctatttctgatgaagactttcctgatattatgccaatgaggaagggtgagaaccggtttgttattagtaagaaaaaagaccgctcgctgacatcaccacagtaccagaggcgcagtgtgcttgagcaggctgacaattcngatttcgtcccatttgttccgtttcctcctgattattttgccaagaaagatgcgccagcagagagtactccagatacaggaatagtntcagaaagttctccatcanctgataagctgccagaaacaaatgcttcatcaagacattcgggaaatagccaaaacacctcacaggtgattggccctcagggaagtagcatcatgantaatgagaactngaataggaattactctcagcagagctcgagtccaggtggttatacacgtggtggaagcagcagccagcagtatcaacaacaaccttatggggtgggtgatagatctgctggtacaccaaattcaggcgcctggaatccaaactactcccaggggacgtctactgatgtcagaggaggatctagcaactatcagcatcaacagcaaccccatgaggtcggtgatcgatctcggggaacttcaaatactggtgctttgaacacaaactactcccccgggaggtttaatgatggcagaggtggagctagcaactatcagcatcaacagcaacctcatgaggcgggtggtcgatctagtggaacttcaaatactggcgcttggaacacaaactactcccagtcccaggggagttttaatgatggcagaggtggatctaacaactatnancatcaacagcaacctnntgaggtgggtgatcgatctagtggaacttcaatactggtncttggaacacaaactactcccagtcccangggagntttaatgatggcagaggtggatctaacaactatcancatcaacagcaacctcntgaggtgggngatcgatctagtggaacttcaaatactggtncttggaacacaaactactcccagtcccaggggaggtttaatgatggcagnggtggatctagcanctatcatatcagacacaacctcatcaggcnggtggtcnatccagtggctcttcgaacactcnnaacacaaactactctcaggggagcttcanngagggtcgagatacatctacttacaatcagggaagctattctacacaaccgtcttatacgcccggctatagtaatcacagcaacagcaatgcttggagcagcaacaacaaccaaaattggagtggttcacatcctgatagtagggtttctactactggcattggttccactaaccctaatcaagcaacaggctactcaagctacggaggtggaggttatactggaaagagcttagaaggctctgctgtgaaggaccctgatcctctggacatgtccgaggaagccaaggccgagagatggttcaggagggcagcccagatcaaggacatctccgagcttgccaacattcccgacgaggacttccctgagataatgccgatgaggaagggggtgaacagattcgtggtgagcaagaggaagacnccnttggagaggagnttnacntctcctcagtacagaaggaacctaccgatcgtaagctncgagccngacaaagatgntagctgaaagcaggnatatctattcngatgnangagcgaagagtttacacaagatatacttttacttctgatcgtgataataagcagcaaggcgaagaaatccacgcggaggaaacagctgaacncccagancattttttctntatcnaaaagttttgttctcgaccagtagggatttgctgtttaatttgttacgtgtatncagttgtatacatttgttgttgtacctgaaatccgtgagtgcaatcatcaaat

SEQ ID NO: 3414 - DNA, 795 bp, Triticum aestivum
aacacaaactactctcaggggagcttcaacgagggtcgagatacatctacttacaatcagggaagctattctacacaaccgtcttatacgcccggctatagtaatcacagcaacagcaatgcttggagcagcaacaacaaccaaaatcggagtggttcacatcctgatagcagggttgctactagcggcattggttccactaaccctaatcaagcaacaggctactcaagctacggaggtggaggttatactggaaagagcttagaaggctctgctgtgaaggaccctgatcctctggacatgtccgaggaagccaaggccgagagatggttcaggagggcagcccagatcaaggacatctccgagcttgccaacatccccgacgaggacttccctgagataatgccgatgaggaagggggtgaacagattcgtggtgagcaagaggaagacaccgttggagaggaggttaacctctcctcagtacagaaggaacctaccgatcgtaagctccgagccggacaaagatgctagctgaaagcaggtatatctattccgatgcaggagcgaagagtttacacaagatatacttttacttctgatcgtgataataagcagcaaggcgaagaaatccacgcggaggaaacagctgaacgcccagaccattttttctgtatcgaaaagttttgttctcgaccagtagggatttgctgtttaatttgttacgtgtatacagttgtatacatttgttgttgtacctgaaaccgtgagtgcaatcatcaaataatttgcgacg

SEQ ID NO: 3415 - DNA, 1150 bp, Avena sativa
gcaactatcagcatccacagcaacctcatgacgtgagtaacagatctggtggaacttctaataccgatgcttggaacacaaactattcccatgggaggtttaatgatggccgaggtgtatctagcaactatcaacatcaacagcagcctcgtgaggtgggtgatcgatctggtgaaacttcgaataccgatgcttggaacacaaactactcacaggggaattttaatgatggcagaggtggatctagcaactatcagcatcagatgcaacctcatgatgtgggtggtcgatccagtggcacttcgagtacccatgctttggacacaacctactcccaggggagcttcaacgagggcagaggtggatctacttacaatgggggcagctattctgcacaaccgtcttatacacccggttatagtaataatagcaccaacaatgcttggagcagcagcaacaacagcaacaattggagtggttcacaacctgataatagcactgctactagcggaagtgcttccaataaccctaatcaagcaatgggctactcaagttacggaggcagaggttatacaggaaagagtctagaaggttctgccgtgagggaccctgatcctctggacatgtctgaggaagctaaggctgagagatggtttaggagggcagcacaggtaaagcacatcgacgatcttgtcaacattcctgacgaggacttccctgagataatgccgatgaggaaaggggtgaacagattcgtagtgagcaagaggaagacgccacttgagaggagattgacctctcctcagtacagaaggaacctaccggtcgtaagttctgaaccggacacacatggatataattctactccagattggaataataagcagtaaggggaaatccacatggatgaaatagttgaacacccagaacatttttctgtatggtaaaattttgttctcgaccactagggatttactcggtttcatgtgttacgtgtatcttatgtgctaggagttgtgatagtatgcacgtgttgtaactgaaatcttctactatactgaaaccgtgagtgcgatgtttcaaagtaatttttattttggtcgagcatcatataatgttattcattccctcttgctctaaaatgagtgtc

SEQ ID NO: 3416 - DNA, 1321 bp, Triticum aestivum
  misc_feature (538)..(538): n is a, c, g, or t
  misc_feature (543)..(543): n is a, c, g, or t
ccaatggttagagctgcggatgaaagacttgcaatctcaagtatccagatatgacagggagcttgcagtacttaaacatgagaaagagtacagacaaaaatgattgagttggactgttcctcgtcgagatcagtgcccttctcttctcattgctgcaggaagactatgaagaggaagaagagaaagagaaatgaggagaaaatcaatgctccctcatacatcgcaacccacaccatattgtcttattatgaaaaagagaaaacggaaggtgatggccattctattgacgacattggaaacttagcagatgacagcacaaaaggaaataatgacgctgactggctactcggtaatggagacgatgctactgtcgagcagattcttgtaagcattcagtctgttcaagacagagtctgtagtctgagatcagatctcaagaaagcaatggccaagaagagtaaggggcttctccttaaagtcaacacacaggtcaacggcgcacagagctctaattgctcacatggaaaaggcaaagttnctganatgcctgaaatatcacctcaagatgcatcggattgtgatatgggcgatacggacatgcccgatagtgctgtctcaagctatggagaagctaacaatatggatatttttgagagcacgatgaacctattgtcagttgaagatccagataaaattggtgaactacaccagacttcggaagatgtattgatcgacaaccaaccagctgaggaagggtatcaaaattttgaggtgatcagtcacccatgccagcgactacgggtatcagtcaagagggaacaggtacctgtcaagagagaaactgtagcacattctgaggatgagagcgtcgccgcccccatggcggtcgtcaaggaagaaggcggcacaaccaggatgggcctccaggggatcttgaagccctgctacacgggcaagagaaaagggaggaggccgaagattctaaggcgcggtggttcatcatctgctctcagctcatggaggagcgcccggactcgaaagaagaggaaatcgtagatgcagatggtctcagtgaacacaccctatcctctggcttcagttcttccgtttgattagatgatgatgacggcaactgcacactccttctatctgactgatgacatttttcgcggagccagaagagagtgatggaaaatggtgctctatggctttcagccgcgaggtgcttgtaaacctagcaatgtctgtttctatttcctttgttgttgttgcgtgtggtctttgttctgaaagagtcaaaactttggttgttacagtgtaa

SEQ ID NO: 3417 - DNA, 946 bp, Avena sativa
cctcgccgccacgcaccgccgcgcggtcgtggcggcggcctcgtccaggcctccccctccgccgtccccggagagaggagacgaggacgaggaggaagagcaggaggtggagagggccatggggatggacggcggcatccccgggacctcgggcgagctgctgcgccgcgtctcctcccgcgcctacggcatgcggcgccacctcatggagtcgctcgactccctcgcctacgacgtgttggagacaaacccatggagagaacaacccaagccagtctatgtgctggctagaagggacaaccaactatgtacgatgaaaacccgcaggaaccgcagtgaagttgaacgggaacttgggatgcttttctcaaagggagggggttcaagagttgggactaaatcaaagtactctggctccaagtttagtatgcttgttgaagatgttacagagggagtactggtgtttgaagacgaggatgatgctgtaaaatactgtgaccttctacagggatgtgaaggaattgcagagatagaggcttcatcagtcttcaacctatgccgtcaaatgaaagctcttgctgtccttttccgtcgtggagggactcctccaacgcctcaaagccttgagcacgatctgagggcgagaaaccggtcactggaagactaggatctttgggataaattgagtagatatgctaattatattcattctagctgttgaaacaaatgccctaggcattgtatatactacatggtacatagattcaattttaaaaggaaagatgaaaaaaaaagattggtatatagatttattgatagccaagatggagtggaaatcaagtatgacactagcacgtaaactagcctgagattagcaatctctgtaataccgaatattcttgtaattaattacattgtctacaagtgaataaatgagatactaagt

SEQ ID NO: 3418 - DNA, 877 bp, Saccharum officinarum
gcccgcgcctcgccgcggcgcaccgccgggcggtcgtggccacggccgcgtcgccccgtccccgtcccccgccgccaccggaaggggacggcgacgagcaggaggtggacagggcgatggggatggacggcggcatacccgggacctcggacgagttcctgcgccgcgtctcctcccgcgcttacggcatgcggcgccacctcatggagtccctcgactccctcgcctacgacgtactggagacaaacccatggagagaagattccaagccagtctatgtgctggccagaagcgataaccacctatggacaatgaaaactcgcaggagccgcaacgaagttgaaagggaacttggaaaacttttctcaaagggagggggttctggagttggaactaaatcaaagtactctggctccaagtttgacatggttgttgaagatatcagagagggagtactgatatttgaggatgaggacgatgctgtaaaatactgtgaccttctgcagggtggcggccaagggtgcgagggaattgcagagatagaggcatcatcagttttcaacatgtgccgtaatatgaaagcccttgctgttcttttccgccgcggaaggactcctccattgcctcaaagcctggagcgcgacttaagggcgagaaagcggtcaccactggaagactagatctgtgtgtttacagtgtatagaatcgttaattgtattcttctagctggtggaaacatgggccctaagccttgtatacaacatatagtaatacatagaagtccctagctgcaatggaaccagacgagtctgacagcaaacacagacgaaattgctcgaaaacagagattcatttgaaattggatggatactcttgt

SEQ ID NO: 3419 - DNA, 1361 bp, Pennisetum glaucum
cgggcaggaggtggagagggcgatgggcatggacggcggcatccccggcacctcgggcgagttcctgcgccgcgtctcctcccgcgcctacggcatgcggcgccacctcatggagtcgctcgactcactcgcctacgatgtattggagacaaacccatggagagaagattccaagccagtctatgttctggccagaagtgataacaatctatggacaatgaaaactcgcaggagtcgcaatgaagttgaaagggaacttggaatgcttttctcaaagggagggggatcaggagttgggactaaatcaaagtactctggctccaagtttaatatggttgttgaagatgtcagagagggagttctggtatttgaggataaggatgatgctgtaaaatattgtgaccttctgcagggtggcggtcaaggttgtgagggaattgcagagatagaagcgtcatcggttttcagcatgtgccagaaaatgaaagcccttgctgttcttttccgccgcggggggacacctccattgcctcaaagccttgagcgtgatttaagggcgagaagacggtcattggaagactaaggtcgttggttacattgtatagaacttttattcatctagctgttgaaaccatagaggccctaggtcttgtatactacatcatacatagtaacatagatctccctagctgaaatggaaggaggcaagtctgacagtaaatacagacgatagctcaacaccagaaatctctttgagattgaatattcttgtaatcatgtacattccaaagctccattttacaataaataaatgtgatccatcaagtcattcttagtctggtgccatcaaacttgtgaatggtacaaggggttggcaaccctgatgacaggaccaatccaaaaaatccataatcatggtcatgctgggctcgtcaactcgtggctgctgcttttgcctagaatcaccggagctgtgaaatgtgactgtgagttgagtgcttcgaaattcagggcgaagtgcgcctctcagacagcttctccgtccggtacttcttgaaatctgccgccagccctgtatcgaagtcctgcttcatctgctccgccatctgcctcagcaccgtctcgccgacgcctctgatgatgctctccgggaccatggcgagcaccggcgggaggttgaagccgacggtcatctcgacgtggcccttcaggctcttcctcccctcacgctgcgggtacatcaagccccggacggtgagtgcgaggtgcgacggcatggagttgctgtccagaccgttgagcttgtagtctaccacttccatgaggaggaggctggtggcgtggacggggacgttgggcgg

SEQ ID NO: 3420 - DNA, 621 bp, Triticum aestivum
tctatgtgctggccagaagcgataaccacctatggacaatgaaaactcgcaggagccgcaacaagttgaaagggaacttggaaagcttttctcaaagggagggggttctggagttggaactaaatcaaagactctggctccaagtttaacatggttgttgaagatatcagagagggagtactgatatttgaggatgaggacgatgctgtaaaatactgcgaccttctgcagggcggcggtcaaggatgcgagggaattgcagagatagaagcatcatcagttttcaacatgtgccgtaacatgaaagcccttgctgttcttttccgccgcggaaggactcctccattgcctcagagcctggagcgtgacttaagggcgagaaagcggtcaccactggaagactagagctgtctgtttacactgtatagaatcgttaattgtattcatctagctgttggaagcatgggccctaggccttgtatacaacatagtagtacatagtagtccctagctgaaatggaaccagacgagtctgacagcaaacacagacgaaattgctcgataccagaagtttctttgaaattggattggatggatactcttgtaattatgagcaaccat

SEQ ID NO: 3421 - DNA, 1438 bp, Zea mays
ggctgaggctgccgtgtccacgttgcactccacattcccgtttcatttcctttcatttcactcctcgcctcggctttgttggaacgtaaaaaaaaaaaaaaatggcagctccctcgtcgtccctcaccccgccgccgccggcagcggctgtggcctccacaacgctgtccgggaacctcacggcctcctcgctcctgtctattacgccgccgcgaccgcgcctcgccgcctcgcaccgccgggcggtcgtggccgcggccgcgtcgccccgtcccccgccgacaccggagggcgacggcgacgagcaggaggtggagagggcgatggggatggacggtggcatccccgggacctcgggggagtttctgcgccgcgtctcctcccgcgcttacggcatgcggcgccacctcatggagtcgctcgactccctcgcctacgacgtactggagacaaacccatggagagaagattccaagccagtctatgtgctagccacaagcgataaccacctatggacaatgaaaactcgcaggagccgcaatgaagtcgaaagggaacttggaaagcttttctcaaacggagggggttctggagttggaactaaatcgaagtactctggcaccaagtttaacatggttgtcgaagatatcagagagggagtactggtatttgaggatgaggatgatgctgtaaaatactgcaaccttctgcagggcggcggccaagggtgcgagggaattgcggagatagaagcatcatcagttttcagcatgtgccgtaaaatgaaagcccttgctgttcttttccgccgtggaaagactcctccattgcctcaaagcctcgagcgcgacttgagggcgagaaagaggtcactggaggactagtgctgtctgtttacgctgcatagaagtgttaattgtactcatctagctgttggaagcatgggccctaggccttgtatacatcatagtagtacatagcagtccctagctgaactggaaccgagcctgacagaaaacacagacataattgctcgagaccagaaatctctttgaaattggatggatgttcttgtaattatgagcaacatgtttacaatgaataaaatgtgatacatcaagttattgtcattatttgattgatgtcttccaactggtgaatgaacagtacatacagacataattgctccagaaatctctttgagattggatggatgctctttaattatgagcaacgtttttacaatgaataagatgcgaatacatcaagttaatatcattatttgatgtcatccaacttatgaatgaataaatagtgcaagaggttgacgaccctgcttgacgacaaggcgagtctgaagaaattcctagtcatggctacttgttgatgatacatcgatacaggccgggatgtgattgtgaaatgtgtctcagaattc

SEQ ID NO: 3422 - DNA, 771 bp, Panicum virgatum
taagctaaatataaataatatttgaactagacagtttgaaatttagtaacattttggactttcatgatcattcactaaaggagacaaacccatggagagaagattctaagccagtttatgtactggccaggaatgataaccagctatggacaatgaaaacacgcaggagccgcaatgaagttgaaagggaacttggaatgcttttctcaaagggagggggttcaggagttggaactaaatcaaagtactctggctccaagtttaacatggtcgttgaagatatcagagagggagtgctggtatttgaggatgaggatgatgctgtaaaatattgtgatcttcttcagggtggtggtcaatggtgcgagggaattgcagaggtagaagcatcatcagttttcagcatgtgccagaaaatgaaagcccttgctgttcttttccgacgtggaaggactcctccaatgcctcaaagcctcgagcacgacttaagggcgagaaagcggtctttggaggactaggattgttggtttacaccacatagaactgttaattgtattatagctggttgaaaggccataggccatgtataccacatagtacatggcctatgtggtatgtataccacaataccacttaggccatgtattccctagctggaatgaaagaaggcagtctgacagtaaacacagaccatagctcagtggtcggcaccagaaatctctttgaaattgaatattcttgtaattatgtacattcggaagctccatttta

SEQ ID NO: 3423 - DNA, 862 bp, Saccharum officinarum
agatcttcattgcaaacatctatgtaagagactggtggatcctacacagttgcgctggatgagtctcatttcaaagagttgttactggaacatgctcccccacctccagcaattgcagaatatgctgcagctattttgattaagatgggctttccacagaggggtgctgaggatcttatctctatttgctcttgtcacaagaagataaagtctggggctgaaggttacatatgtcctagatgcaaagttaatgtgtgtgagcttccaactgaatgtcgaacttgtggtcttacgctagttagttctccacacttggcaaggtcatatcatcatctcttcccggtagcaccgtttgatgaggtcacccctgtcccaaatagaatccaaaggggaggacagatctgtttcagctgccagcagagcctttttaacccagatggccaatctaacctccatgttcgctgcccaaaatgcaaccagcacttctgccttgattgtgatatttacatccacgagagcttgcacaattgccctggttgtgagagccaacgcagcatcgcttcatagagaccttgtcattgtgtgcattattcaggtcgtaccttaagctttcgctacactgtaaccagcagcaaagttgtttcatgatcagacaatgtacagataatataatgcccagcatccttttattgatagttcctgttaggttgagtaactagttgagctattgataccccatcagaggccaatgagttgatagttttaacattgtgccgagaagagatgctgaaagtgtataaacacgactgagacttgattcttgctattttttttccctgaagcaagacggtatttttattct

SEQ ID NO: 3424 - DNA, 1002 bp, Setaria italica
tcatttcaaagaattgttgctggaacatgctcccccacctcctgcaattgcagaatatgctgcagctaatttgattaagatgggctttccacagaggggtgttgaggatcttatatctatctgctcttgtcacaagaaaataaagtctggtgctgaaggttacatatgtcccagatgcaaagttaatgtgtgtgagcttccgacggaatgtcgaacttgtggcctaacactagttagttctccacacttggcaaggtcatatcatcatctcttcccggtagcaccatttgatgaggtttcctctgtcccgaatagaatccaaaggggagtacaaaactgttttggctgtcagcagaacctttttaaccctgatgggcaaactagcctccatgttcgctgcccaaaatgcaaccagcacttctgcctggattgtgatatttacatccatgagagcttgcacaattgccctggttgtgagagtcaacgcagtttctcatcactgtgaggccgttgcgcgcattattcgggttttgtaccttatttttagttgtcagttactaagctttctcgatgcattgaaatcggtggcagagttgtttgatgataagacagtgtacagatataatgcccggcgtccttttgttgacatctcctgttagatggagtagctagtcgagctattgatactgagcagaggccgaggagttgatagattagcatatgcctggctagcagagatgctaaaattgtataacatgactggaacatgactcttgctgttttttttctgaagcaagacaatattgttattcggtatcgtgacttgtgtttttacatgctgaaagctaagtgggtcgtgtaagaatagggagatactacgtcaaaggggcctaggtatatgtttcgtcagtatgcccttattctgtgaagctgattattgcatttaaatatgttttcagtaggtatgccagttgcttgcactaattacattttagaaatgaa

SEQ ID NO: 3425 - DNA, 941 bp, Cenchrus ciliaris
  misc_feature (497)..(497): n is a, c, g, or t
  misc_feature (606)..(606): n is a, c, g, or t
aaatgtaagaagtccaaaattagatgctctgttattggtcttgctgcagagattttcatttgtaaacacctctgcgaagagactggtggatcttacacagttgcactggacgagtctcatttcaaagaattgttgctggaacatgctcccccacctcctgcaattgcagaatatgctgcagctaatttgattaagatgggctttccacagagaggtgttgaggatcttatctctatctgctcttgtcacaagaaaataaagtctggcgctgaaggttacatatgtcccagatgcaaagttaatgtgtgcgagcttccgacagaatgtcgaacttgtggcctaacactagttagttctccacatttggcaaggtcatatcatcatcttttcccggtagcaccgtttgatgaggtttcctctgtcccgaatagaatccaaaggggagtacaaaactgttttggatgtcaacagaacctttttaaccctgatggccaaantagcctccatgttcgctgcccaaaatgcaaccagcatttctgcctggattgtgatatttacatccatgagagcttgcacaattgccctggttgtgagagtcaacgcagnttgtcatcacagtgaggccgttgcgtgcattattcaggttttgtaccttattttgagttgtcagtcactgtaagctttctcgatggaatcggtggtagagttgtttgatgagaagactgtacagatataatagctgccatgcccggtgtccttttgttgacatctcctgttagatggagtagctagttgagctatataactgagcagaggccaaggtgttgatagattagcatatgcctgggtagcaccgtagcagagttgctaaaattgtataacgtgactgcaacattgactcttgctgtttttttctgaagcaagactattgttattcggca

SEQ ID NO: 3426 - DNA, 1438 bp, Pennisetum glaucum
cctcctgctccgatccgccgctgccgcggcggcccgcatccagaaggggctcatacgctacctctacatcgtcatcgacctctcccgggcagcttcagagatggattaccgtcctagtagaatggcagttgttgcaaagcatgctgaggctttcataagagaattctttgaccagaatcccttgagccatgttggcctagtgacaattaaagatggtatctctcatcgacttacagagattggagggagcccagaatcacagattaatgctttgattgggaaacttgagtgttctggtgattcatctctgcagaatgctctagaacttgtccatggttatttagatcaagtaccatcatatggtcacaaggaagtcttaattttgtactctgccctaaatacatgtgatcctggtgatatcatggagacaatagaaaaatgtaagaagtccaaaattagatgctccgttattggtcttgctgcagagattttcatttgcaaacatctctgcgaagagactggtggatcatacacagttgcactggatgagtctcatttcaaagaattgttgctggaacatgctcccccacctcctgcaattgcagaatatgctgcagctaatttgattaagatgggctttccacagaggggtgctgaggatcttatctctatctgctcttgtcacaagaaaataaagtctggcgctgaaggctacatatgtcccagatgcaaagttaatgtgtgcgagcttccgacagaatgtcgaacttgtggcctaacactagttagttctccacacttggcaaggtcatatcatcatcttttcccggtagcaccgtttgatgaggtttcctctgccccaaatagaatccaaaggggagtacaaaactgtttcggctgtcagcagaacctttttaaccatgatggccaaactagcctccatgttcgctgcccaaaatgcaaccagcacttctgcctggattgcgatatttacatccatgagagcttgcacaattgccctggttgtgagagtcaacgcagtttccaatcgcagtgaggccattgcatgcattattcagattttgtaccttatttgagttgtcagtcactttaagctttctcaatgcatttaaatcggtggcaaagttgtttgatgaaaagacagtgtacagatataatggcataatgccccggcgtccttttgttgacatctcatgttagatggagtagctagttgagctattgatactgatcagaggccgaggagtttgatagattagcatatgcctgggtagcccatagcagagatgctaaaattgtataacgtgactgcaacattgactcttgctggtttttctgaagcaagacttctgttattcggtatcttgactatgactttaatgtttacaatgatgatgaaggtataagttgatcggct

SEQ ID NO: 3427 - DNA, 789 bp, Panicum virgatum
tatctctatctgctctgtcacaagaaaataaagtctggggctgaaggttacatatgtcctcgatgcaaagttaatgtgtgtgagcttccaacagaatgtcgaacttgtggcctaacactagttagttctccacacttggcaaggtcatatcatcatctcttcccggtagcaccgtttgatgaggtttcatctgtcccaaatagaatccaaaggggagtacaaaactgtttcggctgtcagcagaacctttttaaccctgatggccaaactagtctccatgttcgctgcccaaaatgcaaccagcacttctgcctggattgtgatatttacatccatgagagcttgcacaattgccctggttgtgagagtcaacgtggtttctcatcatagtgatatgccatcacattcattattcaggtgtaccttattctgagtcatcatgtcatactaaatctttctcagtgcattgaatcggtggcagagttgtttgatgataagactgtgtacagatataatgcccggcatccttttgttatgttagatggagtagctaattgagctatatcgatactgagcagaggttgaagagttgatagtttagcattatgcctagctagcagagatgctaaaattgtattacgtgactggaacatacgactcttgctgtttttctgaagcaagactattgttattcagtaccatgactcgggtttttacatgctgaaactaagttgctgtgtaagaatagagagatactactaaggagggatctgggtacatgtttcagtt

SEQ ID NO: 3428 - DNA, 4768 bp, Theobroma cacao
atttattctttaaattcatttcacaccaatctatctatcctagacgctgagtccagaaccatggtttttacaaattttaagcagccatacaacccacgccatatctagtggtaggaaacacaagaaacaagccactgcaaacaatccccaccatcaatggaaaactctccataacttgatccatttccttctcatgccccgggaatacacagtttgtaactctatgatccgaaaacgcaattgccatgaacaccaagaccgacatgattgcgtgcaccaaatcagtgagcccaaccttgtatttctcgtctttcggagtttccacatcgagaccagccttgaacacagccagtcccttaggggtcacgaaaccatagtaaactttcccatcaggaccccggaaactatcagtaaaatgaaagaagaagcaagagagcgcacaaaggcataagaggaagtaaatcatcatggtgttaacaggggagcaatcaccattgcggtttctactaatcggccatattgtagttttgaggactcctttttgtcccatcagttatgcgtataatctatgaagaaagtacactttccagatccttcaggaaatgggaaatttgagcaataaacacccaagcctaagaaaaggccaaattgaagtgctagaaacatccttgtctgaccaccttatttatggaactccaaactattccctccatatcagaaacgacttctcaagcacagcaaaaagtgttcaaacacttggaacatagcttggctaccagctgagaccaaagactatggcacctgctctatctctttctgtctcccaccttccagtttgcaaatctcaagacttctcgaaggatacctgcctcccaaaaggaactaatagggaaaacccttctgccaaaatagcttcagatgtcaagttaagtaaaagaaagctattgagttcaactgccttgggtcttattggaggtctctcagttgctcagccaatccagagatcccaattgaaagcacatcaaatagaatgtcatattcaagattcttgcagtacttggacgaaggtgctgtgagaaaggtggacttgttcgagaatgcaactgtagcgattgctgagatatataatcctgcgcttgacaaaattcagagggtaagagtccagttaccggggttgccacaagaattactcgggaaaatgaaggagaagggtgtagattttgctgctcatccaattgatatcaactggtcagttgctttacttgacttgttggggaacttggcatttccttcgattttgcgaggcactttgttgttaaggagctcatcttcaaacactcctggaggtcccaacttgccttttggacttggaaggagcaaagccaaattttagatggaacccaacactggagtaacttttaatgatgttgctggtgttgatgaagctaagcaagattttcaagagatagttgagttcttaaaaaacccagagaagtttgctgcggtgggtgcaaaaattcctaaaggagtgcttttagttggacctcctgggactggaaagacattgatggcaaaggcaattgcaggagaagcaggggttcctttcttttcactttctggatcagagttcatagagatgtttgttggagtaggagcttcaagagttagggatctgtttaacaaggcaaaggctaattcaccgtgcttggtgttcatagatgagattgatgctgttggaaggcagagaggaactggtataggtggaggaaatgatgagagggagcaaactctaaatcaattgctaattgaaatggatggttttactggcaacactggagttatcgtcattgctgttactaataggcctgaaattcttaattctgctttgcttaggcctggaagattcgacagacaggtcactattgggataccagatataagaggcagggaagaaatactgaaggtacatagcaacaacaagaggctggataaagatgtttctctcggtgtaattgctatgaggacaccaggattcagtggtgcagatttggcaaaccttatgaatgaagctgccattcttgccggtagaaggggcaaagacaagatcacaatgaaagagattgatgactcaattgatcgaattgtggctggaatggagggaacaaagatgacagatggaaagagcaaaattcttgtggcctaccatgaaattggacatgctgtctgtgcgacattgaccccagtccatgacccagttcaaaaagtcactctgattcccagaggccaagctcgaggcctaacatggttcaaaccaggtgaagatcctgctctaattgccaagcaagaactctttgctagaatagtcggaggacttggtggtagggcagcagaagagataatctttggagaatcagaaattactacaggtgctgcaggggacttgcaacaaataacacaaatagcaagacagattgtaacaagatttggcatgtctgatattggaccttgggcattaactgatcctgcagtacaaagtagcgacgtggtgttaaggatgctggctaggaattcaatgtctgagaaactagcagaagacattgattcatcagttaggaacataattgagagtgcatatgaggttgcaaagaagcatataaggaataaccgcgaagccattgataagagagtggaggtgctgctggagaaagaaacccttacaggagatgagttcagaacaatcctgtcagaatttgttgatgcccctgtagtaaaagcagacagatctccaaaccaatttctggttttcttaaagctctgttcttcaatcaaacacctctctcaagtccatgcccaaatcctcatctctaatcttcaccaagactctttccttctcaccgaactcgtcagattctcctcgctatctccctacaaaaatctcagctacacgcatacccttctagttaactcactcaactcaactccctctacatggaatattcttatccgaggctatgcttctagcgatactccacaaaaggcaatctgggtacttaaagaaatgcgaaaacgaggccttcaacgcaataaacttacgtacccatttgttttaaaggcgtgcgcaaggggtgaagcacttgcggaaggtagacaggttcatggggagattttcaagcatggtttagatgatgatgtttatgttgagaacaatttggtgcatttttatgggtgttgtaagaagataatcgatgcaaagcaagtgttcgatggaatgggtgagagaactgtggtttcgtggaatgcggtgctttctgcttgtgttgagaatttttgcattgaggatgcaattgggtattttgataagatgaggaattgtgggttggacgaaaccacaatagtgatcatgctctcagcgtgtgcagagctaggatctttaagcttcggcaggttgcttcatttgcaagttgttgagagaggtttaattttgaattgtcaattggggactgcacttgttgatatgtatgcgaagagtggatatgttggttatgctagtcgagtttttgatagaatggaggagaaaaatgtgtggacttggagtgcaatgatattgggatttgcgcaacacggttttgctaaggaagcccttgaaatttttgtaaagatgatgaaaagttcttgtataagaccgaattacgttacttatcttggagttctttgtgcttgtagccattctggtttggtggacgatgggtaccggtattttcatgaaatggagtatgttcatgggattaagcctatgatggttcattatggtgccatggttgatgccttgggtcgtgctggtcgtctgaaagatgcttacactttcataatgaacatgcctattgagcctgaccccattttatggaggactttgctaagtgcatgcactattcataatgttaatgatactgatggcgtcagtgatagggtgagaaagaggttgcttgagttggagccaagaaggagtggaaatttggtgatggttgcaaacatgtatgcagaagctggaatgtgggatagagcagcaaatgtacggaaggttatgagggatggacggttgaaaaagatggctggtgaaagctgtcttgagttaaatggctccatttatcagtttttttcagggtatgattctcaatttgattttgatggcatctatctattgctagatacactgaccttacacatgaaaatgattaacattttgtagtggtattgcttgatatgaacccttttgtattcaggattagagaaaatatttaattgtgcaagctgcaaatttgcattatcggtaccccatagtttcattctgctttaatagtggtgtggccctatgtaggcccagtggtgtatagaaatcataagagttcattactttcagcagtcattcctgtggccctaaggaatgtgtagtatcatttatatagataataaaatgtgaccttgaaactttctacccctgtacacagtagaaactaagtggaaacacaagaagatggatcttgaggagagaaaaggatttagcaatctaataacacaagtgaaagccaagagatggatagttactgaaggttttcttctgatagactgttgctgtttctgtagaagaagactatttttcaacaagctccagtcagcaatctgaatacaggagggaatttgaggccttgacaagagtttgtgccaattaaagactggaggcttactttcgtattctggtgtagtgcaaact

SEQ ID NO: 3429 - DNA, 3507 bp, Populus trichocarpa
gaaacatgtcgcctgctctatctctttctctcccccacattcccatttgcaaatctcaggaccttgcaaatggtgtccagattcctaaaagcactaacagagacagcccatctctcaaaacacccctagatatcaaacttagtaagagagaactacttaatgccactgctgtagtactcttaagtgaagggctctctgttgctaagcctgcaagagctgcagagccagagagtccagttacttcaacttcaagtagaatgtcttactccagattctttgagtacttagatgaaggtgctgtaagaaaagtggacttgtttgagaatgggacggtagcaatagctgagatttttaatcccacacttgaaaagatccagagggtcaaaatccagttaccaggactgccacaagagttgttgaggaaactagaagagaagaatgttgattttgctgctcacccaacagagccgaactggacagctgctctacttgactcgttgggaaacttggcctttccattgatattgctcggctctttgttgttaaggacatcatctaccaacacccccggaggtcccggcttgccatttggactaggaaggagcaaagccaaattccagatcgagcctaatactggagtgacatttgatgatgttgctggagttgacgaagcaaagcaagattttcaagaaattgtggaatttttaaaaactccagagaagtttgctgcagtaggtgcaaggattcctaagggagttctgttagtaggacctccaggaactggaaaaaccttgctagctaaagcaatagctggagaagcaggcgttcctttcttttctctgtcaggatcagagtttattgagatgtttgttggtgtaggggcttcaagagttagggacttgttcaacaaggctaaggcgaactcaccatgcatagtttttatcgatgagatagatgctgtcgggaggcagagagggacaggaattggtggaggaaatgatgagagggagcagacactgaatcaattacttactgaaatggatggttttagtggtaatagtggagtgattgttattgctgctacaaaccgacctgaaattcttgattctgctttgcttaggccaggaagatttgataggcaggtcacagttgggctaccagatgtgagaggtagggaggagatattaaacgtgcatagcaaaaacaagaagctggacaaaggggtctctctgagcgttattgccatgaggacgccaggattcagtggtgcagacttggctaacctaatgaatgaagcggcaattcttgctggtaggagaggcaaatacaagatcaccctgaaagagattgatgattcaatcgatcgaatcgtggcaggcatggagggaaccaagatgactgatggaaagtgcaaaactttggtggcttaccatgaagttgggcacgctgtttgcgcgacattgacacccggacatgacctggtgcagaaagtcactctaattccccgggggcaagctcgtggtctaacgtggttcataccaggtgaggatccgactctcatttccaagcaacagctattttctaggatagttggaggacttggaggaagagcagcagaggaagtgatttttggtgaatcagaaatcacaactggtgcagcaggggacctgcaacagatcactcaaattgctaaacagatggtaacaatgtttggcatgtctgagctcggaccatgggcactgaccgatccagcagcacagagcagtgatgtggtgctaaggatgctagctagaaactccatgtcagagaaactcgcagaagatatcgattcatcagtgcgaaacataattgaaagagcatatgagattgctaaggaacatataaggaacaatagggaggccattgataaactagtggaggtgctgctagaaaaggaaaccctctctggggatgagttcagggcaatgttgtctgaattcacagatattcatgttgataaaatagatagaacccctaaccattgcctctctctactgaaactctcatcttcagtcaaacatgtctctcaaatccatgcacagatcctagtctctggtcttcaacaagacaccaatcttttaactgaactcataagattctgttccttatctccctctaaacacctcagttatgcccactcccttctatacaattcacttgactcactgcctccttggaatttcctcattagaggctacgcctcgggtgatgcaccgaaaaatgccatacgggtgtttcatagaatgcgaaaagaaggagttggacccaataactttaccttcccttttgttttgaaggcatgtgctacttgcttggcacttgaagaagggaaacaagtacatgcggatatttttaagtttggtttagattgcgatgtttatgttaacaacaatttggttcacttatatgggtcttgtaagaggatttgggatgcatgtaaagtgtttgatgaaatgcctgtaaggagtatcgtttcgtggaattcggtgattactgcttgtgttcagaatttatggttaggagatgcaatttggaattttgttaaaatgaaggactttgggtttgagcctaatgagacgacaatggtgattatgctttccctctgcgcacaaatagggaacttgagcttagggagatggattcattctcaagtgattgaaagggggatgacattgaattgtcaattgggcactgcccttgttgacatgtatgcaaaaagcggagatcttggttacgctaagctagttttcgatagaatggagaagaagaatgtttggacttggagtgcaatgattttgggactagctcaacatggatttggaaaagaagggcttgagctttttctcaagatgaaagagagtgtttctatttgcccaaattatgtcacattcctaggggttctctgtgcttgcagtcatgctggtttggttgatgaggggtttcggtacttttatgaaatggaacacaggcatggaattagaccaatggtcatacattatggtgccatggttgatatcctgggtcgtgctgggaatcttgaagaggcttataactttttaatggacgtacctttccagcctgacccaattttgtggaggacattgctcagtgcatgcaatattcacaatgctaatgtcagtgatggcttagtagataaggtaagaaagaagttgcttgaactagagcccaggaggagtgagaactttgtgataattgcaaacatgtatgctgatgctgggatgtgggaaacggcaacaaatgtgcggaggactatgagagatggtggtttgaagaagataggtggcgagagttgcattgttttagagggctcaatccatcagttcttttctggctgttcaaaagatgatcatgaaagtatcgaactgcttctagatggactgaacttgaacatgaaaatggtaaactccctgtaatcagtattgcttgtcatgtcatttattccattgg

SEQ ID NO: 3430 - DNA, 1437 bp, Glycine max
aggagtaaagcaaagtttgagatggaaccaaacacaggagttacatttgaggatgttgctggagttgacgaagccaagcaagacttgcaagagattgttgagttcttgaagaccccagagaagttttctgcagttggagctaaaattcccaaaggggtacttttggtagggcccccagggactggaaagacattgctggccagggcaattgcaggagaggctggggttcctttcttttccctatctggatcagagttcattgagatgtttgggggtgtaggggcctcaagggtgagagatttgtttagcaaggccaagcaaaattcaccttgtttgatattcattgatgagatagatgctgtagggaggcagagaggtacaggtataggtggaggaaatgatgaaagggagcaaacactgaatcagttgctcactgaaatggatggtttcactggaaacactggagttatagtcattgctgctaccaacagacctgaaattcttgattcagcattgcttagacctgggaggtttgatagacaggtcactgttggattaccagatgaaagagggagggaagaaatattgaaagttcatagtaacaacaagaagcttgacaaggatgtctctcttagtgtcattgccatgagaactccgggattcagtggtgcagacctcgcaaacctcatgaatgaggccgccattcttgctggtcgaaggggcaaagataagatcacaatgaaagaagttgatgactccatagatcgcattgtggcaggcatggaaggaaccaagatgactgatggcaaaagcaaaattctggtggcttaccatgaaattggacatgctgtttgtgcgacactgaccccagggcatgatccagtacagaaagtcactctagttccgagaggccaagcccggggcttaacatggttcataccaggtgaagatccatctctcatctctaagaagcaactatttgctagaatagttggaggcttagggggaagagcagcagaggaagttatatttggtgaaactgagataaccactggagctgctggggagttgcaacaaattacacaaatagcaagaaagatggtaacagtgtttggcatgtcagagattggagcgtgggcattgactgatcctgcagtgcaaagtagtgatgttgtgctaaggatgctggctaggaactcaatgtcagacaaactagctgaggacattgataactcagtgaggcagataatagaggcagcataagaaattgcaaagaatcacataaggaataaccgtgatgcagttgataaattagtggatgtgctacttgagaaggagacccttagtggagataaattaagagctatcttgtctgaattcactgacatttcttcaattaaggtagagagaatccctattcgggaattgatcgaagca

SEQ ID NO: 3431 - DNA, 3494 bp, Prunus persica
cctctcgaaatatgtcacctgctctgtctctgtccgtctccctctctccactctgcaaatctcaggacatttcaaaggaaacccaccttcccaaaaaccccaatagagaaaacccatgtcaaagcactcactcaaacttcaaatttagtaggagatcgcttttaaactccactacactggacctagtaggagctggggccctctctgtttctaagcctgcaagagcagagccaaagccagagccagagagcccagttgcctcaacttcaagcagaatgtcatactcaagattcttgcagtacttggatgaagacgctgttaagaaggtggacttgtttgagaatggaactgttgcgatcgccgagatcttcaatcccacattagataagatccaaagggtcaaggttcagttacctggattgccacaagagttgctgaggaagatgaaagaaaagaacgtagatttttcagctcatcctatggaaatcaactggttgccagcagttctagacttgttgggaaattttgcttttccattaatactacttggaacattgctgttcagagctagttctacaaacacaccaggaggccccaacttgccttttggacttggaaggagcaaagccaaatttcagatggagccaaatacaggggtaacatttgatgatgtagcaggggttgatgaagcaaagcaagatttccaagagattgttgaattcttgaaaactccagagaagttttctgctgttggagcaagaattcccaaaggggttcttttagtagggccacctgggactggaaagacactgctggccaaggccatagcaggagaagcaggggtccctttcttttctctgtcagggtcagagttcatagagatgtttgtaggagtaggagcttctagagtgagggatttattcaacaaggctaaagccaattccccatgcttggttttcattgatgagatagatgctgttgggaggcagagaggaacaggaattggtggaggaaatgatgagagagagcaaacactcaatcagttgcttactgaaatggatgggtttagtgggaacagtggagtgattgttattgctgctactaaccgccctgaaattctcgattcggctttgcttaggcctggcagatttgacagacaagtcactgttgggctaccagatataaggggaagagaagagatattaaaggtgcatagcaacaacaagaggcttgacaaggatgtttctcttagtgttattgccatgagaactcctggtttcagtggtgcagaccttgcaaacctcatgaatgaagctgccatccttgctggtaggagaggcaaaaacaagataacaatgaaggaaatcgatgactcaattgatcggattgtggctgggatggaggggacaaaaatgacagatggaaagagcaaagttcttgtggcttaccatgaagttggccacgctatttgtgcgacactgactccaggccatgatccagtgcagaaggtctctcttattccccgaggccaagctcgtggccttacatggttcataccggatgaagatcctgctcttatttctaagcaacaactgtttgcgagaatagttggagggttaggaggtagggcatcagaggaagtgatttttggggagccagaaataacaactggtgcagcaggagacttgcaacaaatcacacagatagcacgacggatggtaacaatgtttggcatgtctgagattggaccgtgggcattgacagaccccgcaacgcaaagcagcgatgtagtgttgagattgctagcaagaaacaacatgtctgaaaagctcgctgaagacattgatttgtcagtgagacatataattgagagtgcatatgaactggcaaagaaccatgtgaggaacaacagggaggccatggataaattagtagaagtgcttttagaaaaggagatcctcacaggagatgaattcagagcaattctgtctgaatttactgatatttctgtggcgaagttagataggaaatctcaatgtctctatctcctcaacctctgcttcacattcaaacaactctctcaggttcatgcccaaatccaagtatctggctttcaaagagaccactttctcctaacccaactcattcgcttctgcgctttgtctccctccaaaaacttcaactacgctcgaacccttctcgaccactctgagtcttcaccaccttcttcgtggaacttcctcatcagaggctatgcctcgagcgacacgcccagagaggccatctgggcctttcgtgcaatgctcggccggggtattagacccaaccaacttacctttccttttctgatcaagtcttgcgcttcggccgccgcccttaaagaagggaggcaagtacatgtaggcgttgtgaagtgcggtttggactgtgacgtgtatgttcagaacaacttggttcatttttatggggcttgtaagaagattaaggatgcacagcgtgtgttcgatggaatgtcggtgagaactgttgtttcgtggaatgcggttctaactgcttgcgttgagaatttctggttagatgaggggattgggtattttgtaaagatgagggattgtgggtttgagccggatgagactacaatggtggtcatgttgaacgcctcctcggagcttgggaacttgagcttagggaaatgggttcactcccaagtaattgaaaagggtttgattttgaattgtcaattgggtactgcacttgttgacatgtatgcaaaatctggggctttggtttatgccaggctagtttttgatagaatggagttgcggaatgtgtggacatggagtgcaatgattctaggactagcccagcatgggtttgccaaggaagcccttgaacttttcccaaagatgttgaacttctcagtacgcccgaattatgtcacttttcttggcgttctctgtgcttgtagccatgctggacaggtggatgatgggtaccaatactttcacgatatggaacatgtgcatgggattaaacccatgatgatacactatggtgccatggttgatatcttaggtcgtgctggccgtctgaacgaggcttatagcttcatcatgagcatgccctttgaccccgaccccattgtatggagaacattgcttagtgcatgcaatacgcgtgatgctaatgacgatgaaggggtaggaaataaagtaagtgagaagttgcttgaattggagccaagcaggggagggaatcttgtgatggtcgcaaacatgtatgctgaagttgggatgtgggagaaagcggccaatttgaggaaggttatgaaagaaagacgggtgaagaagacggcaggggagagttgcgttgagttaggcgggtccatccataaattcttttctggctatgattctcgagctgattatgagggtatctaccagttactagatgtattgagcttgcacatggagttggttaacatgtaatcaaaa

SEQ ID NO: 3432 - DNA, 1432 bp, Mesembryanthemum crystallinum
agtttgcagctgttggagcaaagattcccaagggagttttgttagttggaccacccgggacagggaaaaccctgcttgccaaggctatagcaggagaggcaggggtcccgttcttttctctctcgggctcagaattcatcgagatgtttgtaggagtcggggcctcgagggttagagacctattcaaaaaggctacagaaaatgcgccatgtttggtgtttattgatgagatagacgcggttgggaggcagagagggacgggcattggtggggggaatgatgagagggagcaaacgttgaatcagctgctcacggagatggatggttttagtggtaatagtggagttatagtcattgctgctacaaaccggcctgagattcttgatcaggcattgcttagaccggggcgatttgataggcaggtagcagttggactaccagatgtaaggggaagggaagaaatattgaaggtgcatagcagcaacaagaggctagacaaggatgtttcccttaatgttatagcgatgagaactcccgggttcagtggagcagatttggccaatcttatgaatgaagcagccattcttgctggtcggagaggcaaagacaggattacaattaaggaggttgatgactcaattgatcgcatcgtggcaggaatggaaggaaccaagatgactgatgggaagagcaagatgcttgtggcttaccacgaggtcggacatgctgtttgtgcgacgcttactccggggcatgacccagtacagaaagtcaccctgatacctagaggtcaagcccgtggtcttacatggttcatgcctaatgaagacccaaccttggtttctaagcggcagctgtttgctaggatagttggagggcttggaggaagggcagcagaagaagttatcttcggcgaaccagagataacaactggtgcagctggggacttgcagcaggttacacaaatagccaaacagatggtaacgatgtttgggatgtcggagattgggccttgggcgttaactgatcctgcagtgcagcaaagcgatgtggttctgaggttgttagcaaggaattcgatgtcagagaagctagcagaggatatagacgcatccgttagacggatagtcgacagtgcttacgaaatcgctaagcagcatatcagaaatcatagggaggctattgataagattgtggatgtattgctagagaaagaaacactcacaggagacgagttcagggccatcctgtcggaatttgttgatatctctgtcaacgattcgagcaggacttctgttcgtcaattgattaatgcttgagatggttttagaagcttgtctttgtacattcagaatcaacagtggctaaatgtaagatgtaacctgtacataaggaaattaagcaagataatagaaatgacaagttaatagta

SEQ ID NO: 3433 - DNA, 2058 bp, Arabidopsis lyrata
atgaaaatggcatcatcatcatcagctttgtctctccctctctccaacatcccaacctgtaataagaagtcccaagaatttcaaaaaccggctcctttatccaaatccagtcacacacataaacctagtcttaaaacccaaactttacaccacaaactcactaagagaaatttactgagtttgactgccttgggatttacgtcatctctaggaactgttcttgctcaccccgcaaaagctgaaccagaagctcccatcgaagccacttccaatagaatgtcgtactcgagattcctgcagcatctgaaagagaatgaagtgaagaaagttgacttgatcgagaacggaaccgttgcgatcgcagagatctctattccagcattaggaaagatccagagggttagggttaaccttcccggtttaccggttgatctggtgagggagatgaaggagaagaacgtcgatttcgctgctcatcccatggatgtgaattggggagctttcttgctcaacttcttggggaatttagggtttcctttaatcttacttggctctctgcttttaacatcttcttcaagaaaaacccctggtggacccaacttgccttttggtcttggaagaagcaaagctaagtttcagatggagcctaacacagggataacgttcgacgatgtagcaggagtagacgaagccaagcaagacttcgaagagatcgttgaattcttgaaaaccccagagaaattctcagctttgggggctaaaatcccaaaaggcgtcttgttgactggaccgccgggaactggaaaaactctcttggccaaggctatagccggagaagccggtgttccgtttttctctttgtccggctcggagttcatagagatgtttgttggtgtaggagcatctagggttagagacttgttcaacagggcaaaggctaattcaccttgtatagtgttcattgatgagattgatgctgttgggagaatgaggggaaccggtataggaggaggaaacgacgaacgtgagcagacgctaaaccagattttaaccgaaatggacgggtttacggggaatactggagtgattgtaatcgctgcaacgaaccggccggagattctcgactctgctttgctccgaccaggaagattcgataggcaggtttccgttggtttaccggatataagaggaagagaggagatattaaaagttcacagcaaaagcaagaaactcgacaaagatgtgtctttgagcgtgattgccatgagaactccaggtttcagtggagctgacttggcgaatcttatgaacgaagctgcgattctagccggaagaagaggaaaagacaagattacccttacagagattgacgactctatcgatcgaattgtcgccggaatggaagggacgaagatggtcgacggtaaaagcaaagcgattgtagcgtatcatgaagtaggacacgcaatttgtgcgactttgacggagggtcacgatccggttcagaaagttacgttggttcctagaggtcaagcacgtggtctcacgtggtttttgccgggagaagatccgactttggtgtctaaacagcaattgttcgctagaatcgtcggcggactcggaggcagagccgctgaagatgtaatttttggagaaccggagataaccactggcgccgccggcgatctccagcaagtcactgagatagcaagacagatggtgacgatgtttggtatgtccgagattggtccgtgggcattaaccgacccagcggttaagcaaaacgacgtagttctacgtatgttagcgaggaactccatgtccgaaaaactcgcggaagaaattgatgcttgcgtgaagaaaataatcggtgacgcttacgagattgcaaagaagcacgtgagaaataacagagaagccatagacaagcttgttgatgttttgttggagaaagaaaccttaacgggagacgagttccgagcaattctgtctgagtatactgatcaaccattaaataccgatgatagagttcgaatcaaagacttgattagtgtttaa

SEQ ID NO: 3434 - DNA, 2067 bp, Arabidopsis thaliana
atgaaaatggcatcatcatcatcagctttgtctttccctctctccaacatcccaacctgtagtaagaagtctcaacaatttcaaaaaccggcttctttatccaaatccagtcacacacataaacctagtctcaaaacccaaattttacaccacaaattcactaagagaaatttactgagtttgacgactgccttgggatttacgtcagcgctaggaactgttcttgctcaccccgcaaaagctgaaccagaagctcccatcgaagccacttccaatagaatgtcgtattcgagattcctgcagcatctgaaagagaatgaagtgaagaaagttgacttgatcgagaacggaacggttgcgatcgtagagatctctaatccagtagtaggaaagatccagagggttagggttaaccttcccggtttaccagtcgatctggtgagggagatgaaggagaagaacgtcgatttcgctgctcatcccatgaatgtgaactggggagctttcttgctcaacttcttggggaatttagggtttcctttgatcttgcttgtctctctgcttttaacatcttcttcaagaagaaaccctgctggacctaacttgccttttggtcttggaagaagcaaagctaagtttcagatggagcctaacacagggataacgttcgaggatgtagcaggagtagacgaagccaagcaagactttgaagagatcgttgaatttttgaaaaccccagagaaattctcagctttgggggctaaaatcccaaaaggcgtcttgttgaccggaccgccaggaaccggaaagacactcttggccaaggctatagccggagaagccggtgttccttttttttcattgtctggttcggagttcatagagatgtttgttggtgtaggagcatctagagctagagacttgtttaacaaggcaaaggctaattcaccttgtatagtgttcattgatgagattgatgctgttgggagaatgagaggaaccggtataggaggaggaaacgacgaacgtgagcagacgctaaaccagatattaaccgaaatggatgggtttgcggggaataccggagtaattgtgatcgctgcaacgaaccggccagagattctagactctgctttgctccgaccaggaagattcgataggcaggtttctgttggtttaccggatataagaggaagagaggagatattaaaagttcacagcagaagcaagaaactcgacaaagatgtatctttgagcgtaattgccatgagaactccaggttttagtggagctgacttggccaatcttatgaacgaagcagcgattctcgccggaagaagaggaaaagacaagattacccttacagagatcgacgactctatcgatcggatagtcgccggaatggaagggacaaagatgatcgacggtaaaagtaaagcgattgtagcgtaccatgaagtaggacatgcaatttgtgcgactttgacggagggtcatgatccggttcagaaagttacgttggttcctagaggtcaagcacgtggtctcacgtggttcttaccgggagaagatccgacattggtgtctaaacagcaattgttcgctagaatcgtcggaggactcggaggcagagccgccgaagatgtaatttttggagaaccggagataaccaccggcgctgccggtgatctccagcaagtcactgagatagcaagacagatggtgacgatgtttggtatgtcggaaatcggtccatgggcactaaccgacccagcggttaagcaaaacgatgtggttctacggatgctagcgaggaactcaatgtccgagaaacttgcggaggatattgattcttgcgtgaagaaaataatcggtgacgcttacgaggttgcgaaaaagcacgtgaggaataatagagaagctatagacaagcttgttgatgttttgttggagaaagaaaccttaacgggagacgagtttcgagcaattctgtctgagtatactgatcaaccgttaaataccgatggcgatgtaagaattcgaatcaatgacttgattagtgtctaa

SEQ ID NO: 3435 - DNA, 3498 bp, Ricinus communis
aaatcttcaataaataaaacatgtcacctgcactatcattctccctttcccgtgttcccatctgcaaattccaggccttctcgaaagatacccacctcacaagaattggtaacaaagacgacccatctcataaaacatccttggatatcaaacttagtaaaagaaagctactatgtgccactgcttcaggacttttaagtgttgcttctcagtcagctaaagctgagccagatattccaatagcatcaacgtcaagtagaatatcatattcaagattcttgcaatacttggatgaaggtgctgtcaggaaagtagacttgtttgagaatgggactatggcgattgctgagatattcaatccaacccttgacaagattcagagagtgaaaatacaattaccaggattgccacatgagttgttgaggaaaatggaggagaagaatgtagattttgctgcgcatccaatggaatttaattgggctcctgctttaatcgacttgttagggaactttgccttcccattgattctgcttggcagtttgctgttaagatcatcatctacaaacactcctggtggtccaaatttaccgtttggacttggcaggagcaaagccaaattccaaatggagccgaacacaggagtaacatttgatgatgtcgctggcgttgatgaagcgaagcaagactttcaagaaattgttgacttcttgaaaacaccagagaagttttctgcagtaggggcaagaattccaaaaggagttctattagttggacctcctgggactggaaagacattacttgccaaggcaatagctggagaagcaggggttcctttcttctcgctttcaggatcggagtttattgagatgtttgtgggtgtaggggcttcaagagtcagggatttattcaacaaggcaaaggtaaactcaccatgtttggtttttatcgatgaaattgatgctgttgggaggcagagagggacaggcattggtggaggaaatgatgagagggaacaaacattaaatcagttgcttactgaaatggatggttttagtggtgatagtggagttattattattgctgctacgaatcgacctgaaattcttgattctgctttgcttaggccagggagatttgacaggcaggttactgttggactaccagatattagaggaagagaagagatactgaatgttcatagcaaaagcaagaagcttgacaaggatgtttctctcagtgtcattgctatgaggactccaggattcagtggagcagacttggcaaatctcatgaatgaagctgccattcttgctggaaggagaggcaaagacaggatcagcctgaaagaaattgatgattcaattgatagaatcgtagcaggcatggaaggaaccaagatgacagatggaaaaagcaaaatcctggttgcttatcacgaaattgggcacgcagtttgtgcgacattgactcctggccacgatccagttcaaaaagtgacactgattccacgaggccaagctcgcggattaacatggttcacacctggagaagatcctactctcatctccaaacaacaactttttgctagaatagttggaggacttggagggagagcagcagaggaaataatcttcggagaatcagaaatcactactggtgcagcaggagaccttcaacaggttactgaaattgctaaacaggcatatggtaacaatatttggcatgtctgaaatcggtccatgggcactgactgatccagcagttcaaagcactgatgttgtgctaaggatgctggctagaaattccatgtcagaaaaacttgcacaggatattgatacatcgattcgagacataatagagagagcccacgagattgctaaagaacatgtaaggaataatagggatgcaattgataagctagtggatattctacttgagaaggaaactttgacaggggatgagttcagggcaatcctgtcagaatttacggatatttctggagctcaagtagaaagaactccttgcctttcactcctcaagctttgttcctcgatcaaacatctttatcaaatccattcccaaatacaagtctctggtcttcaaggagacacctttctcgttacccaactcattaaattctcctctttgtctccttcaaaagacttgagctatgctcaatccattcttgatcactctgttcacccagttccacttccttggaacatacttattagaggctacgcggatagtaataccccaaaagatgccctttttgtctatcgcaatatgcgaaatgaagggattagacccaatagcttgaccttcccttttcttctcaaagcctgcgctgcgtgttttgcaactaaagaagggaaacaagttcatgttgaagttatcaagtatggtttggattgtgacgtgtatgtcaataacaatttggtcaatttttatgggtcttgcaagaaaattctagatgcatgtaaggtgtttgatgaaatgcctgaaagaactgtggtttcatggaatgcggtgatcactagctgtgttgagagtttaaagttgggggaggcaattaggtattttttgaaaatgagggattttgggtttgaaccggatgggactacgatggtgcttatgcttgtgatatgtgctgaaatgggaaacttgggtttaggtagatggattcattcccaagtgattgagagaggtttggtattgaattatcaattgggtactgcccttgttgatatgtatgcaaaaagtggagctgttggttatgctaagttagtttttgatagaatgaaggagaaaaatgtgtggacatggagtgccatgatcttggggctggcgcaacatggatttgccaaagagggccttgaacttttccttgacatgatgaggagttctttgatacacccgaattatgtcacatttctcggggttctttgtgcctgtagccatgctggtttggtatccgatggattccggtacttccatgaaatggggcatacatatggaatcaaaccaatgatggtacattatggtgcaatggttgatatcttaggtcgtgctggtcttctcaaagaggcttataactttataactaagatgcctttccaacctgaccctattgtgtggaggacattgctcagtgcgtgcagcattcatgacgttaaggacagtactggggtagcatataaggtgagaaagaggttgcttgagctagagccaaggagaagtgggaattttgtgatggtagcaaacatgtatgctgatgctgggatgtgggaaaaggcggcaaaagtgaggagggtaatgagagatgggggtttgaagaagaaggctggagagagttgtgttgaattatctggttccatccatcggttcttttctggttatgactcgcaggatgataaggaaggcatgtaccagttgctagatggactaaacttgcatatgcagatgatggtaatgtttctcgtccatcattatgtgtga

SEQ ID NO: 3436 - DNA, 1564 bp, Glycine max
ttgaggtcttctaatcctccttctgggccatctgattgggctgtgtcattacctcttggattgctgattgggctcacaacatctctttatggtttttccgaaactccatatgcaattacttcctccaccgaaaaaattgtttttaccgcacctttccggaatgtagagtaaagcaaagtttgagatggaaccaaacacaggagttacatttgaggatgttgctggagttgacgaagccaagcaagacttgcaagagattgttgagttcttgaagaccccagagaagttttctgcagttggagctaaaattcccaaaggggtacttttggtagggcccccagggactggaaagacattgctggccagggcaattgcaggagaggctggggttcctttcttttccctatctggatcagagttcattgagatgtttgggggtgtaggggcctcaagggtgagagatttgtttagcaaggccaagcaaaattcaccttgtttgatattcattgatgagatagatgctgtagggaggcagagaggtacaggtataggtggaggaaatgatgaaagggagcaaacactgaatcagttgctcactgaaatggatggtttcactggaaacactggagttatagtcattgctgctaccaacagacctgaaattcttgattcagcattgcttagacctgggaggtttgatagacaggtcactgttggattaccagatgaaagagggagggaagaaatattgaaagttcatagtaacaacaagaagcttgacaaggatgtctctcttagtgtcattgccatgagaactccgggattcagtggtgcagacctcgcaaacctcatgaatgaggccgccattcttgctggtcgaaggggcaaagataagatcacaatgaaagaagttgatgactccatagatcgcattgtggcaggcatggaaggaaccaagatgactgatggcaaaagcaaaattctggtggcttaccatgaaattggacatgctgtttgtgcgacactgaccccagggcatgatccagtacagaaagtcactctagttccgagaggccaagcccggggcttaacatggttcataccaggtgaagatccatctctcatctctaagaagcaactatttgctagaatagttggaggcttagggggaagagcagcagaggaagttatatttggtgaaactgagataaccactggagctgctggggagttgcaacaaattacacaaatagcaagaaagatggtaacagtgtttggcatgtcagagattggagcgtgggcattgactgatcctgcagtgcaaagtagtgatgttgtgctaaggatgctggctaggaactcaatgtcagacaaactagctgaggacattgataactcaaatcacataaggaataaccgtgatgcagttgataaattagtggatgtgctacttgagaaggagacccttagtggagataaattaagagctatcttgtctgaattcactgacatttcttcaattaaggtagagagaatccctattcgggaattgatcgaagcataa

SEQ ID NO: 3437 - DNA, 1209 bp, Nicotiana tabacum
  misc_feature (113)..(113): n is a, c, g, or t
  misc_feature (129)..(129): n is a, c, g, or t
  misc_feature (142)..(142): n is a, c, g, or t
  misc_feature (199)..(199): n is a, c, g, or t
  misc_feature (207)..(207): n is a, c, g, or t
  misc_feature (265)..(265): n is a, c, g, or t
  misc_feature (286)..(286): n is a, c, g, or t
  misc_feature (290)..(290): n is a, c, g, or t
  misc_feature (313)..(313): n is a, c, g, or t
  misc_feature (495)..(495): n is a, c, g, or t
ttgatgagattgatgctgttgggagtgcaaagaggaactggcattggcggtggaaatgatgaaagagagcagacacttaaccaacttctcactgaaatggatggtttcactgngaaacactggagtcantgtcattgctgcnactaataggcctgaaattcttgatcaagctttgcttcgacctggaagatttgatagncaggtaantgttggactgcctgatataagaggaagggaagaaatattgaaggttcatagtaacaanaagaagcttgataaagatgtntctntaagtgttattgcaatgagaacnccaggattcagtggtgcagatcttgcaaacctcatgaatgaagctgctattctagctggaagaagaggaaaagataagattacctcgaaagagattgatgattccatcgatagaattgttgctggaatggaaggaaccaagatgacagatggcaaaaacaagattttggtagcatatcatgnagttggacatggtgtctgcgcgacattgacccctggccatgatgcagtacagaaagttacattgatcccaagagggcaagctcgcggtcttacatggtttattcctggtgaagatccaaccttgatatctaagcagcaactttttgctagaatagttggaagcttaggaggtagagcagcagaggaaataatttttggtgaagcagaaatcactactggtgcagccggagacttgcaacaaataactcaaatagcaagacagatggtgacaatgttcgggatgtctgagataggaccatgggcgttaacagatccagcaacacagagtggtgatgtggtgctgagaatgctggcgaggaatcaaatgtcagagaaactagcagaagacattgatgcatcggtaaggcacataattgagagagcatatgaaattgcaaagaaccacataaggaacaacagggaggcaatcgacaaattagtggatgtgttgctagaaaaggagactcttacaggagatgaattcagagctatactctctgaattcactaatatcccatcagctaacataaacagcaaaccaattagagaactgattgaggcctaagcaaaattacttccaatgtacagctgcagaaactaaaaactttcaccagattgtacatgtatagtgtagtgcagaaagcttgatcaatgtaatataatcggttaaatttc

SEQ ID NO: 3438 - DNA, 2077 bp, Aquilegia formosa
ttgttctatcttccttaaaaatgccagttgctctgtcaatctctgcatccaaactcctcatctctaactttcagtatcattcaaaggataccaatctccaaaagaatgtttctagagaaaacccaagtcttggatcacttcaagacatcaaactaagcaagagaaagttgttacaatctttaggtttgggtcttataaatggtggagttttggcagttcagcctacaagagctgaaccagagaaccaaacagattttacttcaagtagtacaatgtcttactcaaggttacttgagtatatagatgaaggaaaggtgaagaaggtagatttttttgagaatggaactgttgcaatagctgagattatgaatctaggactcaacagaactcagagggttagagtacaattaaataacttgtcagaagaagtgttgttaaaaagattaaaggagaaagatgtagattttgctgctcatcctatggaacctaacattacagctatgcttctagattttttatggaacttcggcttcccattatttttagttggtagtttattgttccgaggaagttccatgaataatactcctggaggtcctaacttaccatttggactaggaaggtccaaggccaaatttcagatggaaccaaacactggaataacatttgatgatgtagctggagttgatgaagcaaagcaagactttcaagaaattgtagaatttttgaagactccagagaagttttcttcagttggggcaagaattcccaaaggggttctccttgtcggtccaccaggtacagggaaaacattgttggctaaagctatagctggagaagcaggggtacctttctttagtttatcaggatcagagttcattgaaatgtttgttggagttggagctttaagagtaagggatttattcaataaggctaaaatgaattccccgtgtttggtttttatcgatgagatagatgctgtaggaagacaaagaggaacaggtattggaggaggaaatgatgaaagggagcaaactttgaaccagttgcttactgaaatggatggttttagtgggaatagtggagtgattgtcattgctgctactaatagacctgaaattcttgattcagctttgcttaggcctggaaggtttgataggcaggtgactgttggattgcctgatataagaggcagggaggagatactgaaagtccatgccaagaacaagaagcttgataagaatgtattgattgatgtaattgcaatgcgaacaccaggatttagtggtgcagatctggcgaatcttatgaacgaagctgctattctggctggcagaagagggaaggaggagataacaacaaaagaagttgatgattcaattgaccgtattgtagcaggaatggaaggaaccaagatgacagatggaaagagcaaaatattggtggcttatcatgagattggacatgctatatgcgcgacattgactccaggtcatgaccctgtacaaaaggttacacttattcctcggggacaagctcgtggtcttacttggttcatacctggtgaagacccaactcttgtatcaaagcaacaactctttgccagaatagttggtggtcttggtggtagagcaaccgaggaaataatcttcggcgagccagaagttactactggtgcaacaggggacttgcaacaaatcactcagatagcaagacagatggtaactacatatggaatgtcagaaattggtccatgggcattgactgatccagcagcacagagcagtgatgtagtatttagattgttagcaagaaataacatgtcagaaaaacttgccgaagacattgataagtcggtacgaacaattgttaacactgcatatgaaattgcgaagagtcacataaggaataacagggaagcaatcgataagctagtggatgtgttgttggagaaggaaacactcccaggagacgagttcagagcaatcttatcagaatttgttaacaccccactcgataaaatcaataagacttccattcgtgagctaatcacactatgaaccactccatcaatgaa

SEQ ID NO: 3439 - DNA, 2477 bp, Sorghum bicolor
aaaaccgcaaggacgactgaaacttgacacggctcgcgcgcgtacgacgctgcattgcaattttgcatcactcatcagtataaccacttaaccagtaggtagtcgatctagtccgattagttgccgatgtcgccgacgaccatgtccctgaccacgacgagccgcctgcccatctgccgggcgcaggacgtgtccaagcaggcgcctggacagaagcgtgcgcctccgtcgtcgtcgaagtcgtcgtcagacacagccggtttcagcaggaggaggctgctgcagtccgcggggatgggtctcggcgggctcggtctcgccgtgagagacccagcgcgggcgcgtgccgagacagcgccggcgctggctccggaggaggtgacgtcgaaccggatgtcctactcgcggttcctggattacctcaacgccagcgcggtgcggaaggtggacttcttcgagaacggcacggtggccgtcgtcgagcttgacgacccggcgctggcgccgtcgagggtgcaccgggtgcgggtgcagctcccgggcctctccgccgagctggtgcgcaagctgcgggacaggggcgtcgacttcgcggcgcaccccgtggagcccaacctcgggctcgtgttcctcgacgtcctcctcaacttcggcttcccgctcctcttcatcgcgtcgctgatctggaggtcgatcaccatgaacaaccccggcgccggcggggggcccagcctcccgttcgggctcggcaagtccaaggccaagttccagatggagcccaacaccgggatcacgttcgacgacgtcgccggcgtggacgaggccaagcaggacttccaggagatcgtgcagttcctcaagtcgccggagaagttcacggcggtgggggcgaggatccccaagggcgtgctgctggtgggcccgccgggcacggggaagacgctgctggccaaggccatcgcgggggaggccggggtgcctttcttctcgctgtccgggtccgagttcatcgagatgttcgtcggcgtgggcgcgtcgcgggtgcgggacctcttcagcaaggccaaggccaacgcgccgtgcctcgtcttcatcgacgagatcgacgccgtgggacgccagcgcggcacgggcatcggcggcgggaacgacgagcgggagcagacgctgaaccagctgctgacggagatggacgggttcagcggagacagcggcgtcatcgtcatcgcggccacgaaccggccggagatcctcgacgccgcgctgctccgcccgggccgcttcgaccggcaggtcagcgtcgggctccccgacgtccgcgggcgggaggagatcctcagggtgcacagctccaacaagaagctcgaccccgacgtgtcgctcagcgtcgtggccatgcgcacgcccgggttcagcggcgccgaccttgccaaccttatgaatgaggctgccatccttgccggccgccgcggcaaggaccgcatcagtgtcaaggagatcgacgactccatcgaccgcatcgtcgccggcctcgagggcaccaccatgaccgacggcaagagcaagctgcttgtcgcctaccacgagatcggccacgccgtctgcgcgacgctgacgccggggcacgacgcggtgcagaaggtgacgctgatcccacgggggcaggcgcgcgggctgacgtggttcctgccgggcgaggacccgacgctggtgtcgaagcagcagatcttcgcgcgcatcgtgggcgggctcggcgggcgcgccgccgaggaggtgatcttcggggacgccgaggtgacgacgggcgcggcgggcgacctgcagcaggtgacgcaggtggcgcggcagatggtgaccacgttcgggatgtcggagatcgggccgtgggcgctcatggagccggccgcgcagagcggcgacgtcgtgctgcggatgctggcccggaactccatgtcggagaagctcgccgcggacatcgacagcgccgtgaagcacatcatcgaccaggcgtacgaggtcgccaaggagcatgtcaggaggaaccgcgcggccatcgaccagctggtggacgtgctcatggagaaggagacgctcaccggcgacgagttcagggccatcttgtcggagcacgtcgacattggcaaggagcagagggaaacagcagcccggacagagctggtcaccgcttgaagctagagaagactagcactgtagtatagaaaggagtatatataggagaagcatagcttagactatctccaacaatcgtcacccaaaatacaagacccatttgtcctttgagtagcgctacaggtaaaaggttccatacctatttttagtcttctccaacaataagacctaaaagacaacactctctgcaaatgggtctcgaagagagaggatatccaaatttgggttatgtctctcctaatacccaaaatgggtcttctgttttggtactctgttggaggctatat

SEQ ID NO: 3440 - DNA, 1010 bp, Gossypium hirsutum
gtttcaaagttggggtttggttgtatgggtctcactggagtttacaatgattctgtccatgaagaagttgggatatcgattatcaagcatgccttccacagaggaatcactttctttgatacatctgatttctatggacccaaaactaatgaaattttggttggaaaggcattgaagcaactaccaagagagaaggtacaattagccacaaagtttggaattgaaaaaatggattcggccggtgtcacaataaacggtactccagaatatgtccgtgcctgtattgaagctagccttaagcgcctagatgtggactatattgatctctactaccaacacagggttgacaccaacactccaatagaggatactatgtctgaactgaagaagttggtggaagaggggaaaataaagtacataggtttatctggagcttcccctgaaactataaagagagcacatgcagtacatcccataactgctttacagatagagtggtcgctatggactcgtgatcttgaggaagaaatagtccccctttgcagggaacttggaattggcattgttccatatggccctcttggtagcggtttctttgcaggcagaggagtattggaaactatgcctgcaaatagttttctgccaactttcccaaggtttcaagaagaaaacttggacaaaaataagatcatatatttgaaagtggagaagttggctaagaagcatggatgtagccctgcacaattagcacttgcctgggttcttcatcaaggggacgatgtagcaccgattcccggaacaaccaagataaagaatctcgatagtaacagtgattcactaaaagtaaagctcacagaagaagatttgaaagaaatttctaatgcggtcccgataaatgaggtagctggtgaatttttgcctgataatttaagtcaattccactggaagttcggtaatacaccaccaaaggggagcaaggtttgaacttgaaataaccatggatgcaaagt

SEQ ID NO: 3441 - DNA, 1010 bp, Gossypium hirsutum
gtttcaaagttggggtttggatgtatggggctcactggagtttacaatgatcctgtccctgaggaaattggcatatcgattatcaagcatgcattccacagaggaatcactttctttgatacatctgatttctatggacccaaaactaatgaaattttgattggaaaggcattgaagcagctaccaagagagaaggtacagttagccacaaagtttggaatcgaaaatatggattcgactggtttcatagtaaatggtactccccaatatgtccgtacctgtattgaagctagcctgaagcgccttgatgtagactatattgatctttactaccagcacagggttgacaccaacactccaatagaggatactatgtctgaactcaagaagctggtcgaagaagggaaaataaagtacataggtttatctgaagctagccctgaaactataaagagagcacatgcagtacatcccataactgctctacagatggagtggtcactgtggactcgtgatatcgaggatgaaatagtacctctttgcagggaacttggaattggcattgttccgtattcccctctcggtagcggtttctttgccggaagaggagtgatggaaactgttcctgcaaatagtatgctgacatatatctcaagatttcaaggagaaaacttggacaaaaataagaagttatatttgaaaaccgagaagttggccaagaagcatggatgtacctctgcacaagtagcacttgcctgggtccttcatcaaggggatgatgtagcaccgcttcccggaacaaccaagataaagaatctggatagtaacattggttcactaaaagtaaagctcacagcagaagatttgaaagaaatttcggatgcagttccgataaatgaggtagcaggtaatcctatgcctgatattttaagtcgattcagttggaagtttagcaatacaccaccaaaggggagcaaggtttcaacttgaaacaaccatggatgcaaagt

SEQ ID NO: 3442 - DNA, 1232 bp, Gossypium hirsutum
gttgtatgggtctcactggagtttacaatgattctgtccatgaagaagttgggatatcgattatcaagcatgccttccacagaggaatcactttctttgatacatctgatttctatggacccaaaactaatgaaattttggttggaaaggcattgaagcaactaccaagagagaaggtacaattagccacaaagtttggaattgaaaaaatggattcggccggtgtcacaataaacggtactccagaatatgtccgtgcctgtattgaagctagccttaagcgcctagatgtggactatattgatctctactaccaacacagggttgacaccaacactccaatagaggatactatgtctgaactgaagaagttggtggaagaggggaaaataaagtacataggtttatctggagcttcccctgaaactataaagagagcacatgcagtacatcccataactgctttacagatagagtggtcgctatggactcgtgatcttgaggaagaaatagtccccctttgcagggaacttggaattggcattgttccatatagccctcttggtagcggtttctttgcaggcagaggagtattggaaactatgcctgcaaatagttttctgccaactttcccaaggtttcaagaagaaaacttggacaaaaataagatcatatatttgaaagtggagaagttggctaagaagcatggatgtagccctgcacaattagcacttgcctgggttcttcatcaaggggacgatgtagcaccgattcccggaacaaccaagataaagaatctcgatagtaacagtgattcactaaaagtagagctcacagaagaagatttgaaagaaatttctaatgcggtcccgataaatgaggtagctggtgaatttttgcctgataatttaagtcaattccactggaagttcggtaatacaccaccaaaggggagcaaggtttcaacttgaaataaccatggatgcaaagtctgcagcaaaaaatgaggttttggatgaatggactctctccaacaactcaaacgattgaaaatttgtatcaatggttttgctgtctgtgattgtagcaagtaattttccaagttatatagttaggaaatcaaacaggttgtttatcacctgaacactgttgtttcagctacttacagcagtattattgtagcaggttgctaccacctgtttgtcttggagaaataaaaatcataatttttt

SEQ ID NO: 3443 - DNA, 2295 bp, Theobroma cacao
atggctgaggagcagcagagatttcagattcctagagtgaaactgggaaatcaaggacttgaggtttccaagttagggtttggctgtatgggactttctggagcctacaatgatcctctccctgatgatgttggcatatcgatcatcaagcacgctttcgatagaggaatcactttcttcgatacatccgatatctatggacccaaaactaatgaagtactggttggaaagggattgaagcagctaccgcgagagaaggtgcagttagccacaaaatttggttttgcgaaaatggaagctactggtgtcaccgtaaacggtactcctgaatatgtccgtgcctctgttgaggctagccttaagcgccttgatgtggaatacattgatctctactatcagcacagggtcgacaccaccactccaatagaggataccatgggtgaacttaagaagttggtggaggaagggaaaataaagtacattggtttatctgaagctagccctgaaactataacgagagcacacgcggttcatcccataactgctgtacaaatggagtggtccctctggactcgtgacattgaggaagaaatagtcccccttagcaggcaactgggaattgggattgttccatacagccctcttggtcatggtttctttggtggcagagcagttgaggaaagtgtgcccgcaaatagtgttctgggaattctcccaaggtttcaaagcgaaaacttggaaagaaacaagatcttatatctgaaacatggatgtaccactgcacaacttgcacttgcctgggttcttcatcaaggagatgatgtagtacctattcctggtaaagaagaaaaaatcttgatagcaacattgattcactcaggttgaagctcactgaagaagatttaaaagagattagtgatgtgatccccataaatgaggtagcagggtgtagaacgctggatagtttttttcaggtttccaagttagggtttggctgtgcgggactttctggagcctacagtgatcctctccctgatgatgttggtataacgatcatcaagcacgctttcgatagaggaatcactttcttcgatacatcagatttctatggacccaaaactaatgaaatactggttggaaaggcattgaagcagctaccgcgagagaaggtgcagttagccacaaaatttggtattgcgaaaatcgatgctactggtgtcatagtaaacggtactcctgaatatgtccgggcctcggttgaggctagcctgaagcgccttgatgtggaatacattgatctctactatcagcacagggtcgacacctccactccaatagaggatactatgggtgaactcaagaagttggtggaagaagggaaaataaagtacattggtttatctgaagctagccccgaaactataaagagagcacatgcggttcatcccataactgctgtacaaatggagtggtcgctctggactcgtgacattgaggaaggaatagtccccctttgcaggcaactcggaattgggattgttccatacagccctcttggtcatggtttctttggtggcaaagcagttgatgaaagtgtgcctgctgatagttttatgagattgctcccaaggtttcaaggagaaaactttgacagaaacaagatcttatatctgaaagtaaagaagttggctgagaagcatggatgtaccactgcacaacttgcacttgcctgggttcttcatcaaggagatgatgtagtacccattcctggaacaacaaagacaaaaaatctggatggcaacattgattcactgagggtgaagctcacagaagaagatttacaagagatttgtgatgtgatccccatgaatgaggtagcaggcgctcttatgccagatggtttaagtcatctcacgtggaagtttgctaacacaccaccaaaggatagcaagatttcaacttaaattgaactgaacgatggatgcaaagtctgcagcagaatatgatgtttttggtgaatggactctctccatcaacggaaactattgaaagactagtagtttgtgttgaaaagttagtaagctttggatacaataatgaagggctgtagttggcattgtagctttgccgttgaatgcttatcagagaaagaatgcatttacttgtattgtttttctgtctgtgctttgttggtaataatccccaatgcttatggttgtcaacagcaaaggttaagatgctgtataagaactatgtttttatttagtgctctaataatataattcatcttggtct

SEQ ID NO: 3444 - DNA, 3114 bp, Gossypium hirsutum
tttcttgtagatttacaatgagcaaattggggatttactcgatccaactcaaaggaaccttgagataaaggacgatccaaagaatggattgtacgttgagaatttgacagaagaatatgtttctagctatgaggatgtaactcaagtttttgatttaaggggctttcaagtaggaaggttggagcaacaactgtaaattccaagagctctcggtctcacattgtttttacttttttcattgaatcttggtgcaagcgggagcttcatcaaaatgtttcagcagttcaaaaacaagcagaatcagcttgattgaccttgcaggattggatagaaacaaacttgaagatgttggtagacaacatgtactggaaggcaaaaatgtcaagaagtccttatcacaacttgggtatttggtgaacactcttgcaaaagaaactcaacctgaaaaacctgaagatgttccatatgggggttcctgtttaacacgtatattgagagaatcccttggtggcaatgccaaactcacagttatgtgcaatatttctgcaaacaacagaaatacaagtgaaatactgagcactcttagatttgggcaaagggttaaagctgtaagaaacgagccagtaataaatgaaatatctgaagatgatgtaaatggcttgagtgatcagattcgtcaactgaaggaagagcttataagagcaaagtctgatgcatatagctcagttgggagtaaaagtggatattttaaagggtggaatgcacgtgaaagcttgaaccagttaagaataagccttaaccgctctctgatccttccacgcatagataacgaatacgaggaagagattaatattggcgaggatgatgtaaaggaactacgtcagcagctagattatttagatagctcttgtgagacaaacttaagagatccattggacaagagaggttccattcaatcttctgtaaaagaaagttgtgagacagacttgctgagtgaatatgacattcattgcccaaaggaaacagagatagaagaaattgatgaagtggaagttcctcccatgtccagtcctgagccagctgatgacctttcagttacatcaaaaactttgaaggctgttgatccttcaattagaaatagcatctccatcagcccacatcgtcggtcttcaatccttgaagagcctacattgtctgaatctcccaaaattgcaaataatctaaggaaaagcatggctgttccgtcagcacttttggccagtcagaaaaatgtatcagagagttcagagtcagaggtattacgagagttgctcaaatatagtgaccacatcaggtcctcattacgtacaagcaagacgtttttaggacctacagagtctttggctgcaagccttcaaaggggccggcagattattgatcaacaccagcatagttcagttcccaacagatcttcagttgccttctctttcgaacacctgatgctgaaaccttctccagaagcagacaaggccaatgcttctgttcaaacattaccaaatgacaaaccatctccggatggttcttctactcctttgttttgttcatcttgccaaaggaagtttgacaataaccaccctgatgaggttcaggatagcttgaagacatggattgtaacggttgataaccaacagagagatggcaggaacacagtggaagaagcctccaaaaaagagaaaacacttgaaagtgtttgtaaggagcaagcagccaaaattgagcagttaacccagctggtgaaaaaatacaaacttgaaagagaaaattctgcaattgaacatgctcctgagcctctgaagaatgaaataatactgtttgatgagcagtccaacaatggtgaaaatggaaaagaatattttgatatgactgaaaaggaagcacttcttcaggagattcagacattgaaaagtaaattgcagtcatatactgcttctccatctccaaacaagtctactgaaatactgaggtcctctttgttgtcacgttccattcaattgcgaaaaagtgtagactgtcgtaataacagcgaggaagaacttgagcgagaaagacaaagatggatggaaatggaaagtgactggatatccctgaccgatgagctcaggatggatctggaatctaaccgctgccgtgccgaaaaagtgagatggaactgaaattagagaagaagtgcaccgaggagttagatgatgctcttagcagagctgtcctcggtcatgctagaatggttgaacactatgctgatcttcaagaaaaatacaatgatctggtttcgaagcaccgggcgataatggaaggcatagcagagataaagaaggcagcagcaaaggcaggaagcaaaggtcatggtgcacgttttgccaaatccctggcggctgagctctcagctattagagtggaaagggaaagggagaaagaacaattgaaaaaagagaacagaagtctcagaacccagctaagagacacagcagaggcagttcatgctgctggagaactcctagttaggctgagagaagctgagcaagcagcctcaattgctgaggagaactttagtaatgttcagcaagagaatgaaaagttgaaaaagcaagcggataagttgaaaagaaaacacaagatggaaatggtgaccatgaaacagtaccttgcagagagcagattgccagaatctgcactacaaccattataccgagaggattcagatgtagcagcatcacacaacagcagtgcaattccatatgatgatcaggcttggagagcagaattcggagcaatatatcaagaacattactaattcatctaaaacaaatctgaccttacttcggtcagaatgaagatatgtatacctatgttgtttgtgagtgtcggatacgaatatgtatcttacacaatttaattcttttaaaatgtttttttttggtgtgtaaaagttacaagtcaattttatacccatatccggatatatatatgttggacatgggtgagagcaagagggacacaaactactattcttgtatttttattttttatttttgatcaaaatactactattcttgtattgaatgcatcatctctaat

SEQ ID NO: 3445 - DNA, 1293 bp, Setaria italica
cacagaggccggctttactggcattggagttggtgcagcttatcaaggtcttcggcctattgtagaatttatgacatttaacttctcgatgcaggctattgatcatatcatcaattcagctgccaagtcaaactacatgtcagctggtcagatctctgttcctattgtttttagaggacctaatggagctgctgctggagtcggggcgcaacactcccagtgttatgcagcttggtatgcgcatgttccaggccttaaagttctcacaccatactctgcagaagatgctagaggcttgctaaaagctgctattagggatcctgatcctgttattttcttggaaaatgaattgctttatggagaatcattccctgtttctgctgaagtgcttgattctagtttctgcctgccgattggcaaagctaagatagaacgtgagggtaaagatgttaccattactacattctccaagatggttggctatgctctccaggctgcagagatactgtccaaggaaggaatcagtgctgaggtgatcaaccttcgatccattagaccacttgacagagctgctatcaatgcatctgttaggaagaccaaccgattggtgactgttgaagaagggttcccccagcatgggattggtgctgagatatgcatgtctgttgtagaagaaagctttgagtaccttgatgcgccagttgagaggatcgctggagctgatgtacctatgccctatgctgccaaccttgagagaatggctgttccacaggtagatgacattgtccgggcagcgaagcgggcctgctatagggcagtgccaatggcagcaactgcctgatcggtggacgagccttattgttttcctttgctttcgccctctataggcagaagaaacatgtagtattcataaagtgctggcaaattgcccagactccaagcgagctaattttgtagatctgccatggcgtgctcaattccgttagtcgcagatggatgattgcattcgttttctggtttcaagccccattccttttctatgatttatacacacggcctaatcatgttggcatgcaaaacgggtcactttgttgggacccgttagttccgtcgcatccaatcttttgctgcttggaacacaaggtcagtggatggcaataaactacccaccactattgtacatgcctactttattgtttatctgcctgaaattcacagcaagggacatcgaatcttcgagtaaatgtatttcccatgactcgagtaaatgtgttaccaaggccctgtatgtga

SEQ ID NO: 3446 - DNA, 1077 bp, Zea mays
gatactgttcctattgtttttagaggaccaaatggagctgctgctggagttggtgctcaacactcacagtgttatgcagtttggtttgcacatgttccaggacttaaggttctcacaccatactcttcagaagatgcccgaggcttgcttaaagctgctattagggatcctgatcctgttattttcttggaaaatgaattgctttatggagaatctttcccagtttctgctgaagtgcttgattctagtttttgcctaccgattggcaaagctaagatagaacgtgggggtaaagatgttaccattactgcgttctccaagatggttggctatgctctccaggctgcagagatactgtccaaggaaggaatcagtgctgaggtgatcaaccttcgatcgatcagaccacttgatagagctgctattaatgcatctgttaggaaaaccaaccgattggtgactgttgaagaagggttccctcaacatgggattggtgccgagatatgcatgtctgttgtagaagaaagctttgagtaccttgatgccccagttgagaggatcgctggagctgatgtacctatgccctatgctgccaaccttgagagaatggctgttccacaggtcgatgacattgtgcgggcagcaaagcgggcctgctacagggcagtaccaatggccgcagctgcctgattggtgtacaggcctttctatttttctcccccctcagttttcgctctcgggcagcaagaaacatgtagtattcataaggtgccggcaaattggccggaccccagactccaagcgagctagtttttgtagatctgctatggtgtgctttattccgttagtcgatatatgttgcattgtttctagtttcaaagcccatttatttacttctctatgatttctacacacggcctaataatcttgctaaggccctgattgaatggaaaatatttttttgggagttttaggaaaatactacatttttgtgaaataccttggttttggagtaacatgaagaggatgtttggttagaagaaccaatccattctaaatatggtggtgtatcacgac

SEQ ID NO: 3447 - DNA, 778 bp, Triticum aestivum
aggctatcactgcattctccagatggtcggatatgctcttcaggctgccgatatactggccaaggaaggtatcagtgctgaggtaatcaatcttcgctcgattagaccgctggatagagctgctattaatgcatctgtgaggaaaaccaatagattggtaaccgtagaagaaggtttccctcaacatgggattggtgctgaaatatgcatgtctgttgtagaggacagctttgagtatcttgatgcaccagttgagaggattgctggagctgatgtccccatgccgtacgctgccaaccttgagaggatggctgttccacaggtggatgacatcgtccgggcagccaagcgtgcttgctacagagctgcagtaccgatggcagcaacagcctaattcacacagaaccctgcctgttgcatttctttgtctaatgtccatactccagaaagacaaatgttccataatggtatgacgagtacccactgccgctgcaactcaactagcatgagctgattttgtagagccaccaagaggtgtccagtactccagtcccgttgtcttcgccgccgcagccggatggctgcgcattactctgcgtctgtttatggttcacgaatgattgcagcctctggagatgaagttttttacatgaggcgaggtggtgtgtcaataacatgtagtattcggaagtgggactctcaagaggtccccaaatagtggttctggttgcgccttttcttgataacgtcttttctatgctagtgctagaaaaaaaaa

SEQ ID NO: 3448 - DNA, 884 bp, Panicum virgatum
ggtgaatcatttcctgtttctgatgaggtactcgattctagcttctgccttccaattggcaaggctaagatagagagacaagggaaaagatgttacaatcattgcattctccaagatggttgggtatgcccttcaggctgcagatatactagccaaggagggtatcagtgccgaggtaatcaatcttcgttcaattagaccgctggatagagctgctattaatgcatctgtgaggaaaaccaacagattagtaacagtagaagaaggcttcccacaacacgggattggagctgaaatatgcatggctgttgtcgaggacagctttgagtatcttgatgcgccagttgagaggattgctggagctgatgtgcccgtgccttacgctgccaatctagagaggatggctgttccacaggttgaggacattgttcgagcggcgaagcgggcttgctacagagcagtaccaatggcggcaacagcctaattcacagacccaatcgtttctcaatcttccatttcgtagtctgtgtcgagaaagatgtgttgcataatggtatgagtgcccactaccgctccaactcaactagcgtgagctgattttgtagagcaaccaaagaggtgtgtccagttcagttctctccgacgccgcagcagccggatggctgcctgactctgcttcactttacggttctcaactcgggttcgcgagccatgcagggatatacatgagggggattgtgtcaataacatgtattttaaagggagctccaagaggtcctcgaatagaaattctggttgcgcgttgtttaaaatctctgtttccatgctggatatccaacggccctgccgctgccggcctctgaaactgaaaatcatgttcgagc

SEQ ID NO: 3449 - DNA, 956 bp, Leymus cinereus x Leymus triticoides
tcatcaattcagctgccaaatcaaactacatgtcatctggtcagatatccgttcctattgtttttcgaggaccaaatggggcagctgctggagttggtgctcaacactcgcagtgctatgcggcatggtatgcccatgttccaggattgaaggtcctaactccttattctgcagaagatgctcgaggcttgctaaaagcagcaatcagggatccagaccctgttgttttcctggaaaatgaactactctatggtgaatcgtttcctattaaggctgaagtacttgattctagcttcagtgtcccaatcggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccattggatagagctgctatcaatacatctgttaggaaaaccaaccgattggtaaccgttgaagaaggctttccacaacatggggttggtgctgaaatttgcatgtccgttgtggaggacagctttgagtatcttgatgcaccagttgagaggatcgccggagctgatgtgcctatgccctatgcggcaaacctcgaaagattggcagttccacaggtcgaggacatcgtccgtgcagcaaagcgagcttgctacagatcagcaccaatggcggcaaccgcttaaacacaaatgcacgttttgtttctcgcccttcttctttgttccttgtccagaaaagatgtatcgaatcgcataattgtatcccccaactcgtgtgagctaattttgtagatctgcatgaattgttgattccgagctgtcggcgccgagagctcggatgactgcattgagttcatggttcatccctagacatttgaatcatgcaacttctggaggtttacatca

SEQ ID NO: 3450 - DNA, 417 bp, Unknown
  Sequence found in Organisms: Setaria italica, Momordica charantia
ctgccttccaatcggcaaggctaagatagagagacaaggaaaagatgttacaatcactgcattctctaagatggtcggatatgctcttcaggctgcagatatactggccaaggagggtatcagtgctgaggtaatcaatcttcgttcaattagaccgctggatagagccactattaatgcatctgtgaggaaaaccaatagattggtaacagtagaagaaggcttcccacaacacgggattggcgctgaaatatgcatgtctgttgtggaggacagctttgagtatcttgatgcgccagttgagaggattgctggagctgatgtgcccatgtcctacgctgccaacctagagaggatggctgttccacaggtcgatgacattgtccgagcagcgaagagggcttgctacagggtggt

SEQ ID NO: 3451 - DNA, 1057 bp, Persea americana
cgttgggaaactacatgtctgctggtcagatatctgtgccaatcgttttcagagggcctaatggtgctgctgctggagttggtgcacagcattcccagtgttatgcagcttggtatgcttcctgcccgggtttgaaggttctgaccccatactcttcagaagatgctagaggattgctaaaagctgctattagagaccctgatcctgtagttttccttgaaaatgagttgctatatggtgagtctttccctgtttcagcagaagctcttgattcaagtttctgccttccaataggaaaggctaagattgaacgagaaggaaagcatgttactattacagctttctcgaagatggttggttatgctctccaggctgcagagatacttgccaaggaaggtatcagtgccgaggttataaatcttcgttcaattaggcctcttgacagagatactatcaatgcttctgtcaggaaaaccaacagattagtgacacttgaagaaggatttccgcaacatggtgttggtgctgaaatctgtacgtctgttattgaggagagctttgagtatctcgatgcaccagttgagaggattgctggagcagatgtacccatgccttacgcagcaaatcttgagaggatggctgtaccccaggttgatgacattgttcgggcagcaaaacgggcgtgctacagagctgttcctgttgctgcagttgcttaggtcaaagtggttcatctctgaaggtctactgtttttctacgtgttcactgtcgccattttgccttgtccgtatgttttttgagttccaatggtagaaaaagaaattctcagctgccaagtgctgatttcctgattcatttaaagcaaccccttggtttcagatcttcagaaatgtcacgtccttgaaaagaagggatctatattttttccatcagttggaagattgctcatcagttatcaataatatcattttggacattgtgattcagttgggagccgagtcacaaatttcacagatactaatattacaatagttctgagatttctataaaatggct

SEQ ID NO: 3452 - DNA, 805 bp, Pseudoroegneria spicata
gtttttcgaggaccaaatggggcagctgctggagttggtgctcaacactctcagtgctatgcagcatggtatgcccatgttccaggattgaaggtcctaactccttattctgcagaagatgctcgaggcttgctaaaagcagcaatcagggatccagaccctgttgttttcctggaaaatgaactactctatggtgaatcgtttcctatcaaggctgaagtacttgattctagcttcagtgtcccaattggcaaagctaagatagaacgggaaggaaaagatgttacaattactgcattctctaagatggttgggtatgctcttcaggctgcagagatactgtccaaggagggaataagtgctgaggtgatcaaccttcggtcaattagaccattggatagagctgctatcaatgcatctgttaggaaaaccaacagattggtaactgttgaagaagggtttccacaacatggggttggtgctgaaatatgcatgtcagttgtggaggacagctttgagtatcttgatgcaccagttgagaggattgccggagctgatgtgcctatgccctatgcggcaaacctcgaaagattggcagttccacaggttgaggacatcgtccgtgcagcaaagcgagcttgctacagatcatcatcaatggcggcaactgcctaaacacaaatgcacgttttgtttctcggccttctttgttccttgtccagaaaggtgtatcggattgcataattgtatcccccaactcgtgtgagctaattttgtagatctgcatacattgttgattccaaaa

SEQ ID NO: 3453 - DNA, 1184 bp, Triticum aestivum
ggcattggcgttggtgctgcctaccaaggtcttagacctgtagtagagttcatgacatttaacttctcgatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgcccatgttccaggattgaaggtcctaactccttattctgcagaagatgctcgtggcttgctaaaagcagcaatcagggatccagaccctgtagttttcctggaaaatgaactactctatggtgaatcgtttcctattaaggctgaagtacttgattctagcttcagtgtcccaatcggcaaagctaagatagaacgggaaggaaaagatgttacaattactgcattctctaagatggttgggtatgctcttcaggcggcagagatactgtccaaggagggaatcagtgctgaggtgatcaaccttcggtcaattagaccattggatagagctgctatcaatgcatccgttaggaaaaccaacagattggtaaccgtcgaagaaggctttccacaacatggtgttggtgctgaaatatgcatgtccgtagtggaggacagctttgagtatcttgatgcaccagttgagaggattgccggagctgatgtacctatgccctatgcggcaaaccttgaaagattggcagttccacaggttgaggacatcgtccgtgctgcaaagcgagcttgctacagatcatcatgaatggcggcaaccgcctaagcacaaatgcacgttttgtttatcggccttcttctttgttccttgtccagaaaagatgtactgaatcgcataattgtatcccccaactcttgtgagctaattttgtagatctgcatgcattgttgattccaatctgtcggcggcagtcggatgactgcattcagttcatggttcatcctgaggcgtttgaatcgtgcaacttctggaggtttacatcactgagggatgtctcaataacatgtatgtaactgaattacagacgttcacatgattttgctgtggcttaggccgatctgtaagtgtgatcaaaatcgcggagaaaactggaacattgaaatgcttccctaagcgtttgtttgtta

SEQ ID NO: 3454 - DNA, 722 bp, Cenchrus ciliaris
  misc_feature (122)..(122): n is a, c, g, or t
  misc_feature (137)..(137): n is a, c, g, or t
  misc_feature (164)..(164): n is a, c, g, or t
  misc_feature (450)..(450): n is a, c, g, or t
  misc_feature (706)..(706): n is a, c, g, or t
gttaccattactacatactccaagatggttggctatgctctccaggctgcagagatactgtccaaggaaggaatcagtgctgaggtaatcaaccttcgatccatccgaccacttgacagagntgctatcaatgcatntgttaggaagaccaaccgattggtgantgttgaagaagggttcccccagcatgggattggtgctgagatatgcatgtctgttgtagaagaaagctttgagtaccttgatgcgccagttgagaggatcgccggagctgatgtaccaatgccctatgctgccaaccttgagagaatggctgttccacaggtagatgacattgtccgggcagcgaagcgggcctgctacagggcagtgccaatggcagcaactgcctgatcagtggacaagcctttttgttttggttttctttcgccctctagaagaagcatgtantattcataaggtgctggcaaattgcccagactccaagcgagctaattttgtagatctgccatggcgtgttctattccgttggtcgcagatggatgattgcattcttttttggtttgatgccccattgcttttctatgatttatacacggcctggcatgcaaacaggtcactttgttgtgacccatcagttccgtcgcatcgcatcttttgctccttggaccacaaggtcagtggatggcaataaactacccgccancgattgtgcatgccta

SEQ ID NO: 3455 - DNA, 497 bp, Olea europaea
gatgtgacaatcactgctttctcaaaaatggttggctatgctcttcaggctgccgacattcttgcaaaggaaggaattagtgctgaggtgataaatcttcgctcgattcgcccacttgacagagccacaataaatgcttctgtcaggaaaacaaataggcttgtgactgttgaagaaggattccctcaacatggtgttggtgcagagatctgcgcatctgttcttgaagatagctttgagtaccttgatgctcccgttgagaggattgccggagcagatgttcccatgccctatgctgcaaatcttgagagaattgctgtcccacaggtcgaggacattgttcgagcagcaaagaggtcttgctacagatcaagttcattggccgcaactgcttaaaatttacaagggacacaaggtttttgttgtcggttctagatttttctttacacagctgggtgggttgttgcctttgccttctgtggttaagaagtccacta

SEQ ID NO: 3456 - DNA, 1066 bp, Cryptomeria japonica
  misc_feature (614)..(614): n is a, c, g, or t
  misc_feature (623)..(623): n is a, c, g, or t
  misc_feature (631)..(631): n is a, c, g, or t
  misc_feature (639)..(639): n is a, c, g, or t
  misc_feature (649)..(649): n is a, c, g, or t
  misc_feature (654)..(654): n is a, c, g, or t
  misc_feature (662)..(662): n is a, c, g, or t
  misc_feature (669)..(669): n is a, c, g, or t
aaggatgtgacaatcacagctttttcaaaaatggtgggctatgctttgcaggcggcacaagaacttgcaaaagaaggaatcagtgctgaggttataaatcttcgttcaattcgacctttggatagagctacaatcaatgcttctgttaggaagacaaatcggctggtgactgttgaagaaggttatccacaacatggcattggtgcagaaatttgtacttctgtggtcgaggaaagctttgaatatctggatgcacctgtggaaagaattgcaggggctgatgttcccatgccttatgctgcaaatttggagcgcttggcagttccacaggtagaagacatcattcgtgctgcaaaaagggcttgctacagagaagttccaatgagtgcaactgcctagtgtaaatttgatttgatttttttctttaaaataaaaggaaatttgctatatgtttaatgaggcccaaggatgtgttcagaatgatcctagtatatagggtatggtcattttgaactttcttttggtcaggattatttttatccttgctggcctcgcaatttttaatgctggaaaggtttttttttccgctctcagagtatgtagctctcattgtnatttactgntcagttgntagggaantgatcctcgnttgtnttgaaatnaatttcnataaactgctatcatctgctgcccatcaattttaaccaaaactttggtgtcattttgtctggagccaatatgagccataacatcaaatgctgtaacaccagtttttatttttgaataataatgatttgttaaatgccatgaaacatctcattgtggatggatttgacccaaataattgcacgcacttttaaagccctaaaaccgatttagttgctgactgtaaccagatcggtaaaactgtgttggtactgtccattcaaatacaaccaaaataattatactatatttttgagcactttgttggccatcccaaaatatttagttgttttgcattatgttgcagtacattcatcctgagacactgactcgggtcttcattcattgaagccatgttaaa

SEQ ID NO: 3457 - DNA, 589 bp, Amborella trichopoda
ttccttgaaaatgagctactgtatggtgaatcgtttcctgtatctgcagaagctctggattccagttttacccttccaattgggaaggcgaagatagaacgtgaaggaaagcatgttactattacagctttttcaaagatggttggctatgcactgaaggccgctgatatactttccaaggaaggaattagtgctgaggtcataaatctccggtcaataaggccattagatagaaatactatcaatgcttctgtcaggaaaaccaatagattagttactgtggaggaaggattcccacaacatggagttggagctgaaatttgcacctcagtcattgaggaaagcttcgagtacctcgatgcccctgtggagagaattgcaggggctgatgttcccatgccttatgcagcaaatctagagaggatggctgttcctcagattgaggatattgtccgtgcagcaaagcgggcatgctacagatctgttcccatggctgcagctgcttaaactcgaaacgttggccattctttgattgcttgttgctttttggggaatcaaatttgatcaggcgccatctttgaattatgca

SEQ ID NO: 3458 - DNA, 1421 bp, Eucalyptus grandis
  misc_feature (711)..(711): n is a, c, g, or t
cgcccgtcgtctctgactcgatccgcctcggcccctccctctctcgcgctcgccctccgccggtcgccgctcctccgtctctcgccgccgcggctcgcctctccctctccagtggtacctaccgttcgggacagaagatgttgggggttgtgaggcaaaaagttagcgctggcggctcgcctctcacgattcttgggcagacattgcccttcctccgtgcggcagcggcaccattaaggagttactcatctgcatttaaagagatgacagtgcgagacgctctcaattcggcgcttgatgaagaaatgtcagctgatccacgggtattcttaatgggtgaagaggttggggagtatcaaggtgcatacaagatatcaaagggtctacttgataaatatggccccgacagggttctcgataccccgatcacagaggctggtttcactggaattggagttggcgctgcttaccatggtctcaaacctgttatagagtttatgaccttcaacttctccatgcaggcaattgaccacatcattaattcagctgcaaaatcgaattatatgtcttctggccaactgtcagtacctattgtttttagaggtccaaatggagctgctgcaggagttggcgctcaacactctcactgttatgcctcgtggtatgcctcttgcccgggcttgaaagtattgactccatactcttctgaanatgcccgtgggctgttgaaagctgccataagggaccctgatcctgtagttttcctcgagaatgagttattgtgagtagttttttgctattggatttgtatgcatttctctttctgatttaggggtaactctgaagtaatattttggattcagatatggtgagtcattccctgtttcagctgaagtgctagattccagcttttcccttcccattggaaaagccaagattgagaaggaagggaaggatgtgacgataacggctttttcaaagatggtgggccttgccctcaaggcagctgatattcttgcaaaggaaggaattaatgctgaggtcattaatttgaggtctattcgacctcttgatagagccactatcaatgcttcagtccggaaaaccaatcggcttgtgaccgttgaggaagggttccctcagcatggcgtcggtgctgagatctgcacatcagttattgaggagagcttcggttatctcgatgcaccagtcgagagaatctctggtgctgatgttcccatgccttatgcagccaacttggagaggatggctgtccctcaggttgaagatattgttcgtgcggcgaagcgagcttgctacagatccgtgccaatggctgcagcagcttgaaacgacgggagaaaaaccaataaagattttttttcgagccgaatgttggcctttcctgaattagttagccg

SEQ ID NO: 3459 - DNA, 1137 bp, Pseudoroegneria spicata
  misc_feature (9)..(11): n is a, c, g, or t
ttgataccnnnatcactgaggctggttttacaggcattggtgttggtgcagcctatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaatggagctgctgctggagttggtgctcaacactcacagtgttatgcagcttggtttgcgcatgttccaggacttaaggttctggctccatattctgcagaagatgccagaggcttgctaaaagctgcaattagggatcctgatcccgttgtttttctggaaaatgaattactctatggagagtcattcccagtttctgatgaagtgcttgattctagtttcgctctgccgataggcaaagctaagatagaacgcgagggtaaagatgttacgattactgcattctccaagatggtcggctatgctcttcaggctgctgatatactgtccaaggaaggaatcagtgctgaggtgatcaaccttcgatcaattaggccactggatagagccgccataaatgcatctgttaggaaaacaaatagattggtgactcttgaagaaggcttcccccagcatggtgttggtgctgagatatgcatgtctgttgtagaagaaagcttcgagtatcttgatgctccaattgagaggattgctggagctgatgtacccatgccctatgctgccaaccttgagagattggctgttccacagattgaggatatcgtccgtgcggccaggcgagcctgctacagagcgttgcccatggcggcaactgcgtgatcgaaatttcactttactttgcccatgctttttcccgtcgccccgccggccagaaacgtgtgttccataatggtatccacaattgcccaaactcaaagcgagttaaatttctgtaggtgtgcctttgccatcttattcttttagctgcagtcggatctcaccgcactcgctggtgcctccctccactgtcttgtgaattattacgcatgcagctttcgttgattgattagcacggcctaatcacggtggttacataaatggaaaactgaggtgttctcttgca

SEQ ID NO: 3460 - DNA, 769 bp, Triticum aestivum
gttttcctggaaaatgaattactctatggtgaatcgtttcctattaaggctgaagtacttgattctagcttcagtgtcccaattggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccgttggatagagctgctatcaatgcatctgtcaggaaaaccagcagattggtaaccgttgaagaaggctttccacaacatggtgttggtgctgaaatatgcatgtccgtagtggaggacagctttgagtatcttgacgcaccagttgagaggattgccggagctgatgtacctatgccctatgcggcaaaccttgaaagattggcagttccacaggttgaggacatcgtccgtgcagcaaagcgagcttgctacagatcatcatccatggcggcaaacgcctaataagcacaaatgcaagttttgtttcttggccttcttctttgttccttgtccagaaaaaatgtaccgaatcgcataattgtatcccccaactcgtgtgagctaattttgtagatctgcatgcattgttgattccgatctgtcggcggcagttggatgactgcattgagttcatggttcatcccgagacatttgaatcatgcaacttctggaggtttacatcactgagggatgtataaataacatgtatgtaactgaatta

SEQ ID NO: 3461 - DNA, 1551 bp, Leymus cinereus x Leymus triticoides
  misc_feature (7)..(11): n is a, c, g, or t
  misc_feature (84)..(84): n is a, c, g, or t
  misc_feature (90)..(90): n is a, c, g, or t
  misc_feature (199)..(199): n is a, c, g, or t
  misc_feature (235)..(235): n is a, c, g, or t
  misc_feature (283)..(283): n is a, c, g, or t
  misc_feature (295)..(295): n is a, c, g, or t
  misc_feature (379)..(379): n is a, c, g, or t
  misc_feature (472)..(472): n is a, c, g, or t
  misc_feature (508)..(508): n is a, c, g, or t
  misc_feature (517)..(517): n is a, c, g, or t
  misc_feature (538)..(538): n is a, c, g, or t
  misc_feature (941)..(941): n is a, c, g, or t
  misc_feature (1088)..(1088): n is a, c, g, or t
  misc_feature (1142)..(1142): n is a, c, g, or t
  misc_feature (1235)..(1235): n is a, c, g, or t
  misc_feature (1247)..(1247): n is a, c, g, or t
  misc_feature (1265)..(1265): n is a, c, g, or t
  misc_feature (1274)..(1274): n is a, c, g, or t
  misc_feature (1280)..(1280): n is a, c, g, or t
  misc_feature (1295)..(1295): n is a, c, g, or t
  misc_feature (1303)..(1303): n is a, c, g, or t
  misc_feature (1322)..(1323): n is a, c, g, or t
  misc_feature (1334)..(1334): n is a, c, g, or t
  misc_feature (1394)..(1394): n is a, c, g, or t
  misc_feature (1423)..(1423): n is a, c, g, or t
  misc_feature (1438)..(1438): n is a, c, g, or t
  misc_feature (1443)..(1443): n is a, c, g, or t
  misc_feature (1450)..(1450): n is a, c, g, or t
  misc_feature (1454)..(1454): n is a, c, g, or t
  misc_feature (1466)..(1466): n is a, c, g, or t
attcccnnnnnccgaggcggcgtcggcgtctgcgtctgcgtctgcctctgcgtctccttcccccaacccgtccctctcgctgcntccagnccggcgacacatccaccgccgcgccaccgtcgaattcgcccccccgcccgccgctccgatcgcggggaggaagatgctgggcgccgcgaggaggcagctcggatccggncccatgctggggcaggtgctgcggaggctccgcccngcggcggcggcgtccacggaggcggcaagggggtactcctccgcggcnaaggagatcacngtacgtgacgcgttgaactctgccctagatgaagaaatgtctgctgatccttctgtctttttgatgggtgaagaggttggagantatcaaggtgcatacaagattacaaagggcttgcttgacaagtatggtcctgatagggttcttgataccccaatcactgaggctggttttacnggcattggtgttggtgcagcctatcaaggtcttcgnccagtcatngagttcatgacatttaatttntcaatgcagaggaccaaatggagctgctgctggagttggtgctcaacactcacagtgttatgcagcttggtttgcgcatgttccaggacttaaggttctggctccatattctgcagaagatgccagaggcttgctaaaagctgcaattagggatcctgatcccgttgtttttctggaaaatgaattactgtatgcaacatctgaacttgttgaggtatttatacttcactagtggctagctatcatttcattgagatgttatgttgttttctacagctatggagagtcattccctgtttctgatgaagtgcttgattctagtttcgctctgccgataggcaaagctaagatagaacgcgagggtaaagatgttacgattactgcattctccaagatggtcggntatgctcttcaggctgctgagatactgtccaaggaaggaatcagtgctgaggtgatcaaccttcgatcaattaggccactggatagagccgccataaatgcatctgttaggaaaacaaatagattggtgactcttgaagaaggcttnccccagcatggtgttggtgctgagatatgcatgtctgttgtagaagaaagcttngagtatcttgatgctccaattgagaggattgctggagctgatgtacccatgccctatgctgccaaccttgagagattggctgttccacagatngaggatatcgtncgagcggccaggcgagcntgctacagngcgttncccatggcggcaacngcgtgatngaaatttcactttactttnnccatgcttttnccgtcgcccgcccggccagaaacgtgtgttcataatggtatccacaattgcccaaactcnaagcgagttaaatttttgtaggtgtgccntggcatcttattctnttagntgcagtngganctcaccgcattngctggtgcttgcctccactgtcttgttgtgaattattacgcatgcagctttcgttgattgattagcacggcctaatcacggtggt

SEQ ID NO: 3462 - DNA, 630 bp, Rhizophora mangle
tctgaagatgctcgtggactgttaaaagctgccataagggaccctgatcctgttgttttccttgaaaatgagttattatatggtgaatcatttcctgtctcagcggaagcacttgattccagcttttgcctgccaatcggaaaagctaagattgagagagaaggaaaggatgtgaccattgtagccttttcaaaaatggtgggctatgttcttaaggcagctgagatacttgcaaaggaaggtatcagtgctgaggtgataaatttgcggtccattaggccacttgatagacccacaatcaacacttctgttaggaaaactaacagattggtgactgtcgaagaagcatttcctcagcatggtgttggcgctgaaatatgtgcatctgttgttgaggaaagctttgagtatctcgatgcaccagtggagagaattgctggagctgatgttcccatgccttatgcacccaacattgaaagaatggctgtcccacaggttgaagatattgtcggtgcagcaaagagagcttgctacagatctgtgccaatggctgccactgcctaattattgagtttccatcaaacaaaaaccaacgggactttgaaattaggaaattcaaagagtagtaca

SEQ ID NO: 3463 - DNA, 792 bp, Humulus lupulus
ggtgggctatgttctccaggctgctgagatacttgccaaggaaggaatcagtgctgaggtaatcaatttgcggtcaattcggccactggatagagccacgattaatgcttcagtcaggaaaaccaacagacttgtaacagttgaagaaggattccctcagcacggcgtcggtgctgaaatatgcacatctgttattgaggagagctttggctatcttgatgcaccagtggaaagaattgctggtgctgatgttccgatgccttacgcagctaacttggagagattggctgttcctcagattgacgatattgtacgtgcagcgaagagagcatgctaccgagctgtgcctttggctgcaactgcttaatttttttttgtccaattccatccacaaacatctccaggccctggagataatgggactgtatattattttctcttcgcatctcttagggtaggggaggaaatgcttgtcaaataacttggagaatatcttgaccggagcgataaattttgtggctctgttttgtctttttcgttttgggcagttcaacatgaaaaaactactctccacaggcagccatttttttttctttcacaaagttatttactttcttctaatcttcgcttcactcccaacatttggttttgggtaaagctgttttctgtgactggcttccaatgatttttctattccatgttatattattcggtgactcaattgtgagacattccttgattgatgtactctgtatgtgaatggccaacccaagagttatgaccaaaagtcat

SEQ ID NO: 3464 - DNA, 772 bp, Cenchrus ciliaris
caaggagggtatcagtgctgaggtaatcaatcttcggtcgattagaccactggatagagccactattaatgcatctgtgaggaaaaccaatagattgctaacagtagaagaaggcttcccacaacacgggattggcgctgaaatatgcatgtctgttgtggaggacagcttcgagtatcttgatgcgccagttgagaggattgctggagctgatgtgcccatgccctacgctgccaacctagagaggatggctgttccacaggtcgatgacattgtccgagcagcgaagcgggcttgctacagagtggtgccaatggcggcaacggcctgatccaccgccatttctcaatcttccattccgctgtctctgtccagaaagatgtgtggcataatggtatgagtagagtactcactaccgctccaactcaagtatagcgcgagctgattttgtagagcaaccatgaggtgtccgttcactctgcccgcggcatccggatggcggggtcctactccgcgtcattctattacggttcaactcagggtttcacgaatcatgcaggatttgacatgagggggaggtggtgtcatcaataacatgtattttgatgaaaggagctccaagaggtcctcggatagaaattctggctgcgcgcttcttccttttttttctctttaaatctccgtttccatactgtagaaactctatatggtcctgccttgccacactgtgtgaaatgtcatccgagagtggaaggcgaatgaagggggtata

SEQ ID NO: 3465 - DNA, 1280 bp, Cucurbita pepo
tgcagctgctggagttggtgccccagcactcgtcagtgttatgcagcatggtatggctcctgtcctggcttgaaagttttggccccatattcatctgaagatgctacgtgggccttttaaaggctgccataagggatcccaggatcctgttggtgtttctgaaaatgagttattatatggtgaatcattccctgtttctgctgaggtcctcgattccagtttcaccgctcccataggaaaagctaagattgagagagaagggaaggatgtgactattactgccttttcgaagatggtgggctatgcacttaaggcagctgaagaactttccaaagaaggaattagtgctgaggttataaacctgcgctctattcgaccgctagacagagccacaattaatgcttcagttaggaagaccaacagattagtaacagttgaagaagggttccctcagcacggcgttggtgctgagatttgtgcatctgttgtggaggacagttttggctatcttgatgcgccagtggagaggatttcaggggctgacattcctatgccttatgcagccaatctcgaaaggatggctgtccctcagattgaggacattgttcgagcagcaaaaagagcatgctacagagccgtacctttggccgcaactggttgattttgcccttccaatctggaaagttattccatcttagggtaagattcaatgacttctttgtccttttctgttcctgttccctgaatcaaggagaaatttcacttttcccttgtacaataaaacctctcgatgacttttattgtcaagacaattacaaccattttttaacgggcaagtccaatcaaagtacgatatatttttgtgaaaagaaacatcgtttcttgccaaaatcatcacagctataggatgaaaattggtggtccgtgcaaggatttggcttttagtgaatatatttgacacttgtaaaatcatatctggcttagcagatgcagggtgtcacggtcaatctactgtattcatagtatggcaactgttacattgtttctgtgatgatgtttggtctggggacgtagccaagttgttaaataacttgggagaatattgtcaaggacgggaattcgttttttcaactctattttcatagtcagatgcttcttctgctttgtcccaaccaaaccttttagtttgtcttgtaagtttgtaatcttcccttggtcttagctttcctttaatgtgaaaccaaaggacctactggcatagaatatatacgtatattcta

SEQ ID NO: 3466 - DNA, 1032 bp, Primula obconica
agtgttatgcagcatggtacggttcagttccaggcttgaaggtgcttgctccatactcagcagaagatgctcggggtctcttaaaagcggctattagagaccctgacccagttgttttccttgaaaatgagttgctttacggagagtccttccctgtttctcaagaagttcttgattctagtttctgtcttcctataggaaaggctaagatagaaagagaaggaaaggatgttaccattgttgcttactcgaagatggttggttacgctctcaaggctgccgaaatccttgccaaagaaggtataaatgccgaggttataaatttgcgctcaatacgcccgcttgatagatcaacaatcaacgcctcggtcaggaagaccaatagacttgtaactttagaagaagctttccctcaacatggtgttggggcagagatttgtgcgtctgttgtcgaggagagttttgagtatcttgatgctcctgttgaaaggatatctggcgcagacgtacccatgccttatgctgctaatcttgagaggatggctgttccacagatagaagatgttgtacgtgctgcgaagagagcctgctacagggccgttcccatggctgcaactgcttaacactatctgaaaacatcttgtcatgttcttcccatcgatttgattttgtccacatttattggtaatccactttttgtgttactgcctttttgttttcgttctcctttctttatgtcccctttgcagaagttgctgtaactcgaaaagggacttgatttgaatgtctattctggttgagaaacatctcaaataacccttttgagtgtggaatataagggtttttgagtttctttttgttcattttgagtgggatgattttgttagctgtagattaataaaatgtgaagttgaagaatacaagacatacctacagttttcttaatgcctgcattaacttgcaaatcatctttgagttcacttggatgtataatatcgtgcaatttgtaaatggaaaatgcttttcatcacc

SEQ ID NO: 3467 - DNA, 996 bp, Ocimum basilicum
tgagttggggcagcatattatggactcaaacctattgtagagttcatgacgtttaattttgcaatgcaggcaatggatcaccttataaattctgctgcaaaaacaaattacatgtctgctggtaacataagtgtgcctattgtttttagaggaccgaatggtgcagctgctggtgtaggtgctcagcactctcagtgttacgcagcctggtatggtgcaatcccaggcttaaaagttttgtctccatactcatcggaggatgctcgtggacttcttaaagctgctatcagggaccctgaccctgttattttcctggagaatgaaatgctgtatggtgaatcattccccatttctgaagaagttcttgattcaggctttaccatccctattgggaaggccaagattgaaaaagaaggaaaagatgtttccattgtagctttctcaaagatggtgggcttttctctgaaggctagtgatatacttgcaaaggaggggatagaagctgaggtgataaatctacgttcgatcaggccactggatagagcgacaatcaacaagtcagtgagaaagactaacaggctagtaacagttgaggaagggtttcctcaacatggtgtcggtgctgagatttgcacatcgattatcgaggatagcttcgagtatcttgatgctccagtggagagaatagccggagcagatgtcccaatgccttatgcagctaacctcgaacgaatggcacttccacaggtcgaagatatcgttcgagcagcgaagagagcgtgttacagatcacagtcaatgcaagcagtcgcttaaaaacatcaatttcaactcctatcggccacacacaagtagcagctgtgtgtataggaataagttgtatggtatcaaatcatgtgtggagttgaaatgtgtttggtgagaggaatttttgtataataactccaaactcacctacagtgtaagggagcattataataaacaaattgcgggcgt

SEQ ID NO: 3468 - DNA, 622 bp, Ocimum basilicum
tttctgtgttccctattgggaaagctaagatagaacgtgaaggaaaggatgtaactatcactgctttctcaaagatggtcggctatgctcttaaggctgctgagattcttgcaaaagatggaatcagtgctgaggtgataaatcttcgctcaattcgacctcttgatagagccacaataaatgcttctgttaggaaaacaaataggctggtgactttggaagaaggattccctcaacatggggttggtgctgagatctgtgcatctgttgttgaagatagtttcgagtatcttgatgcagctgttgagaggattgcaggggctgatgttcctatgccgtacgcagcaaatcttgagagagcggcggtcccacaggttgaagacattgtccgggcagcaaagaggacttgctacagagcaactgctttagctgccactgcttaaagtcaacacggcttccgccgttgcatattctcctgcaaaacttacattctttaaataaatctacctgtcaacattgggtgcttaacctgccattttgttataattttttgagcgtgtcaactgtaaaacaatcaaaactgtgtcataatgcaaaaccatagagaaagttctcctcgtgc

SEQ ID NO: 3469 - DNA, 872 bp, Lotus japonicus
gggagtctttcccagtttcggccgaagttcttgattccagtttttgccttcccataggaaaagcaaagattgagagagaaggaaaagatgttactattacagccttttcaaaaatggttggttatgctctcaaggctgctgagatactagccaaggaaggaatcagtgccgaggttatcaatttgcgttcgatccggccgcttgatcgatccacaatcaatacttctgtcaggaaaaccaacagactggtgacagttgaggaggggtttcctcagcatggtgttggtgctgaaatctgcacatctgtcattgaagagagttttggttatcttgatgcaccggttgagagaattgctggggctgatgttcccatgccttatgcagcaaatctggagaggatggctgttccacaggttgaagatattgttcgtgctgcaaaaagagcatgctacagatctgtgcctttggctgcagctgcttgaagatcaatctaggccttaatgttaatatcaggaacaagagatgctatacatttttgttcccattctcagcatatgggggaggttcatgtttaataatttggataacaataacacaagacgggaagttgtgttcttttggaccaataacacagtattcattgaatacactatcgagttcctttttctctccagcagaccacatattgcaacgactgacttgctgttttgagtgcacaaaaaatattgttagtacttgcttggtttcattggcaaagtaattataattattgggtaaattacactccattacgcttttcttatatgacactaaatttcaaatttactcaaatattaccctccacctcattcactacttattacatgcgattt

SEQ ID NO: 3470 - DNA, 1292 bp, Arachis hypogaea
tctggacaagtatggccctgagagggttcttgatactccaattactgaggctggctttgctgggattggagtcggtgctgcttactatggtctaaggcctgttgtggagtttatgacttttaacttctccatgcaggcaatagatcacatcattaattctgctgcaaaatcaaactacatgtctgctgggcaaatatctgtacctatcgtcttcagaggacccaatggagctgctgctggtgttggtgctcagcactctcaatgttatgcagcttggtatgcctcgtgccctgggttgaaggtattggcaccatattcatctgaagatgctcgtggcttacttaaagccgctataagggaccctgatcctgttgtttttcttgaaaatgagttgttatatggtgagtcattccctgtttcagccgaagttcttgattccagtttttgtcttcccattggaaaagcaaagattgagagagaaggaaaagatgttactattacagcctattcaaaaatggttggctatgctcttaaggctgcagagatactggcgaaggaaggagtcagtgctgaggttataaatttgcgttcaattcggccacttgatagaaccacaattaatgcttcagtcaggaaaaccaacagattggtgacagttgaagaaggttttcctcagcatggtgttggcgctgaaatttgcacatctgtagttgaggagagttttggttatctcgatgcaccggttgagagaattgccggggctgatgttcctatgccttatgctgccaatttagagagaatggctgtcccacaggttgaagatattgttcgcgctgcaaagagagcatgtcacagatctgtgcccttggctgcaacagcttgagtttataaagtaccagattattttattttgatctcccggttatggttaattcttcggtaatcctagatattaccaaaaacattttttgctccatttttcaccataaaacagcagaaagaaattgcaaccagagaatgctggtttcagtatgcgtagtactgcagcctaaattttcgggagttacagatgctatatattttctgtaaatttcgtttataacaatgacacaaggcggaaagttttctgtgtcattttgtaattggcaataacagaagaaatcaactgctcgaattaattttcctgagttcattctatattttctgtaaaatttggggaatggcaaattggcaatggcatgctaacagaaccactgcaattggttgtttccctgcttcctttacgatcgaag

SEQ ID NO: 3471 - DNA, 674 bp, Secale cereale
aggtttcgctctgccgataggcaaagctaagatagaacgcgagggtaaagatgttacgattactgcattctccaagatggtcggctatgctcttcaggctgctgagatactgtccaaggaaggaatcagtgctgaggtgatcaaccttcgatcaattaggccactggatagagccgccataaatgcatctgttaggaaaacaaatagattggtgactcttgaagaaggcttcccccagcatggtgttggtgctgagatatgcatgtctgttgtagaagaaagcttcgagtatcttgatgctccaattgagaggattgctggagctgatgtacccatgccctatgctgccaaccttgagagattggctgttccacagattgaggatatcgtccgagcggccaggcgagcctgctacagagcgttgcccatggcggcaaatgcgtgatcgaaatttcactttactctgcccatgctttttcccgtcgcccgcccggccagaaacgtgtgtgttccataatggtatccacaattgcccaaactcaaagcgagttaaatttttgtagcgtgcctttgccatgttattcttttagctgcagtcggatctcacctcgctggtgcctccctccactgtcttgtgaattattacgcatgcagctttcgttgattgattatta

SEQ ID NO: 3472 - DNA, 492 bp, Tamarix hispida
ggggttgctgtatggtgaatcttttcccatttcacctgaagttcttgatcctaatttttctcttccgattgggaaagctaagatagaacgccaagggaaagacttgacaattactgctttttcgaagatggttggttatgcacttcaggcagcagacatcttagcaaaagaaggaattagtgctgaggtcattaatcttcgttcaattcgtcctcttgatagacctacaattaatgaatccgtgaggaaaaccaacaggctagtaactgtggaagaagggttcccccagcatggtgtaggcgctgaaatatgtacatcagtgattgaagatagctttggatatctagatgcacctgttgaaagaattgcaggtgctgatatcccaatgccgtatgcagcaaattttgagaggatggctgttccacaggtagaagatattgttcgtgcagctaaaagagcttgctatagatcagtccctgtggctgcagctgc

SEQ ID NO: 3473 - DNA, 587 bp, Curcuma longa
aggctgctgatgtactttcagcggaaggaatcagtgccgaggttataaatctgcgttcaattaggccactagacagagccaccatcaatgcttctgtcaggaaaacgaacagactcgttactgtcgaagaaggtttccctcaacatggtgtaggagctgaaatatgcatgtcagtggtggaagaaagcttcgagtatcttgatgcaccagttgaaaggattgccggagcagatgtcccgatgccttattttgccaatcttgagagaatggctgttcctcaggtagatgacattgtccgtgctgcgaagcgggcatgctattgagcagtgcctctagctgctgcagcctagtcaggcacttcataccaacattgttttcgcggttattggagagattactatttccgcaaagactgattttagcctgaaattcgtgttacaggcttattttttggcatttatttatgggactgcagatgctgctggtcataaatcttggaaaactcatctatactgtagattgttgagaatcttcaataatgtataatgccagaatcctcaaaaagtgtttagtaatttggcttacaa

SEQ ID NO: 3474 - DNA, 766 bp, Carica papaya
aggcagctgaaatacttgcaaaagaaggaatcagtgctgaggttataaatttgcgctcaataaggccacttgatagggccactatcaatgcctcggtcaggaaaactaacagactggtaacagttgaagagggctttccgcagcatggtgttggtgctgaaatctgtgcatctgttgttgaggatagctttgggtatctcgatgcgcctgttgagaggattgctggagctgatgttccaatgccatatgcagccaatcttgagagaatggctgtccctcagattgaagatattgtccgagcggcaaagagagcatgttacagatctatgccaatggctgcagctgcataattgtactgatcatccaggtgtcatagactcactgtacaattcttttcccctttcaacatgtttgggcaatttgcaagaggagccactgactaaataattgagatatggcaatggcggaatcttttttgtggctgcatttcgttacgtgaatttggcgatcaagcaagcaattgcctgctcaactgaaaagtttttttggatctattatatatttataataatgtgctattgcctcaagaatttttcttctaaaaggcatgacatgaataatgtaccatggataaggcaggaatgggtgtgctgcagtcgctactctttctgtttaagtcagtcatccacacgtttaaatgaaatttggatcaaacacatttttatgtcgaaagatttcttcccgcaagataatcattgattgtgtt

SEQ ID NO: 3475 - DNA, 1146 bp, Castanea mollissima
ctgcaaaatcaaactatatgtctgctggccagatatctgttcctatagttttcagagggcctaatggtgctgctgctggtgttggtgcccagcactctcattgttatgcatcgtggtatgcctcctgccctgggttgaaagtgttaactccatactcatctgaagatgctcgtggactgctaaaagctgccataagagatcctgatcctgttgtttttcttgaaaatgagttgttatatggtgagtcattccccgtttcagctgaagttcttgattccagtttttgcttaccaatagggaaagctaagattgagagagaaggaaaggatgtgactattaccgctttttcaaaaatggtgggctatgctctcaaggcagctgagattcttgcaaaggaaggaatcagtgctgaggttataaacttgcgcacaatccggccattagatagatccacaattaatgcttctgtcaggaaaaccaacagactcataacagtcgaagaaggttttccccagcatggtgttggagccgaaatctgcacatctgtagttgaggaaagcttcggttatcttgatgctccagttgagagaattgctggggctgatgttcctatgccttatgcagctaatcttgagagattggctgtcccacaggttgaagacattgttcgtgctgcaaagagagcatgctacagatctgtaccattggctgcggctgcttagttcaaccaatcccatccagaaacttttccaaatccaggggatatagagagtgtacattttttcatttctcatagcaggggaagaagctacgttgctgaaataacttggagaaaattgacacaaaggcgggaaattttgtgacttgtcattttaatttggcagtggacgtggaacccattatgataaaggaaaaaaaaccatatttcaaaggtttttttttaaaaaaaattcaatttccatccaatacattgctttcttgcaacgcctcttgtactgtttaagcgttggtcttctgatcattgtttgtttaatttggtaactctctggctggaatgatcatatatatgttcatgcgccccttagccttagggatgttagatgcatggattatcagtggggcgttaaagaaaaaacaataaagttt

SEQ ID NO: 3476 - DNA, 585 bp, Coffea canephora
ctaagatagagcgtgaaggaaaggacgtgactattgttgctttctcgaaaatggttggctatgctcttaaggctgctgagattctggcaaaggagggagtcagtgctgaggttataaatttgcgctcaatccggccacttgatagagccacaatcaatacttctgttaggaaaacgaacaggcttgtgactgttgaagaagggcttccacaacatggtgttggggctgagatctgtgcatctattgttgaggagagctttgagtatcttgatgcacctgttgaaagaattacaggggctgatgttcccatgccttacgcagccaatcttgagagaatggctgtcccacaggttgacgatattgtacgtgcagcaaagaggacctgctatagatcagttccagtggctgtaaatgcctaagctgctggattacaaagctttcttgcgattgtttttcacggtttattttcatcgattgaacaacgagtcttttgaaccaaatcttgatgcagctgtttgggagtctggaactctcatcttcctggtgcaattggattacttaaaattaatctgtccatactcggaa

SEQ ID NO: 3477 - DNA, 812 bp, Orobanche aegyptiaca
cctgtatcagcagaagttcttgattctagcttctgtctacctattggaaaagctaagatagagcgttctgggaaggatgtaacaatcactgctttctcaaagatggttggctatgctcttcaggctgctgagattctcgtgaaagaagggattgacgctgaggtgataaatctccgctccattcgccctctcgacagatcaacaataaatgtttctgttaggaaaacaaataggcttgtgactgttgaagaaggatttcctcaacatggtgttggtgctgaaatctgtacttctgttgttgaagatagctttgaatatcttgatgcacctgttgagaggattgctggggctgatgttcccatgccttatgctgcaaatcttgagagactggctgttccacaggtcgaagatattgtccgtgcagcaaagaggacttgttacaggtcatgttaaccagctgaaactgcttggacttactaggaagggaagcccgctaatagttcctgtagattatcctgttggaattattatttctttattatgggtttcatggtgtttgccttttttcctgggaaaagtttggatttttggcagaaaatcaggtttgacaagtccggatttatcacaagaaataggttgtgatactttggctttagttatggcaattttggagaacgttagtctggaaaacaaattgatttggagaaccgagggtaggaagagaataagtctttgaactatttttcattctgtgtatagtttaatgccatttcggacatttggattgcattttgtcactatacatgggtttt

SEQ ID NO: 3478 - DNA, 1171 bp, Gossypium hirsutum
ggacctgaaagggttcttgatactccaattactgaggctggtttactggaattgggttggtgctgcttactatggtctgaagccagtagtggagtttatgacatttaacttctccatgcaggcaattgaccacattattaactctgctgcaaagtccaactatatgtctgctggccagatatctgtacccattgtttttagaggacctaatggtgccgctgctggtgttggtgcccaacactctcagtgttatgcagcatggtatgcttcttgtcctgggttgaaagtattgtcaccatataattctgaagatgctcgtggactcctcaaagctgctattagagatcctgatccagttgttttccttgaaaacgagttgttatatggtgagtcattccctgtttctgatgaagttcttgattccagtttttgccttccaattgggaaagctaagattgagagagaaggaaaagatgtgactattacagctttttcaaaaatggtgggctatgcacttaaggcagctgagatgcttgaaaaggatggaatttatgctgaggttataaatttgcgttctattaggccactagatagatccacaattaacgcatcagtcaggaaaaccaacagactaataacagttgaagaagggtttccccagcacggtgtcggtgctgaaatctgtgcatctgttgtggaggagagtttttcatatcttgatgcaccagttgagagaatcgctggagctgatgttcccatgccatatgcagcaaatcttgagagaatggctgtgccacaggttgaagatattgtccgtgctgcaaagagagcatgctaccgatctgtaccattggctgctactgcctaattgaaccaatccaggaattagagggatacggatttttgcctttgtcgacacttgggtgcaggaagaagtgctttgacttaataacacagaaattgttagaaatggctggaaattttgacttatttgtcattggaccataacctttcccacattttaagtagttttctctactgtttctgagcttgtatttcaaatattatggcgctgaatcattcaatgttcgtggaggatgattccaactaataggaagtaataaaagattcccccttggctttccaaggtgcatggcccaagtttcttccc

SEQ ID NO: 3479 - DNA, 849 bp, Fagopyrum esculentum
ttcagagggcccaatggtgctgctgctggagttggtgctcaacattcccagtgttatgcagcatggtatggttcatgtcctgggttgaaggtgttggccccatactcctcagaggatgctcggggccttctaaaagcagctatcagagaccccgaccctgttgttttcttgaaaatgagttgctatatggtgaatcgttccctgtttcagcagaagctcttgactccaatttctgccttcctataggaaaagctaagatagaacgatccgggaaggatgtaacaattattgctttctccaagatggttggttattcccttaaggcagctgatattttggccaaggaaggaattaacgctgaggtcataaaccttcgcacaattcgtcctcttgatagagccacaattaatgagtctattaggaagaccaacaggctagtaacggttgaagagggtttccctcagcatggagttggtgctgaaatatgtgcaaccgttgtggaggatagctttgagtaccttgatgctccagttgaaaggataagcggtgctgatattcctatgccttacgctgctaatctggagcgattggctgttccacagattgaagacattgtccgggcagcaaagagggcatgctacagatcggttcccatggctgcctctgcttagttcctttcagattacaacacaactgaacttgacttctggcgttttcttgttcatcgcccccgtcgatcatagcattgctgttgataattcttttgattaaccacattcagagcgtgtggatttttatactatttggaatttgatacaattgaacaagatccaagacttttgaaataat

SEQ ID NO: 3480 - DNA, 684 bp, Parthenium argentatum
cttcctatcggaaaagccaagattgaaagagaaggtaaagatgtcacaattacagctttctcgaagatggttggctatgctctcaaggctgctgaaatacttgaaaaggacgggataaatgcagaggttataaacctgcgttctattcgaccactagatagagctacaatcaatgcttcagttagaaaaactaaccgcctggtcaccgttgaggaggggtttcctcaacatgtaattggtgctgagatctgtgcatcggttgttgaagatagcttcggttatctcgatgcaccagtcgagaggattgcaggggccgatgttcctacaccttatgctgccaatctcgagagaatggctttccctcagattgaggatattgtccgtgcggctaagagaacatgctacaggtcagtaccgatggctgcatctgcttcatgaaaggatatcataatgctgactcttttcgcttagagaatgcaccttgttagttttgaggggagtagaagcgggaagctccagttttttccttcatggtgtattgtgtgaatttaaatctgtagaatcctctctctacacatgagttctctttatttaataaggttggatgcaagtcgccatgcaagagatctctggttttgggttcttttgacatgctgcttcattaataaaagaaagtttacttgt

SEQ ID NO: 3481 - DNA, 650 bp, Cajanus cajan
ggtttgcttaaagcagctataagggaccctgatcctgttgtttccttgaaatgagttgttatatggtgagtcattccctgttacagccgaagctcttgattccagttttgccttcccataggaaaagcaaagattgagcgggaaggaaaagatgtgactattacagcttattcaaaaatggttggctatgctctcaaggctgctgagacactggcaaaggaaggaatcagtgctgaggttattaatttgcgttctatccgaccgcttgatcggtccacaatcaataattctgtaaggaaaacaaataggctggtaactgttgaagaagggtttcctcagcatggtgttggtgctgaaatatgcacatctgtcattgaggagagttttggttatctcgatgcacctgttgagagaattgctggggctgacgttcctatgccttatgcagcaaatctggagagaatggctgtcccacaggttgaagatattgttcgtgctgcaaagagagcatgctacagatctgtgcctttggctgcagctgcttgaaagtcaaaaaattttcatgtcctggttaggtaatccttgatgtaccaaaaacaattttcccctaatttccaccataaacatcaggaagaaattgcaaccaaata

SEQ ID NO: 3482 - DNA, 1526 bp, Helianthus annuus
atctctggattgtttggcgtggatttggttatcaacatctgagatctgtagtcccttgacggcgtgtaccgtatggaaggttcaaaaatatatttggtcacaactcacaataaagctggaattcaaaggggtagtggcggtctgttcgctgaagtggaagagatttatcactacagccaagagggtagacctgactgatgtgggcattgttggcggtctgttcgctgaaatggaagagaaggacaaggggcttccaaattctttgtatatgggtcgagccaagggacttccaaattctttgtttacgtcaagcagaatgacagtgcgagatgctctgaactctgctcttaatgaggaaatggctgctgatcccaatgtttttgttatggacgaagaggtaggagaataccaaggtgcatacaagataaccaagggattattggacaaatatggtccagaaagggttgttgatacccctatcacagaggctgggtttgctgggataggagttggttctgcatatcacggtttgaggcccgtgattgagtttatgactttcaacttctctatgcaggcgattgatcatgtcatcaattctgcagcaaagtcaaactacatgtctgctgggcagattaatgtacccattgtttttcgcggaccaaatgggcccgctgctggtgtcggtgctcaacattcgcagtgttatggtgcatggtttggggctgtccctggtttgaaagtgcttgtaccttactcctctgaagatgctcgtgggcttctaaaagctgcaattagagaccctgatcccgttgtttttcttgaaaatgaattgctatatggtgaatctttccctgtttctgctgaagttcttgattcaagtttctgtcttcctattggaaaagcaaagattgaaagagaagggaaagacgtcacaattacagctttctcgaagatggttggctatgctcttaaggctgctgaaatacttgaaaaggacggaataaatgcagaggttgtaaacctgcgttctattcgaccactagatagagctacaatcaatgcttcagttagaaaaactaaccgtctggtcaccgttgaggaggggttccctcaacatggcattggtgctgagatctgtgcatcggttgttgaagatagctttggttatctcgatgcaccagtcgagaggattgcaggggccgatgttcccacaccttacgctgccaatctcgagagaatggctttccctcagatcgaggatattgtccgggcggctaagagagcatgctacaggtcacctatggccgcaaatgcatcatgaaaggtatcaaatggctgactcttttttgcttggagaatgcaccttgtgatttttgaggggggtagaagtgggaagcttcgattttttccttcgtggtgtattgtgtgaatgaaatttgtagaatgccgtctctgcgcatggattatttttatttaataaggttggatgtaaatcgcaatgcgagagatgcgatttctttaataaa

SEQ ID NO: 3483 - DNA, 752 bp, Cichorium intybus
accgcacatcccgtgtttaggtttatcctattcttcgaaacgtgctgcttcaaagtgcatcagaaccgatctgtgtttcctgaaagagtgtatacgcagtcttccagttctggtgagccctgaatcaggttctgtctccccataggaaaagccaagattgagagagaaggaaaagatatcaccatcacagctttctccaagatggtgggctatgctcttaaggctgcagaaatacttgaaaaggaagggataagtgccgaggtaataaacctgcgttccatccgaccactggatagagatacaatcaatgcctcggtcaggaaaacaaacaggctggttaccgtggaagaaggctttcctcagcatggcattggtgctgaaatctgcgcatcggtggttgaggatagcttcggttatcttgatgccccggtcgagaggatagctggggctgatgttcccacgccttatgctgctaatcttgagagatccgcttttcctcagattgaggatattgttcgtgcagccaaaagagtctgctacagatctgtgcccatggctgcaactgcttaacgttttccctctttttctttgaattgcatccgcttttgggttttgacgtttgtacatgtataatgtctgtttgctcctccaatatttttttttaaccacatgcttcagtcaagtgaaccaacttatagacgtcatgatgctatttttaataaaacctttcctttttatctttcaaaaaaaaa

SEQ ID NO: 3484 - DNA, 642 bp, Solanum melongena
tgaagctcttgattctagtttctctctccccatcggaaaagctaagatagaacgcgaagggaaggatgtgacaatcactgccttctcaaagatggttggctatgctctcaaggctgctgaaattcttgccaaggaaggaattagtgctgaggttataaatctgcgctcgatccgaccacttgatagacctgccattaatgcatctgtgaggaaaaccaacagacttgttactgttgaagaaggatttccacaacatggtgttggcgctgagatctgtgcatctgtggttgaggagagcttcgagtatcttgatgcaccaattgagaggatagcaggtgctgatgttcctatgccatatgcagcaaatcttgaaagaatggctgttccacagatagaagacatcgttcgtgcagccaagaggacttgttaccgatcaagtaactaaatcgtttccaatggcggcagctgcttaggcttggtttacaaggtcttgcttgtttcaaagcatttaacttctttttgtggataacaattctttatccgcctgtgagcgtatgtttcccgcaatcttctgaaaggtttactctactgtaaaatcagctaaactggtaaaagaatgagttctgctgccaaatttttcag

SEQ ID NO: 3485 - DNA, 429 bp, Lolium multiflorum
ggctgcagagatactgtccaaggagggaatcagtgctgaggtaatcaatcttcggtcaattagaccattggatagagctgctattaatgcatctgttaggaaaaccaatagattggtaacagtagaagaaggcttcccacaacatggggttggtgctgaaatatgcatgtctgttgtggaggacagttttgagtatcttgatgcaccggttgagaggattgcgggagctgatgtgcccacaccctatgctgcgaacctggaaaggttggcgtttcctcaggttgaggacattgtccgtgcagcaaagcgggcttgctacagatcatcgtcaatggcagcaactgcctaaattcaaatggatcttatgtttctcggccttctctttcttctatgtccagaaaatttgtacctgcccgggcggccgctcga

SEQ ID NO: 3486 - DNA, 805 bp, Capsicum annuum
agattgaacgcgaaggaaaggatgtcacaattactgctttctcaaagatggtcggttatgctcttaaggctgctgaaattcttgcaaaagaaggaattagtgctgaggtcattaatttgcgttctatccggccacttgatcgacccaccattaatgcttctgtgaggaaaaccaacagacttgtaactgttgaagaagggttcccgcaacatggagttggagctgagatctgtgcatctgttgttgaggaaagttttgagtatcttgatgcaccagtcgagaggatatctggggctgatgttcctatgccatatgcagcaaatctggaaagaatggctgttccacagattgaagatatcgttcgtgcagcaaagagggcatgttacagagcagcaaaatcagttccaatggctgcagctgcttaagcttggtaggagcaaagactaccaagccggttttaagcattttatttcctgttagtggatattgattctttatctccctgtgagtggatgcttctgaatttaccatcctgagaagttcagtttgaccatgaaaaagaaagaagaaaaaggaaaagctacatgttagaaataaaacttggtacacaataaattttgccgttttcttgctctcttttcactgatgtgttgtcaaatgtttatacaaaacaaaacacatgctattactgatggaagagagagtagtggacagcattgcaacttttttgtgagtttcaactgctgacagttaatgagaacaaattctacgctgatatgtaatatggtatattgaatcctcgtgc

SEQ ID NO: 3487 - DNA, 950 bp, Panicum virgatum
ttcggcaccgaggccaagcgcccgcgcctcgcgcgctcctcctccatcgcctccgtctgctccgtctcctccctcgacggggacgccgacgccgacgccggcccgtccccggccgcgccgctgccgctgctgcgcaccagctcgctgcccaccgagaccgaggaggagcgctggcgccggcgcgagatgcagagccgcaggcgcctcgaggcgcgccggaagcgcgtcgagcgccggaactccatgggctcctccttcctgccctcggcgccgcccaggcccgccggcgaggcgcccgccgccgccaacggcgtgcagctcaggaggtccgtcggctcgcaggggagcacttctgtccccaccacggaacaaggtattggtggaagtgcagtttgccagtccacagatgcaaagagtccatcaacctcggataatacaaatgaaaataacatgcttcctcctccaaccaaagcagctgagaagccacaaaatggcacttccacagagcaacctcggctgcggacgcttgggtccctgacaacgagaacgagcagctgcagtgatatcaggaagatcatgatggaggacatgccaatggtctcatccaaggtggaaggtcctaatgccaggaggatcgatggcttcctgtacaggtacaagaaaggcgaggatgtgaggatagtctgcgtctgccatggtagcttcctcactcctgcagagtttgtgaagcacgccggcggcggtgacgtatccaacccgctaaggcatatcgttgtcaacccatcgccgttctcgtgaagagagggttaccctgttgttggttcctattgttctgtaacatgtaggcttcctgttggcgagttaaaccgaaagtctctgtattttacataaattgagaatgacagcaaattcaagagatacatcatctgcaaaagttaggcttgtttaca

SEQ ID NO: 3488 - DNA, 1104 bp, Panicum virgatum
ttcggcaccgaggccaagcgcccgcgcctcgcgcgctcctcctccatcgcctccgtctgctccgtctcctccctcgacggggacggggacgccgacgccgacccgtccccggccgcgccgctgccgctgctgcgcaccagctcgctgcccaccgagaccgaggaggagcgctggcgccgccgcgagatgcagagccgcaggcgcctcgaggcgcggcggaagcgcgtcgagcgccggaactccatgggctcctcctccctgccctcggcgccgcccaagcccgccgccgaggcgcccgccgccgccaacggcgtgcagctcaggaggtccgtcggctcgcagggcagcacttctgtcaccaccacggaacaaggtattggtggaagtgcagtttgccagtccacagatgcaaagagtccatcaacttcggataatacaaatcaaaataacatgcttcctccaaccaaagcagttgagaagccacaaaatggcacttccacagagcaacctcggcttcggacgcttgggtccctgacaatgagaacgagcagctgcagcgatatcaggaagatcatgatggaggacatgccaatggtctcatccaaggtggaaggtcctaatgccaggaggatagatggcttcctgtacaggtacaagaaaggcgaggatgtgaggatagtctgcgtctgccatggtagcttcctcactcccgcagagtttgtgaagcacgccggcggcggtgacgtatccaacccgctaaggcatatcgtcgtcaacccatcgccgttctcgtgaaaagagggttaccctgtcaacccatcgccgttctcgtgaaaagagggttaccctgttgttggtacctattgttctgtaacatgtaggcttcccgtttgagagttaaacggaaagtctctgtattttacataaattgagaatgacagcaaattcaagagatcgtcatctgcaaaagttaggcttgtttacaaattgaagataatttagcagttggtacaggatataagtctggtactctgggaggactttccttgcatatttttcttctagaattgctggagcacaatcaacaggaaccgatcttttaat

SEQ ID NO: 3489 - DNA, 490 bp, Saccharum officinarum
  misc_feature (47)..(47): n is a, c, g, or t
  misc_feature (89)..(89): n is a, c, g, or t
ggaggttttgttccgccacccgcccgtggccgacgcagcggtggtgnccatcccccacccccggtggggcgagacgccgtttgcttttntcgtgcccaggaacaacgctgccgagctcagtgaggacgacgtgctcgcgttctgccgcaagcgcatggcgggcttcatggttcccaagaaggtggaggtcgtcggagcgctacctaggaacgcgctcggaaaggttgagaaggtcaagctccgggaggctgcacggaagctggcgcccaccgtgccggcgcagaagccgaaggggaagacgacgacctcctcgacgacggtcggcggtcgccgcgaggagcaaccggtggcgcacgtcatggcggtgtcaaggctataggtagcacatgcttcgtttttcgacaagtcaaccataaataaatttatatgaaaaactactatcatataaaataagtgccgttaaattagttatagaatatatttttataat

SEQ ID NO: 3490 - DNA, 2864 bp, Theobroma cacao
aggcacattcctctacctactggtctatatactaatatgtcttgtaggctgctaagcttaaataatctccgcatttatatatacgtttcattttcctgcattttggaccaacaaagaaaggaaaagaaagagaaagaaagacagaaaaaaaaaaaccagagagaaatagttcgagagtgtgcagcgacggtggtggagatgcgagacatagacgatcttccgaagaacgccgctaactacatggccttgacgccgttgtggttcttggaacgagctgctacggtccatccggctagaaaagcggtggtccatgcatctcgtacgtacacgtggctccaaacttaccggcgctgctgttgcttggcctcggctctctctagacggtccgtcggcgttggtagcacggtagcaataattgcaccgaatgtccctgctttatatgaagctcattttggaattccaatgtcgggtgctgttttaaacactgtcaatattcgtctaaatgcatccaccattgctttccttttgggtcattcgcaatctgcagttgtcattgtggaccaagagtttttcactttggcagaggatgctttgaaaatcatgaaggagaaaagccaaggcaatttcaagcatccacttttgattgtcattgcggatgaaagctgtgatcccaaagcactcagatacgctttgggaaaaggagccattgagtatgagaagttcttagaaagtggtgaccctgagtttgcttggaagcctcctcaggatgagtggcaaagtattgctttgggttatacttctggcactacagccagccctaaaggggtggtattacatcaccgaggggcatatctcatgtctttgagtaatcctcttatatgggggatgactgaaggagctgtatacttgtggactctacccatgttccattgtaatggttggtgttttacttggtcactagcagctctttgtggaacaaacatatgccttcgacaggtaacagcaaagggagtctactcagccatagcaaagtatggtgtgactcacttctgtggtgcacctgtggtgctgaataccatagttaatgcccctcctaaggacacaattttgcccctcccccatgttgttcatgtgatgacagctggtgctgccccaccccctgctgttctctctgcaatgtctcaaaaaggcttccgtgtcacccacacttatggtctctcagaaacctatggaccttcgacagtgtgtgcatggaagcctgaatgggactcactgccacctgaaacacaagctcgcctaaattcacgtcaaggtgtccgatacatcggtttagagggccttgatgtcatcagtaccaaaaccggtcagcccgttcctgctgatggaaaaactattggagaaatagtaatccgtggtaatgttgtgatgaagggctacttaaagaacccaaaagtcaacgaggaaacttttgcgaatgggtggtttcactctggggatcttggtgtgaagcattctgatggctatatcgaaataaaagataggtcaaaggacatcatcatatctggaggtgaaaacatcagcagtgtggaggtagaaaataatttgtacttgcaccctgcagtattggaggcatcagtggtggcaagggtagacgagcgctggggagagtccccttgtgcttttgtgaccttgaagccgggagtggataaatctgatgaacagcagttagcagaggacataatgaggttctgcaggtcaaagatgcctgcttactgggttcctaaatcagtggtattcggtccattgccaaagactgccacagggaagattcagaagcatgtgcttagagccaaggcaaaggagttgggacctgtcaagttgagtaagttgtaagttgaaacattatatcattagggactaaataaaaaccatggaatcgttggtatgcatcgtttcaactgatagagtgcttgtattttgcatgtctaggataaaccttataggattatttttatcaataaaaaatttcatctctaattagtccttaaataacttggcggttaccatactgatgtacttgtttgaagtcgttttaggaatatgctgtgcttatcttcctttcgctctcgatcctccagttaccaatatgcatggctaagcccattcagttagaagacctgtaacattgtcaatgtcatcagagtttttgggcttagttctttgcgagagctggatctcagtagctttctttgtagactttcacagtatatacagaggcctatattttgagcccgaaaggcttacttccaggccttctactagctttagagtttagatttcctcttcaatattcaggaaagctccattttcttatctctgaatgaccatataaataattaaatattgtagtgtgtatctgatagaagacaagaaaacattacatccttgatatataattgccagatgtggatcataaggttaaggattgatccgagcagacgtggcatgtgaagctcagataactctcagccgaaacattgaaaaataattcagttacagttaggattctgtaagctgcggctaatggaaacatcaaaatcaaaggctgtaaagttaacatcaatcattcgatttggggtcttgcacggaagggagaaggttactctgttgttatgccacgcttaatctcataattatcaactttgtgtacaagttttgtttccccaagaatcctcttaaccctttgttttcttgtcaacaattgtcagctgcaacttcaagttgttctcgagtgttcccacgtatgtcttctctttgtgcgtatgcccgtcaatatcataaaaaaataaaatcaaatttattta

SEQ ID NO: 3491 - DNA, 1059 bp, Brachypodium distachyon
ggagccctccctgctccgccccgccggcatggcgtcgctcgtgccccggctccttcggcgccggactctgcaacccgcccaggttctacgctctctacgtgattcttggatgcgattgcccgacgcgagctccccacgtcctgccccattgctccactgttccccgggggatgctgggtgtgtgttagctgcacgaagttggtggttttactcgcctgtgaggtacgggagcacggcggtgacgctgaacacggacggtggctttgcgcggttttcggtcggagactcgggcacgaggcagaatgggggtcagaagcagccgccggcgaataagaagaagatgtcaaggaagtccaaggtcaaccagctcaagtggttccgactaaaggctaaaaagaagatgaagtcgccaaaccccgaagtcaggataagatacaagcttgaaaaggctaagaggaaagaagagtggctcattgagaaacttaggaagtatgaggtcccgagggttccggagccagttcatgaccctgagattctgactgaagaggagaaattttacctcaaacgaactggggagaagaaaaagaactatgtccctgttgggagaagaggggtctttggcggtgttgttctaaacatgcacctccactggaaaaagcatgagactatgaaggtggtctgcaagccctgtcggcctggccaagtgtatgagtatgccgaggagctggcgaggctcagcaaagggacagtcattgatattaaacccaataacacaattatcttctatcgtggaaagaactatgtgcagccaaaggttatgtcacctcctgacactctttctaagcagaaggccttggaaaaatataggtatgaacaatctcttgaacataccagtcaatttattgagcagctggagaaggagcttgaagattaccagaaacatgtcattttatttaagaaccgtgacagagctattcccgagaaaataagtaacaaagatgctattgttgatgacctcacaactagttcagatactgaataatcatcttcttgatcaat

SEQ ID NO: 3492 - DNA, 1291 bp, Solanum phureja
gagaagagtctacaagcttccattattcttcctataactgaaattctcaacctcgttcttctttcactttcataaaccgagctctccaactacctaacaacactctggttgctgctttgatcgatcgtttgagaaggaggtaggtagcataaatttgtgcaaattgatctctgatagctttttagggttttttttggacgctgttgttaaaagaagaatatggagccatactatacattgaagatgaagaggaaggatttggaagatgtttatgatgaattttctgaattttcactttcttctcccgccagaaaaattcgtcgactggatgcagatttgcctcccataatagaagaggttgaagaaccagagattcctatagcttttgagcaagcagctacttatccaagcttcggaagcaatgcagtaaataggggtctagtaattgaggaactgccaagtgtgcccgagaatgaagagagggcaattgttctattcaagcccatgaacacacagcctgtgcattccccttctaatttctccgttaaagtggatccccagtttcttaatggtctcaaaagtcaaatcttctgggataacactgcaaatgcatttagactagttgacaatgaagcaacgcaacaggacgactctagttctgcaaaagaatgtctagcggttgttccgtgggttccatctcaatttccttctgcagcagaagctgaagtccttagtcaacctgatgtttcagatatgatggatgctgaagatatggagggagtagctatggatattgaagataacagtgtggatgttgaaccaagaactgcagtcgaggctggtgcagttggtgtaaatgatggttttcatcattggcaacaacagcattgtatgacgacgactcaactgcctcagaacacatcaacacctattccctggtaccggtaattggcatataaggattaggatgttataattacgattagatattattagaactctccatgggtctcctcttgcaaggaagcattggttaggtaaaagagggtgaagtaaatagtagataaaagtactagaatgtgaattgaaaaggtcaggagaccgttatgttaaattcagcaagcatggcctctaatatgtcgagcgaagagctgcttatggttttctaatgtctccatcattctccatatcttggatatgatttttctttagttgttatgcctattttgcttacacactgatagagattgtggaatggaaaatagtcactttgggaacgaaatttgttcaa

SEQ ID NO: 3493 - DNA, 1154 bp, Solanum tuberosum
caacactctggtttctgctttgatcgatcgtttgagaaggaggtaggtagcataaatttgtgcaaagtgatctctgatagctttttagggttttttttggacgctgttgttaaaagaggaatatggagccatactatacattgaagatgaagaggaaggatttggaagatgtttatgatgaattttctgaattttcactttcttctcccgccagaaaaattcgtcgactggatgcagatttgcctcccataatagaagaggttgaagaaccagagattcctatagcttttgagcaagctgctacttatccaagcttcggaagcaatgcagtaaataggggtctagtaattgaggaactgccaagtgtgcccgagaatgaagagagggcaattgttctattcaagcccatgaacacacagcctgtgcattccccttctaatttctccgttaaagtggatccccagtttcttaatggtctcaaaagtcaaatcttctgggataacactgcaaatgcatttagactagttgacaatgaagcaacgcaacaggacgactctagttctgcaaaagaatgtctagcggttgttccctgggttccatctcaatttccttctgcagcagaagctgaagtctttagtcaacctgatgtttcagatatgatggatgctgaagatatggagggagtagctatggatattgaagataacagtgtggatgttgaaccaagaactgcagtcgagactggtgcagttggtgtaaatgatggtttgcatcattggcaacaacagcattgtatgacgacgactcaactgcctcagaacacatcaacacctattccctggtaccggtaattggcataatgattaggatgttataattacgattagatattattagaactctccatgggtctcctcttgcaaggaagcattggttaggtaaaagagggtgaagtaaatagtagataaaagtactggaatgtgaattgaaaaggtcaggagaccgttatgttaaattcagctagcatggcctctaatatgtcgagcgaagagctgcttatggttttctaatatctccgctcgagatgaaactgcaaatcattatccatgtcatggatatgatttttctgtagttgttatgcctattttgcttac

SEQ ID NO: 3494 - DNA, 603 bp, Solanum melongena
acacacgcaaaatccaaaacgtcactgggaaaaaaagatcagtattcagtatgaagaatacatcaaaaagttccaaaattagccccaaatcaagccaagatgcgaggaaggaccggcgatcggctacaggaatgagtggttcaccgaaaaaaggcggccatggcggtaagtttacttgggccggcgatggttggactaagaaagaagatgatgctgttgttgttgttgatgcaaaggatccgaattttgatgaaccggaagagaacccgatcgaagattgatctaaattgttaatgtaaatatttgaagaatttgctaatgttttggtaatttatgaaggatttagaggaaaaaaaatggagtggaatggaagtattgagttatctgtgttgtttcactttgtttgataaataaaaatgtatttttccccttttttcacttaatcagatatttcgagttttataaattataagatttgcatatatccaactttattcagatctcattcgtgagattatatggagcaaatgttgttcactttcttatagatcttatttgtaaaatcgcattttgcgtgtatagtatatgattattattgagaaa

SEQ ID NO: 3495 - DNA, 1804 bp, Brachypodium distachyon
atgccgccggcgccgccgtcgaggccctcctcgaccccttcacaccgccgcccccaccctcctacatccaaccccgtccgccgccaccacaacctccacctcgcccgctgcttccccgaccaaccgcaacccgccaaacccgcacccccaaaccctaacccgctcctctcgctgctcaccgccgtaccggactgggcggacgccgtgacggaacggcgggtgcgagacccgcgcccgctctacacgcacgagcagtggcgggagcaccggagctcgcgccgccacctgcggcacctcctctcctcgctctcctcccgcgtcatcctctccctggccccgcccgtctccgccttcaccgccgtcgccgccgccgtggccacctacaacacgctcgtccctgcatacgcgctcacggcgtcctcgctgccctaccagctcacggcccccgcgctcgcgctcctcctcgtcttccgcaccgaggcctcctacgcgcgcttcgacgagggccgcaaggcctggatccgcgtgctcgccggcgccgccgagctcgtcggcatggtcatgcatccggcgggcggtgttgccggagacgggacggacgagccggctgggaggaccgcgctcgtcaactacatccttgcattccctgttgcgctcaagtgtcatataactagcaactccgacataagaaaggatcttcagggtttgctcgcagaagacgacttgaatgttgttctcacgtcaaaacaccggcctcgttgtatcatcgagttcatttcgcagagtcttcagatgctggactttgaggaacataggcgaagcatcatggagtctaaactgtctggttttcttgaaggaatttgtgtctgtgagcagatcattgggattcctgtccccctgtcatacactaggcttacttcaagattccttgttctgtggcatcttacgcttccagtgatactatggtcggaatgtaaatggatagtcgttccagctacttttatcagtgctgcctctttattctgcattgaggaagtcggtgttttgatcgaggaaccattccccatgctagcccttgacgagcagtgcaagcagctccacgacagcatgcatgacatgatgtcagtgcaagactcggttcgcaagcgattggttgcgaagactaagagccagcaacggagcggtagatacccaaacaatggccggcccggctccaaaagcgagcaggtgaagatcgattgagctggtggcgaattattcatcaagaacagcatctggaagcaaccgaagagttcatggtgtctagttgtccaccaccacacgcacaccttcatagtgccagtccccacttccaggtactagtagatgctatgcaacccaacaactttccaggcccattgtatgagaatcggttgcgagctggtccattagtttgttgtggctgagtctgagttcctggatggagcaagtaaacccagctgcagtagtagaataaagtggtgaggtctgaaggactgctgttagtgtagtgcagctccatttgtgtaggtaaggtgtacaagcagcagcatctagctagtgcatgtacaaaataaaaccgggtccttcccagagagagaaatgtagctctatgtatcctagctttgtatatagttttgggtgagctatatagtacttctgttaaaaaaaattatgcatatcgtgctgaggagtcactttgtgtgtaccgtcattgacggctaaccttttgactcgcaaacgaaaaaggaaaagagagaggtgatgcatggttaacctttttttt

SEQ ID NO: 3496 - DNA, 645 bp, Triticum aestivum
  misc_feature (327)..(327): n is a, c, g, or t
caatcaaaccaatccagagtaccatcggctatcaatcagcaggaggaagaaaccgctgctcgaccggggaagaaccaagaggctcggcgaagatgcaggcggcgaaggagaaggtgaaggacggcgtgagcgcggtgaaggccaaggccaagatcacgcaggccaaggcgtcggagaaggcggaggcggccacggcgaggtcgcacgcggagcgggagctggcgcacgagcgcggcaaggccaaggtggccgcggccaagatggagctgcaccaggacaaggcgctccaccgggaggaggccatggagcaccgcatccacaagcacnggcggcggccacggccgccaccaccacaagcacggcgtcggcatcgtggccgcgcccccgccggcgaccggtgccggggcttaccaccctcctcccgccgccggtggccactactactgatcagctacgcagctggatcgccagctagatgggcacatgcgtcgcgtttgtgtgatgtgttctcgatagctaataagtctgtactttgtgctgtttatgtttgacttacccacgcgtggtttttcattttgcacttggcttggatatgagagctgtacttgatatttatgcacatatgaatgcatgcgaccttgttgg

SEQ ID NO: 3497 - DNA, 639 bp, Triticum aestivum
caaaccaatccagagtaccatcggctatcaatcagcaggaggaagaaaccgctgctcgaccggggaagaaccaagaggctcggcgaagatgcaggcggcgaaggagaaggtgaaggacggcgtgagcgcggtgaaggccaaggccaagatcacgcaggccaaggcgtcggagaaggcggaggcggccacggcgaggtcgcacgcggagcgggagctggcgcacgagcgcggcaaggccaaggtggccgcggccaagatggagctgcaccaggacaaggcgctccaccgggaggaggccatggagcaccgcatccacaagcaccgcggcggccacggccgccaccaccacaagcacggcgtcggcatcgtggccgcgcccccgccggcgaccggtgccggggcttaccaccctcctcccgccgccggtggccactactactgatcagctacgcagctggatcgccagctagatgggcacatgcgtcgcgtttgtgtgatgtgttctcgatagctaataagtctgtactttgtgctgtttatgtttgacttacccacgcgtggtttttcattttgcacttggcttggatatgagagctgtacttgatatttatgcacatatgaatgcatgcgaccttgttg

SEQ ID NO: 3498 - DNA, 688 bp, Triticum aestivum
atccagattaccatcggctatcaatcagcaggaggaggaaatcgctgctcgatcggggaagaatcaagaggctcggcgaagatgcaggcggcgaaggagaaggtgaaggacggcgtgagcgcggtgaaggccaagaccaagatcacgcaggccaaggcgtcggagaaggcggaggcggccacggcgaggtcgcacgcggagcgggagctggcgcacgagcgcggcaaggccaaggtggccgccgccaagatggagctgcaccaggacaaggcgctccaccgcgaggaggccatggagcaccgcatccacaagcacggcggcggccacggccgccaccaacacaagcacggcgtcggcatcgtggccgcgcccccgccggcgaccggggccggggccggggcgtaccaccctcctcctgccgccggtggccactactactaattacagctaagcagctccaactctagctagatgggcacatgcgtcgcgtgtgtgttatgcgatctcgctagctaagtttgtattttgtactgtttgtgctagacttacccacgcgtgctttttaagtttgcacttggtttgcacttaggagatgagagctctatgtatgtatggatgcatgcaaccttgttggttgctttcttttataatactctaaagagcggtaaatcaattacgtttgtttggc

SEQ ID NO: 3499 - DNA, 715 bp, Triticum aestivum
caagctccaatcaaacacagcaaaccaatccagattaccatcggctatcaatcagcaggaggaggaaatcgctgctcgatcggggaagaatcaagaggctcggcgaagatgcaggcggcgaaggagaaggtgaaggacggcgtgagcgcggtgaaggccaagaccaagatcacgcaggccaaggcgtcggagaaggcggaggcggccacggcgaggtcgcacgcggagcgggagctggcgcacgagcgcggcaaggccaaggtggccgccgccaagatggagctgcaccaggacaaggcgctccaccgcgaggaggccatggagcaccgcatccacaagcacggcggcggccacggccgccaccaacacaagcacggcgtcggcatcgtggccgcgcccccgccggcgaccggggccggggccggggcgtaccaccctcctcctgccgccggtggccactactactaattacagctaagcagctccaactctagctagatgggcacatgcgtcgcgtgtgtgttatgcgatctcgctagctaagtttgtattttgtactgtttgtgctagacttacccacgcgtgctttttaagtttgcacttggtttgcacttaggagatgagagctctatgtatgtatggatgcatgcaaccttgttggttgctttcttttataatactctaaagagcggtaaatcaattacgtttgtttggc

SEQ ID NO: 3500 - DNA, 628 bp, Triticum aestivum
ccacgcgtccgcaagctccaaacaagcacagcaaaccaatccagagtaccatcggctatcaatcagcaggaggaagaaatagctgctcgatcggggaagaatcaagaggctcggcgaagatgcaggcggcgaaggagaaggtgaaggacggggtgagcgcggtgaaggccaagaccaagatcacgcaggccaaggcgtcggagaaggcggaggcggccacggcgaggtcgcacgccgagcgggagctggcgcacgagcgcggcaaggccaaggtcgccgcggccaagatggagctgcaccaggacaaggcgctccaccgggaggaggccatggagcaccgcatccacaagcacggcggccacggccgccaccaccacaagcacggcgtcggcatcgtggccgcgcccccaccggcaactggggcgggagccggggcgtaccaccatcctcccgccgccggtggccactactactaatccctaggcagctcgatcgccagctagatgggcacatgcgtcgcttctgtgtgatgtgatcttgatagctaataagcctctactttgtactctgtgtgtaatgacttaccaacgcgtgctttttaattttgcacttggttttgagacgagaa

SEQ ID NO: 3501 - DNA, 756 bp, Triticum aestivum
taccatggcggtcggatccgggtcgaccacgcgtcgcccacgcgtcgaacaagcacagcaaaccaatccagagtaccatcggctatcaatcagcaggaggaagaaatagctgctcgatcggggaagaatcaagaggctcggcgaagatgcaggcggcgaaggagaaggtgaaggacggggtgagcgcggtgaaggccaagaccaagatcacgcaggccaaggcgtcggagaaggcggaggcggccacggcgaggtcgcacgccgagcgggagctggcgcacgagcgcggcaaggccaaggtcgccgcggccaagatggagctgcaccaggacaaggcgctccaccgggaggaggccatggagcaccgcatccacaagcacggcggccacggccgccaccaccacaagcacggcgtcggcatcgtggccgcgcccccaccggcaactggggcgggagccggggcgtaccaccatcctcccgccgccggtggccactactactaatccctaggcagctcgatcgccagctagatgggcacatgcgtcgcttctgtgtgatgtgatcttgatagctaataagcctctactttgtactctgtgtgtaatgacttaccaacgcgtgctttttaattttgcacttggtgttgagacgagaactctgtatgtgtgcatagatggatgcgtgcgaccttgttggttgcttttcccctttgcgcggtgtcccgcgaggtgtctgaatctaagagccgtatcttca

SEQ ID NO: 3502 - DNA, 697 bp, Triticum aestivum
  misc_feature (338)..(338): n is a, c, g, or t
gcacagcaaaccaatccagagtaccatcggctatcaatcagcaggaggaagaaatagctgctcgatcggggaagaatcaagaggctcggggaagatgcaggcggcgaaggagaaggtgaaggacggggtgagcgcggtgaaggccaagaccaagatcacgcaggccaaggcgtcggagaaggcggaggcggccacggcgaggtcgcacgcggagcgggagctggcgcacgagcgcggcaaggccaaggtggccgcggcaaagatggagctgcaccaggacaaggcgctccaccgggaggaggccatggagcaccgcatccacaagcacggcggcggcngcggccgccaccaccacaagcacggggtcggattcgtggccgcgcccccgccggtggccggggcgtaccaccctcctcccgccgccggtggccactactactgatcagctaggcagctcgatcgctggctagatgggcacatgcgtcgcgtctgtgtgatgtgatctcgatagctaataagcctctactttgtactgtttgtgtaatgacttaccaacgcgtgctttttaattttgcacttggtgttgagacgagaactctgtatgtgtgcatagatggatgcgtgcgaccttgttggttgcttttcccctttgcgcggtgtcccgcgaggtgtctgaatctaagagccgtatcttcaa

SEQ ID NO: 3503 - DNA, 1119 bp, Lactuca sativa
atcttcatctcgccggagatatagctgcaacgtactctgttacagagacttacagtagagtaatggcggacttgaacggaggagctcagtacacggattttccggcggtgccgacacatggaggccagttcgttcgctacaacatattcagtaatgaattcgaagtcactgcaaaatacgttcctcctattatgcctattggccgtggtgcttacggaattgtctgctcgatgttgaattcggagacgaatgagatggttggtatgaagaagattatgaatgcttttgataattacatggatgctaagagaacccttcgtgagatcaagcttcttagacacttggatcatgagaatgtaatagctttaaaagatgtagttcctccacctgtatacacagagttctcagatgtctacatagccaccgagctaatggatactgatcttcaccaaatcattaggtcaaatcaaaatctctccgaagaacattgtcaatacttcttgtatcaactgttacgaggcttaaaatacattcactctgctaaagtcattcacagagacctgaaacctagcaatttgttgttgaacgcaaattgtgatttaaagatctgtgattttggacttgcaagaccaaatgcagataacgactttatgactgaatatgttgtgacaagatggtatagagcacctgagctgctactaaactcttcagactattcagctgccattgatgtctggtctgttggctgcatctacatggagctcatgaacagaaagcctttgtttcctggtaaagatcatgtgcatcagatgcgactattaacagagcttttaggcacgccttctgaatctgatcttgggtttatcaagaacgaagatgcgaaaagatatattgctcagcttccacgacatcctcgtaaatcattgctgaatactttccctcatgttcatccatcagccattgatcttgttgagaggatgttaacatttgatccgaccaaacgtatcacagttgaagaggcactcgagcacccataccttgaaagattacacgatgtagaagatgagccaatttgtccgaatccattctcatttgattttgagcaacaagtgttaggag

SEQ ID NO: 3504 - DNA, 1643 bp, Centaurea maculosa
  misc_feature (17)..(17): n is a, c, g, or t
  misc_feature (20)..(22): n is a, c, g, or t
  misc_feature (31)..(34): n is a, c, g, or t
  misc_feature (36)..(37): n is a, c, g, or t
  misc_feature (41)..(41): n is a, c, g, or t
  misc_feature (49)..(49): n is a, c, g, or t
  misc_feature (67)..(67): n is a, c, g, or t
  misc_feature (74)..(74): n is a, c, g, or t
  misc_feature (84)..(84): n is a, c, g, or t
  misc_feature (86)..(86): n is a, c, g, or t
  misc_feature (88)..(89): n is a, c, g, or t
  misc_feature (94)..(94): n is a, c, g, or t
  misc_feature (99)..(100): n is a, c, g, or t
  misc_feature (109)..(109): n is a, c, g, or t
  misc_feature (114)..(115): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (179)..(179): n is a, c, g, or t
  misc_feature (191)..(191): n is a, c, g, or t
  misc_feature (209)..(209): n is a, c, g, or t
  misc_feature (224)..(224): n is a, c, g, or t
  misc_feature (276)..(276): n is a, c, g, or t
  misc_feature (290)..(290): n is a, c, g, or t
  misc_feature (344)..(344): n is a, c, g, or t
  misc_feature (353)..(353): n is a, c, g, or t
  misc_feature (1362)..(1362): n is a, c, g, or t
  misc_feature (1374)..(1374): n is a, c, g, or t
  misc_feature (1406)..(1406): n is a, c, g, or t
  misc_feature (1408)..(1408): n is a, c, g, or t
  misc_feature (1498)..(1498): n is a, c, g, or t
  misc_feature (1518)..(1518): n is a, c, g, or t
  misc_feature (1538)..(1538): n is a, c, g, or t
acgaggtccacagtttnggnnnggattcccnnnncnncttncttcttcntcttcttttataatttanaaaatcnacctccattntncnnctacnctttnnaatcaagtnattgnntnantnancaatggcggacgctagcggcggaggacctcactacactgattttccggcagtcgcnactcacggaggncagttcattcgctacaanatcttcgataacganttcgagatcaccgccaagtaccgtcctccgatcatgcctattggccgtggtncttatggaatcgtntgctcgatgttgaactctgagacgaacgagatggttgctgtgaagaagattgcnaatgctttngataattacatggatgctaagcggacgcttcgtgagatcaagcttcttcgacatttggatcatgaaaatgtaatcgctataaaagatataatcccaccacctctacgcagagagttctccgatgtctacattaccactgagcttatggataccgatcttcaccaaattattcgatccaatcagaacttatcggaagagcattgtcagtactttttgtatcagctcctacgaggcttgaagtacattcattctgccaacgtcattcatagagacctcaagcctagtaatttgctgctgaatgcaaattgtgatttaaagatttgtgattttggacttgcccggacaaatgctgagaacgactttatgaccgaatatgttgtcaccagatggtacagggctcctgagctgctactcaactcttcagattatacagctgccatagatgtgtggtctgttggttgcatcttcatggaactcatgaacaaaaagcctttgtttgctggtaaagatcacgtgcatcagatgcgcttattaacagagcttctgggtacaccaactgaatctgatcttcggtttattcggaatgaagatgcaaaaaggtatctcgctcagctccctcaacatcctcgacagtcgttagcaaagactttcccacacgttcatccgttagccattgatctagtcgacaaaatgttaacaatggatccaactaaacgaatcacagttgaagatgcattagatcacccttatcttgctagactacacgacgtagctgatgagccaatctgcatggatcctttctcgtttgaattcgagcaacaagttctaggcgaagaacaaataaaggacttgatttatcaggaagcattggcacataatccgggcttcgcttaaatgaaatcccacgcccacggtatcaattattactagatatgtgctaaataaatctggtgctcatcgatacctccatggtgatcagaatcatccaactggaactctcttgtatcantgatctaaacantttacagatgaatccagctgctgatcggtcancnttgtattgtatgttgtttctccggtttgaaattgttttatttattgcttttcggttcatggttttcggtcttgtttcataccatgtgtgntgtgttgatgagtttatganctagattttagatggttcanttgtacaagtaccagagatcgatctatttatgtattttgttgcctaacacttggtgctcttatatttaatttggacatatggcttcactatcatttaattggggg

SEQ ID NO: 3505 - DNA, 1604 bp, Artemisia annua
tactccaacggggacttttacacatatataccatcatcaaaccacttcactttcctctctctttatatctttcagcactgaaaaacatattatttgcagtttccaaaaataatggcagactcaggaggtggtcagtacacagattttccagcagtgccaacttatggtggtcagtttattcgttacaacatttttggaaatgactttgagatcactaataagtatcgtcctcccatcatgcctattggtcgtggtgcttatggtattgtatgttcgatgttgaacgctgagacgaatgagatggtggctgttaagaagattgcgaatgcttttgataattatatggatgctaaaaggacacttcgcgagattaagcttttgagacatttggatcatgagaatataatagctataaaagacataatcccaccacctctacgaagagagttctctgatgtttacatcaccactgaacttatggacactgaccttcaccaaattattcggtctaatcagaacttatcagaagagcattgccagtacttcttgtatcagctcctaagaggcttgaagtacattcactctgctaatgttatccatagagacttgaagcctagtaacttgctgctaaatgcaaattgtgatttgaagatttgcgattttggacttgctaggacaagtgctgagaatgactttatgactgaatatgttgtcacaagatggtatcgggctcctgagctgttactcaactcttctgattataccgctgccattgatgtgtggtctgttggttgcatctacatggagctaatgaacaagaagcctttgtttcctggtaaagatactgtgcatcaaatgcgcatattaacagagcttttgggtacaccaactgaatctgatcttcggtttattcgaaatgaagatgcacgaaggtatctcgctcaactccctcaacatcctcgccagtcattatccacggttttcccacatgttcatccattagccattgatttagtcgacaaaatgttaacaatggatccaaccaaacgaatcacagttgaagatgcattagatcacccttaccttgcaagactacacgatgtagctgatgagccaatctgtgcggagcctttttcatttcaattcgagcaacaagttcttggagaagagcagatcaaggacttgatttacgaggaggcattagcacacaacccggggtttgcttaaaagaaaaacatcaggcattccatggtattaaaccatcgtgaactctaagatattgctaaataagtctgccatgtgaatgcctatggaaaaagaaaaaaaaaagaagatatctccaaagtgagctgaatcatccaaccggaactgcaaatttgttgtattactcatttagaacaattggcagatgaatcagtggctatgttgttttttcagtttgaaatttttttattgcatttttggttcatggagggggttcggattttggtctcctttcggtaccttgtgatttgtgttgttgctgagatctaaaactagattttagaattgtgtactgttgtaatttgtagtcaatctgtacaagtaccatgagatctatttat

SEQ ID NO: 3506 - DNA, 1516 bp, Helianthus annuus
cgcgtaatggtttgtctgggcatcttcttcttcagttctttcttcttgaactccataacatacatacatatatacatatagccagagctagctgcagtaaccgaaaactaacaaccaacagttgtgcaaatggcagacaatagcggcggtcacgactttccggcagtggctactcacggtggtcagttcatccggtacaacatatttggtaatgaatttgagatcaccaacaagtaccgtcctccgatcatgccgattggtcgtggcgcttatgggatcgtgtgttcgatgctgaacgctgagacgaatgagatggttgctgttaagaagattgcgaatgctttcgacaattatatggatgcaaagcggacgcttcgcgagattaagcttcttcgacatttggatcatgagaatatcatatctataaaagatataatcccaccgcctgttcgaagagagttcactgatgtctacatcactaccgagcttatggataccgatcttcaccaaattattcggtccaaccagaacttatcagaagaacattgtcagtacttcttgtatcaactcctacgcggcttgaagtacattcactctgcgaacgtcattcacagagacctcaagcctagtaatctgctgctgaatgcgaattgcgatctgaagatttgtgatttcgggcttgctagaacaagtgcggagaatgacttcatgactgaatatgttgtcaccagatggtatagggctcctgagttgctactcaactcttctgactacacagctgctatcgacgtgtggtctgttggttgcattttcatggaactcatgaacaagaagcctttgtttcctggtaaagatcatgtgcatcaaatgcgcatattaaccgagcttctgggtacaccaaccgaatctgatcttcggtttattagaaatgaagatgcacgaaggtatcttgcgcagcttcctcaacatcctcgacagtcattatcaacggttttcccacacgttcatccattagccattgatttagttgacaaaatgttaacgctagatccaactagacgaatcacagttgaagatgcattagatcacccttatcttgcaagactacacgatgtagccgatgagccaatatgtgcggatcctttctcgtttgaatttgagcaacaagttctgcgagaagaacaaattaaagacttgatttatgaagaggcgttagcacacaacccgggatttgcttagaagaaaacacttgggcatctcatggtattaatctatcgattatcatcatcataatcatcatgtgtttgttctccggtttaaatacgttgttttattattactatttggttcacgggtggtgttcagttttcggtttccttttggtaccttgtgatttctgctgttgagattgtaaactagatttttagaatgatgttctatttatgtattttgttgcataacatgttcttatgagcagaaatccagtttgtagttttgtacaaacacaaaattcgac

SEQ ID NO: 3507 - DNA, 1594 bp, Vinca minor
atatgagatacagttattgagattcatctgcataatttttggagtttttttttcttagttaattaattcaagcagaatacagatatttcatatggctgacgtcaatatgaccggaggattcccggaatttccagcggtggcgactcacggcggtcagtttattcggtatgatatttttggtaatctattcgagatcacccccaagtatcgcactccgatcatgccgatcggtcgtggagcttacggaatcgtctgctcggtgatgaatgtggaaacgaacgagatggtggcgattaagaaaattgcaaacgcatttgataatttcatggacgctaaacgtaccttgcgtgagattaagcttcttcgccatttggatcacgaaaacgtaattgctattagagatgtgattcctccaccgctgaggagggaatttagtgatgtctacattgctacagaacttatggatactgatcttcaccaaattattcgatctaatcaaaatctatccgaggagcattgtcagtatttcttgtaccaactccttcgaggactaaagtacatacattccgctaatgtcattcatagagatcttaagccaagcaatctcttgttgaatgcaaattgtgatcttaagatatgtgattttggtttagctcgtccaaacacggagaatgaattcatgacagaatacgttgtcactagatggtatagagcacctgagctgctactgaattcttcggactacactgctgctattgatgtgtggtctgtcggttgcattttcttggagcttatgaaccggaaacctttatttccaggaaaagatcacgtacatcaaatgcgcttgttgacacagcttctagggacaccaactgaatctgatcttggttttgtacggaacgaggatgcaaaaagatatatccggcaacttccacaattccctcgtcagcagctaacaagtgtttttccacatgtgaacccattggctatagatctcattgataaaatgctgacatttgatcctgctaagagaattacagttgaagaagcattagcacatccttaccttgaaaggttacacgacatagcagacgaacctgtctgcacaaagccattttcatttgactttgagcaacaaggaattggagaagagcagataaaggacatgatttaccaagaagcctcgactctaaatccagaatatgcataagaatctacgaatccctatttaacaaaagtaagagaattacttcctcttgctttggatctttttaatattgattggatgatcaggactacatcccaggaatcaagtttttttcgcggatcaatagtgataatattctttctacataaccactgttgatattaaccttctgctcattgaaggaggaatcgccctgacgaagcgctcatcttcttggttctgtaatactatttgtttgatttgtatctgtgaccagttcttaattaagagcttagacatttttcattttttttcttcttgtaacatcatcgtactttgtacacgagttttttaatactgagtgtaaccggatatgtaatgtaagttaactaagctgttgtattctgt

SEQ ID NO: 3508 - DNA, 1531 bp, Euphorbia peplus
acttacgagaatatttataaatcttatactttgtagcagaattagatcgatggctaacggtggccccggcggacagtacggggactttccggcggttccgtcacacggcggtttattcgttcaatataatattttcgggaatcagtttgaggttacatcgaaatatagacctccgattatgccgatcggtcgtggtgcttacggtatcgtctgctcggtactgaattcggagacgaatgagatggttgcggtgaagaagattgccaatgcttttgataatcagatggatgcgaaacgtacgcttcgggagatcaagctgcttcgtcatttagatcatgaaaacgttgtagctctcagagatgttattcctccacctttaagaagggaatttacggatgtgtacattgctacagagctcatggacactgatcttcatcagataatacggtccaatcaaggtttatcagaggagcactgtcagtactttttgtatcagattctgcgaggacttaagtacatacactctgctaatgtgattcatagagaccttaaaccaagtaatttgttgttaaatgcaaactgcgacttgaaggtctgtgattttggtctggctcggccaacttccgagaatgagtttatgacagaatatgttgtaactagatggtatagagcacctgagcttttgctcaactcgtcagaatacactgctgcaatagatgtgtggtctgttggttgcatctatatggagcttatgaatagaaaacctttattcccgggaaaagatcatgtgcatcagatgcggctattgacagagcttcttggcacaccaactgaatcagatcttggatttgtcaagaatgaggatgccaaaagatacataaggcaactcagtccttgtccacgtcagccactagcccaagttttcccacatgttaatcctctcgccgttgatcttattgacaaaatgttgacatttgatcccaccaaaagaattactgttgaagaagcattagaacacccgtatctagcaaggtttacacgacgtagctgatgaaccagtctgctcagatccattttccttcgattttgaacaacagccattgggagaagaacagatcaaggatatgatctacagtgaggccttagcgctcaatcccgagtatgcataatattgacaacaaagtaaagcttcagcaaacagatttgtttcatttattgtttcacaagcatttcgcttggatgcatttttttttatggaaaagacagctctggaagtcacagcaatcatcaagctgaacaacagagcctcaagatcacacggatcaaacgtctgaaattccacggttatcttgcgtatcagtcacttttttttaagggtatgctaagtttgtagacattgatgtctatcagttagttgtacactaactctaatttatgtaaagggcagtctagttccaatgtcatgaatgtttatgccctgcctatgactcagcttttcccttcctcctgtaagatatgtatttatttgcga

SEQ ID NO: 3509 - DNA, 1486 bp, Primula obconica
acccttttattatctcttaagacaaatatcatatcaaacacacatatatagagagagaaagaagggaacttggattagaatggcggatgttaaccaatacccggagtttccggcggtggtaacacacgggggtcaatttgtgcagtataacatcttcggaaatctattcgaggtcacacccaagtaccgccccccaatcatgcctatcggccgcggcgcttatggaattgtttgctcggtgttgaatgcggaaacaaatgagatggtggcgatgaagaagattgcaaatgctttcgacaactacatggatgccaaacgcacccttagggaaattaagcttcttcgccatttggatcacgaaaacgttataagccttagagatgtagtccctccaccactgaggagagaattttctgatgtttatattgccacggagctcatggacaccgatcttcaccaaataatacggtccaaccagaatttatctgaggaacactctcagtattttctgtaccagcttcttcgaggattaaaatatatccattccgcaaatgttattcacagagatttaaaaccaagtaatctgttgttgaactcgaattgtgatctgaaaatttgcgattttggtctagctcggccaacttcagagaacgagttcatgactgagtatgtagtcacaagatggtacagagcccctgagcttttactgaactctgctgattacactgctgctatagatatatggtctgtgggttgcgtatatatggagctcatgaatagaaagcctttatttgctggtagagaccatgttcatcagttgcgcttattaaccgagcttcttggcacgccaacagaagcagatttggggtttgttcggagtgacgatgcaaaaagatacatacgccaactcccgcagtttcctcgtcagagtttagcaaagctttttcctcatgtccatccactagccatagatcttgtcgataagatgctaacttttgatccctcaagaagaatcacagttgaggaagcattagctcatccttacctagaaaggttacacgacgttgctgacgaaccaatctgcacacacccattttcattcgattttgaacaagctttaggagaagagcaaataaaagatatgatataccaagaagctttattgctcaatccagagtacgcatgatttatttgttatatgtatctgcggaaccaaactaggcctgtgggtacttgttttaaaggtcacgtctgcagaggttctgctggcctcaaatttttatacgttctaataggttctttcgtttgtttatttctatttttttcccaatttctttggtgtttgtaatgttgtataatatcctcacgaatgtattgtaattgtaacagcaaaagttgcaactcctctgtttgagtcacgctagcttgacgatcatttttgtactactttaaaaaaaatccaatttacgagattgaattaaaccag

SEQ ID NO: 3510 - DNA, 1673 bp, Gossypium hirsutum
ccgcgcaggtgtatcaacgcagagtacatgggcaataagcaaagcagtaaaaagaaaaagtagcgaaatggctgacgtcgctccgggaaacgccggcggtcaatttggagattttccgacgattcatacacatggaggtcagtttattcagtataatatttttggaaatttgttcgaggtgacgtctaagtatcggcctccgatcatgccgatcggtcgtggagcctacggcatcgtttgctcggtgttgaattcggagacaaacgagatggttgcggtaaagaaaatcgccaacgcttttgataatcacatggatgctaagcgcacgcttcgtgagattaaactccttcgacatttggatcacgaaaacgttattggaatcaaagatgtgattcctccgcctttaaggagggaatttactgatgtttacattgcgactgagctcatggataccgatcttcaccaaatcattcgctctaatcagagtttatcggaggagcattgccagtatttcttgtatcaaattcttcgaggactgaagtacatacattctgccaatgtcattcatagagatttgaaacccagcaacctcttgctgaatgctaattgtgatcttaagatttgcgactttggtctcgctcggcctactgctgagaatgagtttatgactgaatatgttgtcacgaggtggtatcgggcaccggagatattgctaaactcttcagactacaccgctgccatagatgtctggtctgttggttgcatcttcatggagctcatgaataggaagcctctgtttccaggcaaagatcatgtacatcaaatgcgtttattaactgagctgctcggcacaccaactgaatccgatcttggatttctccggaacgaggatgcaaggagatatatcaggcagctcccagcacatccgcgccaatcactagcagaagttttcccacatgttcatccattggccattgatctcattgacagaatgttgacatttgatccgaccagaaggattactgttgaagaagcattggcacatccttacctcgaaagattacacgacatatctgatgaaccggtctgccccgaaccattttctttcgattttgagcagcaaccattgggagaagaacagatgaaggacatgatttaccaggaggccttggctctaaatccaacttatgcttaataacaaaatatagttctatcttctaaatccgtcatttcaagtaatgatttctacaataccttgtggtggctcatacaggccggtggattgcggattgagagatactttttgcctctgcaataatcttcgaagcggtgtcgctgagtctgcacccgtgactgccattgatgttaggctttcacgaggtcagtccacttgattaatttatgtttttctcctgatgtgcgtttatatgttatttgtttgatatcttatgcatgtataacatgcatttttatatgctgtatttggttagtgacctaggcaaaagatcctgttgtaacaaactagcaatgaaaattgacattatttgtataatttttgtccatcaaatgcaatttttttgagtgtttaacttacagttgatatgctgttgaataactttgccatacaacatcaagactccaaaggacaatcctgcccttttctttatttagta

SEQ ID NO: 3511 - DNA, 1627 bp, Fragaria vesca
aaacttctcaaccaactccaaaaccctctcaaagctcatttccacagatagagagagaaaagtcaactcaacactcagacatggctgaccacctcccctccggcaacggcgacttcccggcggttccgtcgcacggcggccagtacattcagtacaacattttcgggaacctcttcgagatcaccaacaagtaccgccctccgatcatgccgatcggccgcggcgcatacggcatcgtctgctcggtgttgaattcggagacgaacgagatggtggcgatcaagaaaatcgccaacgcttttgataatcacatggacgccaagcgcacgctccgtgagattaagctgcttcgtcatttggatcatgaaaatgtcgtagctattagggatgtgattcctccacctgttaggagggaattttcagacgtatacattgccgcggaactcatggatactgatcttcatcagattattcgctcgaatcaaggtttatctgaagagcattgtcagtacttcttgtatcagattcttcgaggactgaagtatatacattcggcaaatgttattcatagagacttgaagccgagcaacctgttgttgaatgctaactgtgacctgaagatatgtgattttggccttgcccgtccgactgctgagaatgagttattgactgagtatgttgtcactagatggtacagggcacctgagctattgttgaactcttctgactatactgcagcaatagatgtttggtctgtgggttgtatatttatggagcttatgaatagaaagcctctatttcctggcaaagatcatgtgaatcagatgcgcctactgacagagcttcttgggacaccaactgagtctgatcttgggtttgttcgaaatgaggatgccagaagatatattcgacagcttccccaatttcctcgtcagcaaatggtgaagcttttcccacatgttcatccattggccattgatttagtggatagaatgttaacatttgatcccactaaaaggataacagttgaagaagcattagctcatccttacctggaaagactgcatgacgtagctgatgaaccaatctgtactgttccattctcttttgattttgagcaacaatccttgggagaagagcaaatgaaagatatgatatacagagaggctatagcattcaatcctgagtatgcttgatacaataagcagaaatactgctcggttcttgtatttataaaatagatttggacttccactgctctttgatcagaaaggttatggtgatcaaactactccaagcatccgtgtgcattgtgttaaatagaaggctgccaatcaggtcaccgtgatcatcatgttccatctacatcattactcagatgggtttgctgattttaccactatgaccgcccatcaataatactagatgttttatattatttttgaggtcagttcctcttcttctggcagttgaacttgtattcaatttatcttgtttgtatcttaattttttttttctcttgcctttttctgtaagaaacttgtaccatgtatatcacgattggattgacgaacctaactgagattcaataatatcttctatttatttcttctggggctaatctgga

SEQ ID NO: 3512 - DNA, 1561 bp, Catharanthus roseus
attgaattagaaagagttatatagaaatggccgatgtcaatatggccggaggattcccggattttccagtgctcgcaactcacggaggtcagttcgttcagtacgatatttttggtaatttattcgagattaccaccaagtatcgacctccgatcatgccgattggccgtggagcttacggaattgtctgctctgtgttgaatgtggagacgaacgagatggtggcgattaagaaaatagctaacgcgtttgataatttcatggatgctaaacgtaccttgcgtgagattaagcttcttcgtcatctggatcacgaaaacataattgccataagagatgttattcctccaccattgaggagagaatttagtgatgtctacatagccacagaactcatggatactgatcttcaccaaataattcgatctaatcaaaatctatctgaggagcattgtcagtattttttgtaccaaatccttagagggctaaagtacatacattctgccaatgtgattcatagagatcttaaaccgagcaatcttttgttaaatgcaaattgtgaccttaagatatgtgattttggtcttgctcgtccaaacacggagaacgaattcatgacagaatatgttgtcactagatggtatagagcacctgagctgctgctcaattcttcagattatacagctgccattgatgtctggtctgttggttgcattttcatggagcttatgaacagaaaaactctatttcctggaagggatcatgtgcaccaaatgcgcttgttgacagagcttctagggacaccaactgaatctgatcttggttttgtacgaaatgaggatgcaaaaagatacatccggcagcttcctagattccctcgtcagcagttagcaagtgttttctcgcacataaacccattggctattgatctcatagacaaaatgcttacatttgatcctgctaaaagaattacagttgatgaagcactagctcatccttaccttgcaagattacatgatacagctgatgaaccagtatgttcagaaccattctcctttgattttgaacaacaagcatttggagaagagcagataaaggacatgatttaccaagaagccttggctctaaatccagaatatgcataagaaagaatctaaagaacacaagtaagagcatcatttcctcttgcttggatcttttcagagttaatggaatgaacaagactggttacacaaccacatcccaggaatcaatagcattgttaagattaaccatttggctcttctaggagcaatcgccctgacaaagagctcctcttcttcttgatttttgtactactatttatttttttatttgtagcttgctcttaagagcttgacatttctttctcttttcttttccttgtacgacattgtaccttgtacaggagttttatgtccttacccagatatgtaatgtaacttggaatccaatattgttatgtatgttttgtaaaatgaaatgctcttgaaataaatgacatgatgtggaggaatattgctgcaaaagaaaaaaaatcctc

SEQ ID NO: 3513 - DNA, 1616 bp, Prunus persica
caacaccacaacacaaacagcagcaacttctagagagagaagctgaagactagtagagagagaaattcaggtcacggactcgcacagtgtattgacatggccgacgtccctcccagcagtggcgatttcccggcggttccgtcgcacggcggccagtacattcagtacaacatcttcggcaacctcttcgagatcaccaacaagtaccggcctccgatcatgccgatcggtcgcggcgcgtatggcatcgtttgctcggttttgaactcggagacgaaggagatggtggcgatgaagaaaatcgccaacgccttcgacaatcacatggacgccaagcgcacgctccgggagattaagctgcttcgtcatttggatcatgaaaatgtcgtagctatcagggatgtcattcctccacctttgaggagagaattttcggacgtatacattgccacggaactcatggatactgacctccatcaaattattcgctcgaatcaaggtttatctgaggagcattgtcagtactttttgtatcagattctccgaggactgaaatatatacattcggcaaatgttattcatagagacatgaagcccagcaacctcttgttgaatgccaattgcgatcttaagatatgtgattttggcctcgctcgtcccactgcagagaatgagttattgacagagtatgttgttaccagatggtacagggcacctgagcttctgttgaactcttcagattacactgctgcaatagatgtgtggtccgtaggctgcatctttatggagcttatgaataggaagcctttgtttccaggcaaagatcatgtgcatcagatgcgcctattgacagagcttcttgggacaccaactgagtctgatcttgggtttgtacggaatgaggatgctagaagatatatacggcagctccccccgcatcctcgtcagccattggcgaggcttttcccacacgttaatccgctggccattgatctcattgatagaatgttgacatttgatcctactaaaaggataactgttgaagaagcattggctcatccttacctggaaagactacatgacgtagctgatgaaccaatctgcaatgagcctttctcctttgattttgagcaacaacccttgggagaagagcaaatgaaagatatgatttacagagaggctatagcactcaacccagagtatgcttgatttgaaaagcagcattactactcggtttctatatctatgaagtagaaagatttgcattttcagagctctttgataaaaaggttaggaaaggttattgttaccaaaatattgcaatcatcacgagcacaaggatcgtccacatcattacttaggtgggtttgctgattttttccatgatgaccgcccatcaattttactagacctctatattaatttttgaggtcggttcctcatttttctttttcggtgatcgaacttgtattctatttatcttgtttgtatcttgatttttttgtttttttgttttatttttttgctgtaccaaacttgtgccatgtatagcaagcttgtattgaggaacctaactgagattcaataaatatctttattcactccttgtgagacta

SEQ ID NO: 3514 - DNA, 1426 bp, Cynara scolymus
  misc_feature (730)..(731): n is a, c, g, or t
  misc_feature (758)..(759): n is a, c, g, or t
  misc_feature (1265)..(1265): n is a, c, g, or t
  misc_feature (1335)..(1335): n is a, c, g, or t
gggggggcgatttctatcttcttccggttctttccatcaacaaccccatctcatttcgtatatagactcacttcaaatctaattctctctctcaatctacactcgaattcgagctgaaattaacagataatatcgtcggaggtatatatatatttgccgtcggaatctgttacagtaaagtaatggcggacttaaacggaggagctcagtacacggactttccggcgatgccgacgtatggaggtcggtttgttcggtacaacatattcggtaatgaattcgagatcacatcaaaataccttcctcctattatgcctattggccgcggtgcttatgggattgtctgttcgatgctgaattcggagacgaatgagatggttgctatgaagaagattatgaatgcttttgataattacatggatgctaagcggacgcttcgtgggattaagcttcttcgacacttggatcatgagaatgttgtagctataaaagatgtagttcctccacctctacaaagagagttctcagatgtctacattgccactgagctcatggataccgatcttcaccaaattattcgatcaaatcaaattttcagaagacattgtcagtacttcttgtatcaactattgagaggattaaagtacattcactctgctaaagtcattcatagagacctcaagcctagtaatttgttgctgaatgcaaattgtgatttgaagatttgtgnntttggacttgcccggccaaatgcggannacgattttatgactgaatatgttgtcacgagatggtacagggcacccgagctgctactcaactcatcagactattcggctgccatagatgtgtggtctgttggctgtatttacatggagcttatgaacagaaaacctttgtttgccggtaaagaccatgtgcatcagatgcgactattaacagagcttttgggcacaccttgtgaatcagagcttgggtttatcaagaacgaggatgcaagaagatatatcgctcagcttccacgacatcctcgtaaatcattactaaagactttcccacatgttaatccatcagccattgatctggttgagaaaatgttgacatttgatccagccagacgtatcacagttgaagaggctctagaacacccataccttgaaagattacacgacattgatgatgaaccagtttgcgcgaatccattctcatttgatttcgagtaacaagttttaggagaacaacagatcaaggatttgatcttccangaggcattagcacacaatccagagtacgcgtaaaggattttactcacagtattcggatttagcaccgcanattcgtgctaaataaaatctgataattttttccatagtgatcaaccgccagaagtggatctgcaacatatatgtgtatattagctataaac

SEQ ID NO: 3515 - DNA, 1565 bp, Castanea mollissima
ttctctctctctctctctctctctctcaataccaagaaattctcacagagacagattgagacttcggaaacggctgatataacgcagaatatggcgggaaccggtcaatacggtgaatttccggcagtaccgactcacggaaaccagtttattcaatacaacatcttcggcaacctcttcgaagtcacggccaagtaccgccctccgatcatgccgatcggccgcggcgcgtacggtatcgtttgctcggtgttgaattcggagacgaacgagctggtagcgatgaagaaaattgcgaacgcttttgataaccacatggacgcgaagcgtacgctaagggagattaagctgcttcgccatttcgatcatgaaaatgttgtagctttaaaagatgtggttcctccacctttacggagagaatttactgatgtttacattgccacggaactcatggatactgatcttcaccaaataattcgttccaatcaaagcttatctgaggagcactgtcagtatttcttgtatcagattcttcggggcttaaagtttatacattcggcgaatgttattcatagagacttaaagcccagcaacctcctactcaatgcaaattgtgatcttaagatatgcgattttggtcttgctcgcccgactgcagagaacgagtttatgactgaatatgttgtcacaagatggtacagagcacctgagctgctgttgaattcttcagattatactgctgccatagatgtgtggtctgtgggttgcatctttatggagcttatgaatagaaagcctttgtttccagggaaagatcacgtgcatcagatgcgcttattgatagagcttctaggcacaccaactgagtctgatcttggttttgttcgaaatgaggatgcaagaagatatattcgccaactcccctcacaccctcggcagccattagctgcggttttttcacatgttcatccattggccattgatctcatagagaaaatgttcacatttgatcctactaaaagaattactgttgaagaagcattggcccatccttaccttgcaagattgcatgacatagctgatgaaccagtttgcccaaagccattttcctttgattttgagcaacaacccttgggagaagagcaaatgaaggatatgatttaccaggaggccttatcactcaacccagagtatgcataaataaaagcaacatttgttctcagttttatctcataatttgataagcctgtaagttactgggataatattgcaaccagaaatctaataggtcgcagattgtagaactgagatcctatttcatctgtgccatttctctggtgggtctactgatattacattacaccaacgactgcccatcatttgtactgggcttatgaatttaattttggggtcactttttatttattttttgtaccacttgtatttgcttattagatgtgtctgtatcttaattctatctgtgatatgctaaaactgtatttgtatagcgggttgaattgtaactaagtcggatttaatgaaaattacctattgttttgttcttc

SEQ ID NO: 3516 - DNA, 1705 bp, Eucalyptus grandis
gaaccagatggtcgcttcattacttaaactctccctccacccgctccacaacgatctccatcgccattacgtttctagagagagaaagtgaagagagaggatagaagagaagagagagagagagagagagagagcgctgaggaggttagaggtcatggctgacgccgcagctcagaacggccagttcagcgacttcccggcggtcccgacccacggcggccagttcatccagtacaacatcttcggcaaccacttcgagattacggccaagtaccggccgccgatcatgccgatcggccgcggcgcgtacggcatcgtctgctctgttctgaactcggagacgaacgagatggtggcgatcaagaagatagcgaacgcgttcgacaaccacatggacgccaagcggacgctccgcgagatcaagctgctccgccatctggaccacgagaacgttattggcattagagatgtgattcctcctcccctacggcgagaatttactgatgtctacattgctatggaactcatggacactgatcttcaccaaattattcgttcaaaccaaggcttgtcagaagagcactgtcagtacttcttgtatcagattctacgtggactgaagtatatccactctgcgaatgttattcatagagacttgaaacccagcaatcttttgctgaatgccaattgtgacctgaagatcattgactttggcctggcacggccaactgcagaaaatgaatttatgactgaatatgtggtcaccagatggtacagggcaccagaattgctgttgaactcttcagattatactgctgctatagatgtgtggtctgttggttgcatatttatggagcttatgaacagaaagcctttgttccctgggagggatcatgtgcatcagatgcgtttgcttgtagagcttcttggtacaccagctgatgccgatcttgggtttgtgcgaaatgaggatgcacgccgatacataagacagcttcctcagcatccccgtcaaccattggctagtgtttttcctcatgttcaccctttggccatcgatctggttgagaagatgttgacatttgacccaacaaagagaatcacagttgaagaagcactcgcccatccttatcttacgagattacacgacatagctgatgaacctgtgtgccgacaaccattttcttttgagtttgagcaacagcccttgggagaagagcagatgaaggacatgatatatcaggaggctatagcgctcaatccagagtttgcttgatgctgtttaaagtttctatggtggatgaggaactgcgaactaaagtggaaacagtgcagcgcaacgaaatgaagagttgcacatattcagaggcaaccgatctcgttgctttatttttccgtggagtaagtatgccgtaccacgaatactgatttgaggggagctttgctccacctgtcgaataaactttcttgattccttgaaacgccttttgtttttgcaatcggtgcttcttggcattcttttattagcttgtatttcactcaacgtgcttaatatcattttgttgtaacatttcacagtttgtaaatttgtactgcaagatgtattagtaagaagaactgtatttttttttatttttttggttcattgaaccgtgcttcagtttatgaatgctaatctgtatgtaacgcgcagagcagggcgcta

SEQ ID NO: 3517 - DNA, 1580 bp, Tropaeolum majus
cggccgggggctcttcgaagattaagataaataatctccctagctgtgattgttgtgttgattttgaagtgatacatcttagcatttaggagggaggaaatggttgatggaaacggtagcagtcagttctcggattttccgatggttgctacgcatggagggcagtacattcagtataacatattcggtaacatgttcgagattacatccaagtatcggcctccgatcatgcctataggccgtggagcatacggaatcgtttgctcggtgttgaatacggagacgaatgagatggtggcgattaagaaaatagcaaacgctttcgataatcacatggacgctaagcgtacgctacgcgagattaagcttcttcgccacttggatcatgaaaatgtaatagcaataagagatgtgattcctccacctctaaggagggaattcgttgatgtttacatgacaacggaactcatggatactgatcttcatcaaatagttcgctccaatcagggtctatcagaggagcactgtcagtacttcttgtaccagattcttagaggcctgaaatacatccattctgccaacgttattcatagagatctaaagcccagcaatctcttgctgaatgcgaactgtgatttgaaaatttgtgattttggtcttgctcgaccaacttcagagaatgagtttatgacagagtatgtcgtcacaagatggtatagggcacctgagcttttgctgaactcatcagactacactgctgctatagatgtgtggtctgttggctgcatatatatggagcttatgaacagaaagcctttattcccaggaaacgatcatgtacatcagatgcggttactgacagagctgcttggaacaccaacggaatctgatcttggttttacacggaacgaagatgcgaagagatacattcgtcaacttccggtccaccctcgtcaatcactagagagggttttccctcatgtccacccgttggccattgatcttgttgataaaatgttgacttttgatcctacaagaagaattactgttgaagaggcattagcacatccttaccttgcaagattacatgacatcgccgatgaaccagtctgtttagaaccgttctcttttgactttgagcaacaacctttgggtgaagagcaaatgaaagacatgatccatagggaggccctagcactcaatccagggtatgcttaaaaaaaatgacaaaataaaaatcttccgtcttggttattgttgcttgttatacaaggctacgcaatgtggttttagtgacggaaaatatgcacattcatatcttgctcttttaaaactattgggacgaggttgcagattgtgtgcccatcacttgtttaatttttttcatgtggtcagtcgtcatttccgaagcacgtttagccacataatgtttgttagtcttttgttcttttattcaaatatgtatcccgcttattgtgtctggatctttgggtgtgacaacctatttatgtactttgtgtgataaataatttcttttaatttttaatgtcgtttagaaaaaaaaaaaaaaaaaaaggccg

SEQ ID NO: 3518 - DNA, 2192 bp, Theobroma cacao
cgttgacagaactccatgaaatctcaaccgtggattagaggcggccgcgatctcagccctccatcaaacgcgtcctctgtttctcgcgcgttttccttcctccttcctcgaagctatgacgaagctctctcttaagctctcactaaaataccacaagaataataataataatttattcttccttttttctttttcccctatatataaaaaaccttagacttctcttcgattactcaaagagaaagcaaaaggaagaaaaaaaggagtcaaaaggagaacagtgaacaagtaaaaggtagcgaaatggctgaagttgttccggaaaacgccggtggtcagttaggagattttccggcgattcatacgcacggtggtcaatatattcagtatagtatttttggaaatttatttcagataacgtctaagtatcggcctccgatcatgcctatcggtcgcggagcctacggcatcgtttgctcggtgttgaattcggagacgaatgagatggtggcggtaaagaaaatcgccaacgcttttgataatcacatggacgctaagcgtacgcttcgtgagattaagctgcttcgacatttggatcacgaaaacgttattgcaattagagatgtgattcctccgcctttgcgtagagaatttactgatgtctacattgccacagaactcatggataccgatcttcaccagatcattcgctccaatcagggtttatctgaggagcattgtcagtatttcttatatcagattcttcgaggactgaagtacatacattctgcgaatgtgattcatagagatttgaaacccagcaacctcttgctgaatgcgaattgtgatcttaacatttgtgactttggtcttgctcgacctgctgctgagaatgagttcatgactgaatatgttgtcacgagatggtatagggcaccagagctgttgctgaactcttcggactacacagctgccatagatgtgtggtccgttggttgcatttttatggagctcatgaatagaaagcctctatttcctggcaaagatcatgtgcatcagatgcgtctattgactgagctgcttggcacaccaactgaatctgatcttgggtttctccgaaatgaggacgcaagaagatatctcaggcagctccctgcacacccccgccaaccattggcaaatgttttcccacatgttcatccattggctattgatctcatcgaaagaatgttgacatttgatcccaccagaagaattactgttgaagaagcattggcccatccttatcttgaaagattacacgacatagctgatgaaccagtcagtgctgagccattttctttcgactttgagcagcaaccattgggagaagagcagatgaaggacatgatttacaaggaggccatagctctgaatccaaattatgcttaatcaaatatacttttcctgtttggtatcgatagatacttctatcctctaaatgccccagttcaagtaatgtttggcgaaaaagtttgcggtggctgacagatagcgaccagaatatgctggtgggatgcgaactgagacatcctatttttgcatctgcaatttctttgggttggctttgctgagattgcacccatgactgcccattgattttagttttcatgaggcgagtccctcgcaagcttcacaagccacaacacttcgtaaatttgtgttgtctccacttctgatatgtgtttatttgttatttgtttaatctcttctgaccgtatcaaatgctttttttttttgtgtgtgttgtattttattctagtgtaacccacgcaaaacatcctgttgtaacaaatatcagtaattccgttattctgtacaacatcgtcaatcaactcgagttttgtatgtcaaaattcatgttgagtcaaagttgatatactgttgaatgtctttgccatacaacctcttctgttgttgcaacgaccaagaacaagaacaagaataagaacaagcctgccttctatttcttttgttgggtattgatagtgctgcctgcttacttcgctgtcacctcaccatattttcacagtatagcatagagtcagtatcttggtcgctttcacaaataattcaagctcaatgattagatacatatcaaattttgacaaacccctatccttatccagtctcaatgaaatgaagatattcga

SEQ ID NO: 3519 - DNA, 1602 bp, Vitis vinifera
aaacatcagtagagagagaaagtgggagaaggtagagagagaaggggagctgcaacaagtgagtatagaaatggctgacaatacgaggaactccaccggcggtcaattaagtgattttccggctgttccgacacatggaggtctgtttttccaacacaacatcttcggaaatctctttgagatcacagcgaagtatcggcctccgatcatgccgatcggtcgtggcgcatacgggatcgtctgctcggtgttgaattcggagacgaatgaaatggtagcaatcaagaaaatagcgaacgccttcgataatcacatggatgcgaagcgtacgcttcgggagattaagcttcttcgccatttggatcacgaaaacgttataggtataagagatgtagtccctcctcctttaaggagagaattttctgatgtctacattgccacggaactcatggacactgatctgcaccaaataattcgctccaaccaaggtttatcagaggagcactgtcaatacttcttgtaccagatacttcgtggactgaaatatatacactccgcaaatgtgattcatagagatttgaagcccagcaacctcttgctgaatgcgaattgtgatctaaaaatttgtgattttggtcttgctcgtccaactgcagagaatgagttcatgacggaatatgttgttacgagatggtacagggcacctgaactactgctgaattcttcagattacactgctgcaattgatgtctggtctgtgggttgcatttttatggagcttatgaacagaaggcctttatttgcgggtaaagaccatgtgcatcaaatgcgcttattgacagagcttcttggcacacccactgagtctgatcttgggtttgttcggaatgatgatgcaagaagatatatcatgcaactcccccaacatccccgccagccattagtaaacgttttcccacatattcatccactggccattgatctcattgatagaatgttgacatttgatccgactaaaagaattactgttgaagaagcattagcccatccttacctttcaagattacatgatacagctgatgaaccagtttgcccagagccattttcctttgaatttgagcaacaagctctggtagaagaacagatgaaggatatgatttaccaggaggctttatttttcaatccaggttacgcttaatacaaatgaagcatccacccatccggtgaatctccaagtgggagtgttatataactaaaaataaaaacactactgtgatttgaaggttgcacccagtagaggaaactcggacaagacagtaaaaaagaaaaaaaaaaggcagtttgtagacaaaaaattgagaatattctgcctattgtgcgtcttgtgactgttcatcaggtggactaggccttgctgttaattttataaggtcagtccattcccttggtttattatgtattttgctttcatgtgtttgagagatatgtgctctcgttttcctttttttcttctgtaccatgtgcacatgtgtagaagattggatgagtgtaagcgttaagcacattaatgaaattaacctattattttgttcttcagattca

SEQ ID NO: 3520 - DNA, 1725 bp, Malus domestica
cacaattctgtctggcgcgcttcttcttcttcttcttcttcctcccctcggctttaaaagcttctcctctcttcttcgtcaactcctccaccaccaccgactcaacgcatcagcagcaaatttctagagagagaaaactgaagactcctagagagagaaagtcacgtctcggacttgaacagtatttcgaaatggccgacctcactccctctaacggcgatttcccggcggttccgtcccacggcggccagtacatccagtacaacatcttcggcaacctcttcgagatcaccaacaagtaccgccctccgatcatgccgatcggccgcggcgcctacggcatcgtctgctcggttttgaattcggagacgaaggagatggtggcgatcaagaaaatcgccaacgctttcgacaatcacatggacgccaagcgcacgctccgcgagattaagctgcttcgccatttggatcacgaaaatgtaatagctatccgggatgtgattcctccacctctaaggagagaattttcggatgtgtacattgccacggaactcatggataccgacctgcatcaaattattcgctcgaatcagggtttatcggaggagcattgtcagtacttcatgtatcagattcttcgagggctgaaatatatacactcggcgaatgtcattcacagagacttgaagcctagcaacctcttgttgaatgctaattgcgatcttaagatatgtgattttggcctcgctcgtccgactgcagagaatgagttattgacagagtatgttgtgacgagatggtacagggcacctgagcttctgttgaactcttcagactacactgccgctattgatgtgtggtctgtgggttgcatctttatggagcttatgaataggaagcctttgtttccgggcaaagatcatgtgcatcagatgcgcctattgacagagcttcttgggacaccaactgagtctgatcttgggttcgttcggaatgaggatgctagaagatatataaggcagctcgcccagcatccccgtcaaccattggagaggcttttcccacatgttaatccaatggccattgatcttgttgacagaatgttgacatttgatcctactagaaggataactgttgaacaagctttagctcatccttacctggaaagactacatgacgttgctgatgaaccaatctgcactgagccgttctcctttgatttcgagcaacagcccttgggagaagagcaaatgaaagatatgatttacagagaggctattgcactcaatccagagtatgcttaatatgaaaagcagcattgctcgatttctatatcgacaaagtagaaagacttggacttgcagtgctctttgatcaaaaaggttattgtgatcaaaatattgcaatcatcagcgagctttgtgttcgaagatttagtaggctgctgatcaagtaaccatgatcgtcctatttcattacttaggtgtgtgctgattattcaacaatgattgcgcgtcgattttaatagacctctatattatttttgagatcagttcctctttgttctttccttttggcggttgaacttgtattctatttatcttgtttgtatctttatattttttcggtttttttgctgtaccaacttatcatgtatagcacgattgtattggcggacctaactacgattcaataaatacctttatttattccttgtgagggtaa

SEQ ID NO: 3521 - DNA, 1461 bp, Brassica napus
tcttctcatttcagtccctcatctaactgtaatataattatatatataaaggagtcacacaataccttcagattcactatacctcaaagcacaacaagtcaagcttgaagttgacttagcgcgtcatcgattgaaagagagagagagagagagatgaacaacgccggcggccaatatccagattttccggcggtgcagacgcacggaggacagttcataagctacgatatcttcggtagtttattcgaggtcacatccaagtaccgtcctccgattgttccaatcggtcggggcgcatacggcatcgtttgctctgtgttggattcggagacgaacgagcttgtggcgatgaagaagatagccaacgcctttgataatcacatggacgccaagcgtacacttcgcgagatcaagcttcttcgtcatctcgatcatgaaaacatcatagctataagagatgtggttcctccaccacttagaagagagttcagtgatgtttatatcgccactgagttaatggacactgatcttcatcaaatcatcagatccaaccagggcttgtctgaggaacactgtcagtacttcctgtaccagcttcttcgagggctcaagtacatccactcggctaaagttatccacagggatctaaagcctagcaatcttctcctgaacgccaactgcgatttaaagatctgtgattttggtcttgctagacccacttcagagaacgagtttatgactgagtatgttgttaccagatggtatagagcacctgagcttctgctgaactcatccgattacactgctgctatagatgtttggtctgttggttgtatctttatggagctcatgaacagaaagcctttgttccctggtaaagaccatgtccatcagatgcgcttattgacagagttgcttggcacgccgacagaatcagatctcgggtttacacacaacgaggatgccaaaagatacatccggcagcttcccaacttccctcgccaaccgttagctaaactgttctctcatgttaacccattggccattgatctagttgacagaatgttgacgtttgaccccaacaaaagaatcactgttgaagaagctctgaatcacccgtacctagccaagttgcacgacccgaatgatgagccaatctgtctaaagccattctctttcgactttgaacaacaacctctagacgaggaacagataaaagagatgatctacagggaagccattgcactcaatccaacatatgcttagaagagcagcaaccgaatgaatggccaaatatcctgccctctagcatctttgcttgttcttttattcatgtaccttttttccatgtgtaatcctatttgtttgtttaacattgtattactgctagtgagtgagtgcatgtagctctcatgtaaaagtactccagctacgaaatatttacttcacaaaaaaaaaaaa

SEQ ID NO: 3522 - DNA, 1670 bp, Humulus lupulus
ttttcctaatctccagtctccgaagacttctagagagaaaaagaagaaaataagagagagagagagacaagagaactctcgtacggacacaatatggttgatgccactcataacaatggtcccggtgccggccccggaggccaatacacggattttccggcgattccttcccatggaggtcagtacattcagtacaacatatttgggaacttattcgaaatcacctccaaatatcggcctccgattatgccaattgggcgaggagcatatggtattgtttgctcggtgttgaattcggagacgaatgagatggttgctatgaagaaaatagccaacgcttttgataatcatatggatgccaagcgtacgcttcgggagattaagctgcttcgtcatttggatcacgaaaatatcgtagctataagggatgtgattcctccacctttgcggcgagaatttaccgatgtctacattgcaactgagttgatggacaccgaccttcaccaaattattcgttcaaatcaaggtttatcagaggagcattgtcagtacttcttgtaccagattcttcgagggctgaagtacatacattctgctaatgttatacacagggacttaaaacccagcaaccttttgctgaatgcaaattgtgatcttaaaatatgtgattttggtcttgctcgtcccaccgcggaaaatgagtatatgacagaatatgttgtcaccagatggtacagggcccctgagttattgttgaactcttcagattatactgcttcaatagatgtgtggtctgttggttgcatatttatggagcttatgaataggaagcctctgtttccaggcaaagaccatgttcatcagatgcgcttattgacagagctcctaggcacaccaacagagtcagatctcgggttcattcgaaatgaagatgctaaaagatacatacggcaactcccctcgttccctcggcaacagttaggcagggctttcccacatgttcatacactggccatagacctcatcgagaaaatgttgacatttgatccaaatagaagaattactgttgaggaagctttggcccatccctatttgacaagactgcatgatgttgctgatgaaccagtctgcccaaatccattctcgttcgaatttgaacaacaacctttgacagaagaacaaatgaaagacatgatctaccaggaagctattgcacttaatcctcagtatgcttaataatgtgaaaaaagggtattccatgcttaggatggtctatgtaatgcttaatttgccactctgcgagtctttttttttcttttgttaaatattaagaatgatacaactgcagtcccaaaggttgcaagtaccaatatgatatctagcttgcgtgtcgatcaactgtatccttgagtgtttgatccattttgttaggttgattccctcatcttttccaaaatcctttttgtgcttgttatccccctatgtttgttaaagaaaaaaaagagttgggtcagtttttctttgacctgtgacaagggtagtcaatgccaaacgttggtcgataaccgtggataaagaactattggtactatccctagttttatttttccttgaaatcttaatgtatttgttgtatggattgatgtactaaaattgttatgtatataata

SEQ ID NO: 3523 - DNA, 1576 bp, Brassica rapa
gagagatagaagtagaactgtaaaggacgtcgggaggaagaccgttgacgaagtcaaaaccgaacagcaaccgtcgatctgaggcggctcaaatctcatccacacaatcttcccatctcccttcttcttccgcgcagttaccgcgaaaactcatctgaaactcgtcttctcatttcagtccctcatctaactgtaatataattatatatataaaggagtctcacacaataccttcagattcactacacctcaaacacacaacaagtcaagctttgaagttgacttatcgcgatgaacaacgccggcggccaatatcctgattttccggcggtgcagacgcacggaggacagttcataagctacgatatcttcggtagtttattcgaggtcacatccaagtaccgtcctccgattgttccaatcggtcgaggcgcatacggcatcgtttgctctgtgttggattcggagacgaacgagctagtggcgatgaagaagatagccaacgccttcgataatcacatggacgccaagcgtacacttcgcgagatcaagcttcttcgtcatctcgatcatgaaaacatcatagctataagagatgtggttcctccaccacttagaagacagttcagtgatgtttatatcgccactgagttaatggacactgatcttcatcaaatcatcagatccaaccagggcttgtctgaggaacactgtcagtacttcttgtaccagcttcttcgagggctcaagtacatccactcggctaaagttatccacagggatctaaagcctagcaatcttctcctgaacgccaactgcgatttaaagatctgtgattttggtcttgctagacccacttcagagaacgagtttatgactgagtatgttgttaccagatggtatagagcacctgagcttctgctgaactcatccgattacactgctgctattgatgtttggtctgttggttgtatcttcatggagctcatgaacagaaagcctttgttccctggtaaagaccatgtccatcagatgcgcttattgacagagttgcttggcacaccgacagaatcagatctcggttttacacacaacgaggatgccaaaagatacatccggcaacttcccaacttccctcgccagccgttagctaaactgttctctcatgttaacccgttggccattgatctagttgacagaatgttgacgtttgaccccagcaaaagaatcactgttgaagaagctctgaatcacccttacctagccaagttgcacgacccgaatgatgagccaatctgtctaaagccattctctttcgactttgaacaacaacctctagacgaggaacagataaaagagatgatctacagggaagccattgcactcaatccaacatatgcttagaagagcagcaaccgaatccgaatcgctaccccctagcatctttgcttgttcttttattcatgtaccttttttttccatgtgtaatcctacttgtttgtttaacattgtattactgctagtgagtgagtgcatgtagctcttatgtaaaagtactccagctatgaaatatttt

SEQ ID NO: 3524 - DNA, 1268 bp, Actinidia deliciosa
  misc_feature (361)..(361): n is a, c, g, or t
  misc_feature (389)..(389): n is a, c, g, or t
  misc_feature (423)..(423): n is a, c, g, or t
  misc_feature (458)..(458): n is a, c, g, or t
  misc_feature (670)..(670): n is a, c, g, or t
  misc_feature (1209)..(1209): n is a, c, g, or t
  misc_feature (1234)..(1234): n is a, c, g, or t
agagagagagagaatctagagacgatagagaaatcagagaaagaaaagcagagtttctagagcgagagagtcaatggccgacgtcaattcggccgatttcccggcggttgcggttcacggaggacagttcattcaatacaacatcttcggcaatctgtttgagataacgaccaaataccgggcgccaatcatgcctattggccgcggtgcttatggaattgtctgctctgtgatgaattcggagaccaacgagatggtggcaatcaagaagatcgctaatgctttcgacaactacatggatgcgaagcgtacgctgagggagatcaagcttcttcgccatttggatcatgaaaatgtcatnaccataaaagatgtagttcctcccccantgcggagagaattttccgatgtctacattgccanggaactcatggacaccgatcttcaccagataattnggtctaatcaaggtttatcagaggaacactgtcagtatttcttataccaaatcctcagaggactgaaatacatacactctgcaaatgtcatccatagagatctgaaacccagcaatctcttgttaaatgcgaattgtgatctgaagatctgcgatttcggccttgctcggccaacttcggagaatgagttcatgaccgagtacgttgtcacncggtggtacagggcacccgagctcttgctgaactcttcagagtacactgctgctatcgatgtgtggtctgtgggttgcatctttatggagctcatgaacagaaagcctttgtttcccggtaaagaccatgtgcatcagatgcgcttgttgacagagctccttggcacacccaccgaatcggatctcgggttcgttcgaagcgaagatgcgagacgatacatccgtcagcttccccgacaccctcgccagcagttaactagggttttctcacatgtccatccgttggccattgatctcgtcgataaaatgttgacttttgatcccaccagaagaattacagttgaagaagcattggcacacccctaccttgcaagactacacgacatagcggacgaaccggtctgccccgagtcattctcctttgattttgaacaagccatgggagaggagcagataaaggatatgatttaccaggaggctttatcactcaatccagagtatgcataaacgaaaaatttaagaaccgactcccttatcgnatttttttttatatatatatatcanaaaacaagtctaaaagcctaaattatgcttgatg

SEQ ID NO: 3525 - DNA, 1574 bp, Raphanus sativus
  misc_feature (1042)..(1042): n is a, c, g, or t
ggatctaaaactcatttcagtctctcaatctaagtgtactatattatatataaaccgagtcacacaccaccctcagagatggactacaccacctctcaaagcacaacaacagagtcaaagctttgaagttgactaagcgcgtgatcgatcgatcgatttagagagagagagagagagagagagagagagagagagagagagagagagagagatgaataacgctggcggccaatatccagagtttccggcggtgcaaacgcacggaggacagttcataagctatgatatcttcggtagtttattcgagatcacatccaagtaccgtcctccgattgtaccaatcggtcgaggcgcatacggcatcgtttgctctgttttggattcggagacgaacgagctagtggcgatgaagaagatagccaacgcctttgataatcacatggacgccaagcgtacacttcgcgagatcaagcttcttcgtcatctcgatcatgaaaacatcatagctataagagatgtggttcctccaccacttagaagacagttcagtgatgtttatattgccactgagttaatggacactgatcttcatcaaatcatcagatccaaccagggtttgtctgaggaacactgtcagtacttcttgtaccagcttcttcgagggctcaagtacatccactcggctaaagttatccacagagatctaaaaccgagcaatcttctcctgaacgcgaactgcgatttaaagatctgtgacttcggtcttgctcgaccgacttcggagaacgagtttatgaccgagtatgttgttaccagatggtacagagcacctgagcttctgttgaactcatcggattacactgctgctatagatgtttggtctgttggttgtatctttatggagctcatgaacagaaagcctttgttccctggtaaagaccatgtccatcagatgcgcttattgacagagttgcttggcacgccgacagaatcagatctcgggtttacacacaacgaggatgctaaaagatacatccggcanctccccaccttccctcgccagccgttagctaaacttttctctcatgttaacccattggccattgatcttgttgacagaatgttgacttttgaccccaacaaaagaatcactgttgaagaagctctgaaccacccgtaccttgccaagttgcacgacccaaatgatgagccaatctgtctaaagccattttctttcgactttgaacaacaacctctagatgaggaacagataaaagagatgatctacagggaagccattgcactcaatcctacatatgcttagaagagctgcaaccgaatgaatggcatttattttacccaaactatccatccgaatcgctgccccctagtgtctttacctgttcttttattcatgtactttttacatgtgtactcttgtaatcctatttgtttgtttaagtgctgtattactgctagtgagtgagttgcatgtagctctaatgtaaagaactccagctatgaaataatttcttcacattttctgacttcaaatgcgaggacaataaggaata

SEQ ID NO: 3526 - DNA, 1390 bp, Citrus sinensis
actcgagaaaaacacaaccacaaacgagagcgtagaaaattaattagagagaaaaagagagagagtaaaatggctgacgtggcgcaggtcaacggcgtaggtcaaacggctgattttcctgcggtaccgacgcacggcggtcagtttatacagtacaatatatttggaaacttgtttgaaatcacggccaagtatcggcctccgatcatgccgattggtcgcggcgcgtacgggatcgtttgctcggtgttgaatacggagacgaatgagctcgttgcgatgaagaaaatagcgaacgcttttgataatcacatggatgccaagcgaacgcttcgtgagattaagcttctgcaacatttggatcatgaaaatgtgatagctgtaaaagatgtggttcccccaccgttacgaagagaattcactgatgtctatattgctgcggaactcatggacactgacctttaccaaattattcgctcaaatcaaagtttatccgaggagcactgccagtatttcttgtatcaacttcttcgaggactcaagtatatccattcagcaaatgttattcatcgggatttgaagcccagcaatctcttgttaaatgcaaattgtgatttaaaaatttgtgattttggtcttgctcgtccaacctcggagaatgagttcatgacagagtatgttgtcacaagatggtaccgagcccctgagttgttattgaactcatctgactacactgctgcaatagatgtgtggtctgttggctgtatatttatggagcttatgaacagaaggcctctgttcccaggaaacgatcacgtgcatcagatgcgcttattgatagagcttcttggaacaccaacagatgctgatctggggtttgtccgtaatgaggatgcaaaaagatatatacgacaacttccccaacatcctcgtcagtcgttagcccaagtttttccacatgttcatccactggctattgatcttgtagacagaatgcttacatttgatcccatgaagagaattactgttgacgaagcactagcccatccttatcttgcaagattacatgatgaagccgatgaaccggtctgcccagagccattttcttttgattttgagcaacaaagcctgggagaagagcaaataaaggacatgatttatcaggaggcattagcactcaatccaggatttgcttaataaaataaacagcactggtgctccgttttaatattcactatttgtttgtaattccattaattcaagtgttgctcggatgaatagatgactttgaagccttgaagcactgcagttggccgacaaatgttattttttcccttgttgtattattaatctgttgtaaaataataaaattcagaattatatttttttg

SEQ ID NO: 3527 - DNA, 1465 bp, Citrus clementina
atactcgataaaaacacaaccacaaacgagagcgtagaaaattaattagagagaaaaagagagagagtaaaatggctgacgtggcgcaggtcaacggcgtaggtcaaacggctgattttcctgcggtaccgacgcacggcggtcagtttatacagtacaatatatttggaaacttgtttgaaatcacggccaagtatcggcctccgatcatgccgattggtcgcggcgcgtacgggatcgtttgctcggtgttgaatacggagacgaatgagctcgttgcgatgaagaaaatagcgaacgcttttgataatcacatggatgccaagcgaacgcttcgtgagattaagcttctgcaacatttggatcatgaaaatgtgatagctgtaaaagatgtggttcccccaccgttacgaagagaattcactgatgtctatattgctgcggaactcatggacactgacctttaccaaattattcgctcaaatcaaagtttatccgaggagcactgccagtatttcttgtatcaacttcttcgaggactcaagtatatccattcagcaaatgttattcatcgggatttgaagcccagcaatctcttgttaaatgcaaattgtgatttaaaaatttgtgattttggtcttgctcgtccaacctcggagaatgagttcatgacagagtatgttgtcacaagatggtaccgagcccctgagttgttattgaactcatctgactacactgctgcaatagatgtgtggtctgttggctgtatatttatggagcttatgaacagaaggcctctgttcccaggaaacgatcacgtgcatcagatgcgcttattgatagagcttcttggaacaccaacagatgctgatctggggtttgtccgtaatgaggatgcaaaaagatatatacgacaacttccccaacatcctcgtcagtcgttagcccaagtttttccacatgttcatccactggctattgatcttgtagacagaatgcttacatttgatcccatgaagagaattactgttgacgaagcactagcccatccttatcttgcaagattacatgatgaagccgatgaaccggtctgcccagagccattttcttttgattttgagcaacaaagcctgggagaagagcaaataaaggacatgatttatcaggaggcattagcactcaatccaggatttgcttaataaaataaacagcactggtgctccgttttaatattcactatttgtttgtaattccattaattcaagtgttgctcggatgaatagatgactttgaagccttgaagctctgcagttggccgacaaatgttattttttcccttgttgtattattaatctgttgtaaaataataaaattcagaattatatttttttgttcatcgtatcgaattccattcaataatctcatgcgttgatgaaccgatacaaaaattgaaattgttttaacc

SEQ ID NO: 3528 - DNA, 1623 bp, Quercus alba
ctctctctctctctcaatttcaataccaaaacttcatatttaaacccctctcactacctttgaattcttcatattctctctgtcaatactcaatactaagaaattctcacagagagagattgagacttcgaaaatggctgatataaatcagaatgtggcggcgaccggtcagtacggcgaatttccggccgtgcagactcacggaggtcagtttcttcaatacaacatcttcggcaacctcttcgaagtcacggccaagtaccgccctccgatcatgccgatcggccgcggcgcgtacggtatcgtttgctcggtgatgaattcggagacgaacgagatggtagcgatgaagaaaattgcgaacgcttttgataaccacatggacgcgaagcgtacgctaagggagattaagctgcttcgccatttcgatcatgaaaatgttgtagctttaagagatgtggttccgccacctttacgaagagaatttactgatgtttacattgcgacggaactcatggatactgatcttcaccaaataattcgttccaatcaaagcttatctgaggagcactgtcagtatttcttgtatcagattcttcgggggctaaagtttatacattcagcgaatgttattcatagagacttaaagcccagtaacctcttactgaacgccaattgcgatcttaagatatgtgattttggtcttgctcgcccgactgcagagaatgagtttatgaccgaatatgttgtcacaagatggtacagggcacctgagctactgttgaactcttcagattatactgctgccattgatgtgtggtctgtgggttgcatctttatggagcttatgactagaaagcctttgtttccggggaaggatcacgtgaatcagatgcgcttattgatagagcttctaggcacgccgagtgagtctgatcttggttttgttcgaaacgaggatgcaagaagatatattcgccaactcccctcacaccctcggcagccattagctgcagttttttcacatgttcatccattggccattgatctcatagagaaaatgttcacatttgatcctactaaaagaattactgttgaagaagcattggcccatccttaccttgcaagattgcatgacatagctgatgaaccagtttgcccaaagccattttcctttgagtttgagcaacaacccttgggagaagagcaaatgaaggatatgatttaccaggaggccttatcactcaacccagagtatgcataaattaaagcttttttctcagttttatctcataagttgataagcctgtaagttactgggataatattgcaaccagaaatctaataggtcgcagattgaggaactgagatcctatttcatctttaccatttctctggtgggtctactgatattacattacaccaatgactgcccatcagttgtactgggcttatgaatttaattttggtgtcagtttttatttattttttgtaccacttgtatttgcttagatgtgtctgtatcttaattatatctgtgatatgctaaaacagtatttgtaaagcgggttgaattgtaactaagtcggatttaatgaaaattacctattgttttgttcttca

SEQ ID NO: 3529 - DNA, 2001 bp, Populus trichocarpa
gagagacaagaaagatggccgttgacaaagttgaacaaactacaaccatggataagaggcggctgtaatccaagccgtccattcctttttcctcaccacgtcagttttttctctcgcgcgttttcctttctccttcctcgcatctactcaacaaccgagactttgcatttctccaccgctttcgcaccttaaaacaatcacaaaaagtcaatttctttctaagtctttgttttctctcttatataaatctctctctctactctctatttcctcacacctcaattatattagagtttactcagacaacagaaaagaaaccgaggacatggcgaattatgcacagggaaatggtgacttccccgcgattccgactcacggcggccaattcattcaatacaatattttcggtaatctttttgaaatcacgtcgaaatatcgacctccgatcactccgattggtcgtggtgcctacggcatcgtctgctctgtgttgaattcggagacgaacgagatggtggcggtgaagaagatagccaacgcgtttgataatcaaatggacgccaagcgcacccttcgtgagattaaactgcttcgccatttggatcacgaaaacgttattggtatcagagatgtcattcctccacctctacgcagagaatttactgatgtctacattgccatggaactcatggacactgatcttcaccaaattattcgttccaaccaaggtttgtcagaggagcattgtcagtacttcttgtatcagattcttcgaggactgaaatatatacactctgctaatattatccatagagatctcaaacccagcaatttactgctaaatgcaaattgtgacttgaagatatgcgattttggtctagctcggccaacttcggagaatgagtttatgacagagtatgttgtcaccagatggtatcgtgcacctgagttattgctcaactcctccgactatactgctgcaattgatgtgtggtctgtaggttgcatctttatggagcttatgaatagaaaacctctgtttccaggcaaagatcatgtccatcagatgcgcttattgacagagcttcttggcaaacccactgaatctgatcttggttttgtccggaatgaggatgcgagaagatacatccagcaactcgactcgcatccccgtcggtcattagctgagcttttcccacttgttcaccctctggccattgatcttatagataaaatgttgacattcgatcccactaaaagaattactgttgaagaagcattggctcatccataccttgcaagattacatgacatagcagatgaaccagtctgcttagagcctttctcctttgaatttgagcaacaacccttggcagaagagcaaatgaaggatatgatctatgaggaggctttagcacttaatccagaatatgcatgctagagaaggtatttgtaatatccagttttttattcatttattgatgttccataagcactaccagtcccgatgtcatttgatggagagcaagtttgaacatgacgccatgggatcacagtcacagttgattaaacaagatatatcttccttcgatggtcttcagcactcctctgtatctgaaaattgatccttggcttactaattgttcaccccatcatttccacgacctttatatttaatgttctcgaggtcgatcacttcgcatttgcaacacttgtaaaccctacaaccttaatctgactcagttttttcttttcttcctgtcttttctttatgtccttcctggtttagatctttttaaagtttatctcttgtaacatgtctttgtctgttttccaatgaaaatctattgttaatgtgatgcataattttttatctggttgaaagtaattcgtacttaatacgtgggttgccttttcttttaatgtatagaattttataaattagaattaatagagtgaggatatgcatccaatgtaactgttgggaattttattttaaaa

SEQ ID NO: 3530 - DNA, 1822 bp, Carica papaya
tccttctcggttgggttcttctctccctctttcctcgcagctactgtgaactccagacgaatactccgatctatttccacgcgcgaacgtaagaaataattaacaaatcaatctcctctatcaacgtatatatatatatatattataaatatacaccatagtagatagtcaacatagaaggggacaaggaagaagagagctcaaaacagagaagacagttttcttgcgtgtctggagatactacagagaggggagaaatggttgatgcaaactctggaggtcaggattttccggcgattcccacccatggaggtcagtacattcagtacaacatattcggcaatctttttgagataacttccaagtatcggcctccgatcatgcctatcggtcgcggcgcgtacggtatcgtttgctcggtgtataattcggagacgaatgagatggtggcgattaagaagatagcaaacgcgtttgataatcacatggataccaagcgtacgcttcgtgagatcaagcttcttcgccatttggatcatgaaaatgtcgtaggtataagagatgtgattcctccaccattaagaagagaattcacagacgtgtacattgcaacggagctgatggatactgatctccataacataattcgatcgaatcaaggtttatcagaagagcactgtcagtacttcttgtatcagattcttcgagggctgaaatatattcactcagctaatgttatccacagagacttaaagcccagcaatcttttggtgaatgcaaattgtgatttgaaaatttgtgattttggtcttgctcgaccaactgccgagaatgagtttatgacagaatatgttgtcacaagatggtatagggcccctgagatattgctgaattcttcagattatactgctgctattgatgtgtggtctgtcggttgcatctttatggaacttatgaacagaaaacctttgtttccaggcagagatcatgtgcatcagctgcgcttattgacagagctgcttggcacaccgactgaatctgatctggaatttgttcggaatgaggatgcaaaaagatatatccgtcaactcccaacacaccctcgtcagccactagccagacatttcccaaatgttcatccatcagcaattgatcttgttgatagaatgttaacatttgatccaagaaaaagaattactgttgaggaagcattagctcatccttaccttgcgcgattgcacgacattgctgatgaaccagtttgttcagagccattctcttttgatttcgagcaacaacctttgggagaagagcagatgaaagatatgatttatcaggaggctttagcactcaatccagaatatgcttgaaaaaggagacaacaaacactgaaaccagaacctacaacaccacatgatgtctcgcaatcaaacaattaacatcctcctgttttgttcaacttatattgtaatattttgggcttgcccaattctggctgtcctagttctcttgaggtcagtctcttgaagctctataagttctttaacctttgtactcagtctttttggttcttctgttcaggcgaatgtttgttataatgtgtttaaatttggtattttctcccactgtattataaacacttttgtgaagtgatgtaacctaagattgatttattgtaatactgacttgaaatcttgttgtaaaatggttttattagaatcaccttttgtctcgttcatcaaatcagtctcattcgagaatgattatcttatgttcactgtggtgtacaatattaataatatcatctttgttacacaagtga

SEQ ID NO: 3531 - DNA, 3437 bp, Nicotiana tabacum
  misc_feature (1976)..(1976): n is a, c, g, or t
  misc_feature (2004)..(2004): n is a, c, g, or t
  misc_feature (2011)..(2011): n is a, c, g, or t
  misc_feature (2015)..(2016): n is a, c, g, or t
  misc_feature (2050)..(2050): n is a, c, g, or t
  misc_feature (2079)..(2079): n is a, c, g, or t
  misc_feature (2081)..(2081): n is a, c, g, or t
  misc_feature (2107)..(2107): n is a, c, g, or t
  misc_feature (2128)..(2128): n is a, c, g, or t
  misc_feature (2262)..(2262): n is a, c, g, or t
  misc_feature (2272)..(2272): n is a, c, g, or t
  misc_feature (2348)..(2348): n is a, c, g, or t
  misc_feature (2351)..(2351): n is a, c, g, or t
  misc_feature (2364)..(2364): n is a, c, g, or t
  misc_feature (2413)..(2413): n is a, c, g, or t
  misc_feature (2428)..(2428): n is a, c, g, or t
  misc_feature (2443)..(2443): n is a, c, g, or t
  misc_feature (2445)..(2445): n is a, c, g, or t
  misc_feature (2449)..(2449): n is a, c, g, or t
  misc_feature (2452)..(2452): n is a, c, g, or t
  misc_feature (2455)..(2455): n is a, c, g, or t
  misc_feature (2457)..(2457): n is a, c, g, or t
  misc_feature (2459)..(2459): n is a, c, g, or t
  misc_feature (2465)..(2466): n is a, c, g, or t
  misc_feature (2470)..(2470): n is a, c, g, or t
  misc_feature (2474)..(2474): n is a, c, g, or t
  misc_feature (2478)..(2478): n is a, c, g, or t
  misc_feature (2481)..(2484): n is a, c, g, or t
  misc_feature (2487)..(2489): n is a, c, g, or t
  misc_feature (2491)..(2491): n is a, c, g, or t
  misc_feature (2503)..(2503): n is a, c, g, or t
  misc_feature (2592)..(2592): n is a, c, g, or t
  misc_feature (2622)..(2622): n is a, c, g, or t
  misc_feature (2655)..(2655): n is a, c, g, or t
  misc_feature (2677)..(2677): n is a, c, g, or t
  misc_feature (2742)..(2742): n is a, c, g, or t
acaattatatgtatatatttaattatctatatatatacacatatgctcatatttacacttattacatgttcatatgatcttgtcttaattaggcacatatttttttcttttcttgagctagattaaggactgaaattaattcatggctgatgcaaatatgggtgccggtggaggtcaattccctgattttccttcggttttaactcacggcggacaatatgtacagtatgatatttttggtaatttctttgagatcactaccaagtatcgtcctcctattatgcctattggtcgtggtgcttatggaattgtctgctcggtgttgaatacggagctgaatgagatggttgcagttaagaaaatcgcgaatgcgtttgacaattacatggatgctaagaggactctccgtgagattaagcttcttcgccatttagaccatgaaaatgtaattggtttaagagacgtgattcctccacccttacgaagggagttttctgatgtttacattgctactgaactcatggacactgatcttcaccaaataattagatccaaccaaggtttatcagaggatcactgtcagtacttcatgtatcagctcctccgtggcctaaaatacatacattccgcgaatgttcttcatagagatctcaaaccgagcaaccttttgctaaatgcaaattgtgatcttaagatatgtgactttggtcttgctaggccaaacatagagaacgagaatatgacggaatatgttgtaaccagatggtacagggcaccagagcttttgttgaactcttcagattacactgctgctatagatgtttggtctgtcggttgcatcttcatggaacttatgaatagaaaacctttgtttgctggaaaagatcatgtacatcaaatacgcttgttaaccgagcttcttggcaccccaacagaagctgatcttggcttcctccaaaatgaagatgcaaagagatacatcaggcaactcccacaacatcctcgccagcagttagcagaagttttccctcatgtgaacccattggctattgatcttgtcgataaaatgttgacattcgatcctactagaagaattacagttgaggaagcattagatcatccctaccttgcaaagctccacgatgcaggtgacgaaccgatctgccctgttccattctcctttgactttgagcaacaaggaataggagaagagcaaattaaggacatgatatatcaggaagctttgtcactgaatcctgaatatgcttaaacataagagaaatcaattcttcttctcctgtttcccctttgatctggagtatctactttcctactgtggattttcttgctcggaccgagccactcaatgtttttgctcactggtcagtcctttgcgcaacttgtaatgtaaggcagccttcaatgtgcagccatctatatatcttttttattttttatttttattacggtgctgtctgagctagcttgtgggcaccttgattatttcattggatattgctacctcccgccagcacaaccatttatatctcccactcattcttatgatttgtatcttgtgtgttgtattcagctaaaaccaataatggcaggttcctcaacaatcatagacacatcatctatgcagaattcaagtttctcttttccaacttcatcttcttcattcatgacttcttcattcactgaacttcttgcttctgatgattatccaacaaagagcaaaggacttggtgataggattgcagagagaactggttctggggttcccaagtttaagtcacttccacctccttcactacccctttctcctcctcctttttctccttcccttactttgctattcctcctggcttaagccctactgaactcttggactctcctgttcttttgtctgcttccaacattcttccatctccaacaacagggacatttccagccccaatttggacaatcttttncatcagtctctccgtcccaaactaatcntgtcccnttgnngaaacaatcatggaattatcaagaatcaagaaancagaatgatgaaaatgctaatggaacaantnaattgcagagcttgaaaaataatggncagagcaaccaatataacaancaatcatcaagatcagaagatgggtacaattggaggaaatatgggcagaaacaagtgaagggtagtgaaaatccaagaagttactataaatgtactttcccaaattgtcccacaaagaaaaaagtagagaggtntttagatggncaaattactgaaattgtgtacaagggtaatcacaaccatccaaagcctcagtctactaggagatcctcctctttanccntccaaccttacantacacaaactaatgaaatcccagatcatcagtcaacacctgagaattcntccatttcatttggngatgatgatcatganangagnagntcnanangagtanntcangagnagangannnngannnanaagaaccagacncaaaaagatggaaaagagaaagcgaaagtgaaggtttatcagcaccaggaagcagaacagtaagagaacctagagttgtagttcaaacnacaagtgatattgatattctagatgatggntatagatggaggaagtatggtcaaaaagtagtnaaaggaaatcctaatccaaggngctactacaaatgcacaagtccaggatgtccagtaagaaaacatgtggaacgagcatcacaaganataagatcagtgataacaacttatgaaggaaaacacaaccatgatgttccagcagctaggggcagtggcataaaccgacctgtcgcaccaaacattacttacaacaatggtgccaatgccatggccataaggccttctgtcacatctcaaattccattgcaaagtataaggccacaacaatctccctttacactagagatgttgcacaagcctagtaattataatggtttctcaggatatgtaaattcagaggattcatatgaaaaccaacttcaggacaataatgtattttccagagcaaaggacgagcctcgagatgacatgtttatggagacattgctctgctgaattgaattctcttggtcatcttgagagttcgaacatgaaatcgaaatttcataaaagaatatgttggtttcacttcatttgtcaatccatcatatatctacttttacatttttgcgggtgtgtgtacattttgcctaggaaatttgctggttgtaaattcaatgaaatgcagtgtagaagctcatgtatactattatggggtgtgttctttaggatacgaatgtaaagccccgattcatgacatatatatatgacactgattctttctttcttcattatttatcaaaaaatttcaagttttatttataattagaagattgtaatctttcaagattctggtatattga

SEQ ID NO: 3532 - DNA, 1652 bp, Cucumis sativus
ataaatattgatccaaattctttaattcttcttcaaactcttggtcttggtcttcatcttcatcttcattctggggtttcgttttcttgactcataatcggagaatttgattcagaaggcgtttctgagcaagggatttcgaagaatatggctgatgttggtcagaacaaccccgctgattttccagctctcccaacccatggtggccaatacgttcagtataacatttttgggaatcccttcgaaatcacctccaaatatcgtcctccgattatgcctattggtcgcggcgcatacggaatcgtttgttctgttttgaattcggagaccaacgaaatggttgcggttaagaagattgctaacgcgtttgataaccatatggatgcgaagagaacgctccgtgagattaagcttctacgccatttggatcatgaaaatgtaataggcataagagatgtgattcctccacctttacggagagaattcaatgatgtctacatttcgactgaactaatggatactgatcttcaccaaataatccgctccaaccaaagtttatcagaagagcattgtcagtatttcctttatcagattctcagaggactgaaatacatacattcggcaaatgtcattcatcgagacttgaaaccgagcaatctattgcttaatgcaaactgtgatcttaaaatatgtgactttggtcttgctcgaccaacttctgaaaatgaatgcatgacggaatatgttgtgacaagatggtacagagcacctgagcttcttttgaactctgattatacagctgcaatcgatatatggtctgttggttgcatctttctggagcttatgaatagaaggcctttatttccaggcagggatcatgtgcatcagatgagattattgactgagcttcttggcacaccaagcgagtcagatcttggttttattcgaaatgaagactcgaaaagatatcttcgacaactacctccacatcctcgtcagccattagcaacggtttttccacatgttcatccattagcaattgatcttgtggataaaatgttgacatttgacccaacaaagagaattactgttgaagaagcgttagcacatccgtacctagaaagattgcatgacatagctgatgagccggtttgctcagagccattctcgtttgagtttgagcaacaatacttagacgaagaacagatgaaggagatgatttacagagaggcattggcactcaatccagaatttgcatgaccttaaaagcgttcatgctcaaagtgtcgtcttcccgagtaacgacgactttgcaaatacaagataacacacaatgaaggaaacggctcagattggtgtacaaagcgaaatcaaatcagataagagctttgtatgttgaattggctaacttatctgtttcattcatctatcacctcttattaagaataccctaaattgttagtttatttttttgtcccacgtttgatcctttttaagtttatgtttttttgatttatttgttattttctttgtatctttctgtatttgtttgatttgaaaatgatgttaaatctatatcttgtacaggaaaccaaattaaatggaaactcattttaataaaacttctatttacgtgttgttttgtatgtctc

SEQ ID NO: 3533 - DNA, 1877 bp, Quercus alba
atgggggaaatgggcgttgacaagattgaacaagatgatagaggcggccgtaatcagagccgtccatctcgtccaaacgcgttgcgagtagcttttttttctccatcttttccctcgcgcgttttttcgcgtccctttcctcgcatctgctaagaagtcaccacgtcacaaacaaagagaaacggagagcactctgactctctctctctctctctcaatttcaatatcaaaacttcatatttaaacccctctcactacctttgaattcttcgtattctctctgtcaatactcaatactaagaaattctcacagagagagattgagacttcgaaaatggctgatataaatcagaatgtggcggcgaccggtcagtacggcgaatttccggccgtgcagactcacggaggtcagtttcttcaatacaacatcttcggcaacctcttcgaagtcacggccaagtaccgccctccgatcatgccgatcggccgcggcgcgtacggtatcgtttgctcggtgatgaattcggagacgaacgagatggtagcgatgaagaaaattgcgaacgcttttgataatcacatggacgcgaagcgtacgctaagggagattaagctgcttcgccatttcgatcatgaaaatgttgtagctttaagagatgtggttccgccacctttacgaagagaatttactgatgtttacattgcgacggaactcatggatactgatcttcaccaaataattcgttccagtcaaagcttatctgaggagcactgtcagtatttcttgtatcagattcttcggggtctaaagtttatacattcagcgaatgttattcatagagacttaaagcccagtaacctcttactgaacgccaattgcgatcttaagatatgtgattttggtcttgctcgcccgactgcagagaatgagtttatgaccgaatatgttgtcacaagatggtacagggcacctgagctactgttgaactcttcagattatactgctgccattgatgtgtggtctgtgggttgcatctttatggagcttatgactagaaagcctttgtttccgggaaggatcacgtgaatcagatgcgcttattgatagagcttctaggcacgccgagtgagtctgatcttggttttgttcgaaacgaggatgcaagaagatatattcgccaactcccctcacaccctcggcagccattagctgcagtttttttcacatgttcatccattggccattgatctcatagagaaaatgttcacatttgatcctactaaaagaattactgttgaagaagcattggcccatccttaccttgcaagattgcatgacatagctgatgaaccagtttgcccaaagccattttcctttgagtttgagcaacaacccttgggagaagagcaaatgaaggatatgatttaccaggaggccttatcactcaacccagagtatgcataaattaaagcaacattttttctcagttttatctcataagttgataagcctgtaagttactgggataatattgcaaccagaaatctaataggtcgcagattgaggaactgagatcctatttcatctttaccatttctctggtgggtctactgatattacattacaccaatgactgcccatcagttgtactgggcttatgaatttaatttggtgtcagtttttatttatttttgtaccacttgtatttgcttagatgtgtctgtatcttaattatatctgtgatatgctaaaacagtatttgtaaagcgggttgaattgtaactaagtcggatttaatgaaaattaacctattgttttgttcttcaaaaaaagaaaaaaaagttaattaatcgcgatctagaactacgtgtctgat

SEQ ID NO: 3534 - DNA, 1622 bp, Juglans hindsii x Juglans regia
  misc_feature (418)..(418): n is a, c, g, or t
  misc_feature (439)..(439): n is a, c, g, or t
  misc_feature (445)..(445): n is a, c, g, or t
  misc_feature (1359)..(1359): n is a, c, g, or t
  misc_feature (1473)..(1473): n is a, c, g, or t
  misc_feature (1528)..(1528): n is a, c, g, or t
ggggcaaacggaaaagcactgaggatctgaacctcaggctgctcttctcctttaaatcctttctgtctctcccttcaaattcttcgtcctcattgcttgttcttcacactatacggagcgagaaagcttctgtggaagaggtagagagagtgtgtgtgtgtgtgagagagagagagagagttcggaaatggctgacgccaaccacagttcggcagccggtcagttaggggattttccggcggttccaacgcacggaggtcagttttttcagcacaacatcttcgggaacctcttcgagatcacggccaagtaccgccctcccatcatgcctattggtcgcggcgcgtacggaatcgtctgctcggtgttgaattcggagacgaacgagatggtcgccatgaagaaaatagcgaacgcnttcgataaccacatggacgcnaagcgnacgctcagggagattaagctgcttcggcatttcgatcatgaaaatatcataggcataagagatgttgttcctcctcctttacggagagaattcaccgatgtttacattgccatggaactcatggatactgatcttcaccaaataattcgctccaatcaaagcttatcagaggagcattgtcagtacttcttgtatcaacttcttcgaggactgaagtttatacattctgcgaatgttattcatagagacttgaaacccagcaacctcttactgaatgcaaattgtgaccttaagatatgtgattttggtcttgcccgtccaactgcagagaatgagtttatgactgaatatgttgtcaccagatggtacagggcgcctgagttactgttgaactattctgattacactgctgccattgatgtgtggtctgtaggttgcatctttctggagcttatgaatagaaaacctttgtttccaggccgagatcaagcgcatcagatgcgcttgttgatagagctccttgggacaccaaccgagtctgatttttggtttgttcggaatgaggatacaaagagatatattcgccaactgccccgacatcctcgacagccgttagccattgttttcccacatgttaatccattagccattgatctaatggagaaaatgttaacatttgatcctgctaaaagaattactgttgaggaagcattggcccatccttacttcgaaagattgcatgacgtagctgacgaaccagtctgctcagagccattttccttcgactttgagcaaaaacccttggaagaggagcaaatgaaggatatgatttaccaggaggccttagctttcaacccagaacacgcatagtcaaaaaatgtctttgttcttggtcacagattgtacaatgtacncctgcgtttattctatttcaactgtaacattactttggtgtgtctgctgatattacacaaatgactgtccatcagctgagttcagcctctaaatttatttttgaggccagtccnctagcaaggtgttttttcattttttttctcttttctttctagaacttgtatcccnctttctttgatgtgctaaatctttattttgtatataggatccagtgtaactcataaccaatgagttaataaaaattgactattgttttgttcga

SEQ ID NO: 3535 - DNA, 1630 bp, Cucumis melo
aaactcttggtcttggtcttcatcttcattctggggtttcattttcttgactcataatcggagaatttgattcagaaggcgtttctgagcaaagggtttcgaggaatatggctgatgttggtcagaacaaccccgctgattttccagctcttccaacccacggtggccaatacgttcagtataacatttttgggaatcccttcgaaatcacctccaaatatcgtcctccgattatgcctattggtcgcggcgcatacggaatcgtttgttctgttttgaattcggagaccaatgaaatggttgcggttaagaagattgctaacgcgtttgataaccatatggatgcgaagaggacgctccgtgagattaagcttctacgccatttggatcatgaaaatgtaataggcataagagatgtgattcctccacctttacggagagaattcaatgatgtctacatttcgactgaactaatggatactgatcttcaccaaataatccgctccaatcaaagtttatcagaagagcattgtcagtatttcctttatcagattctcagaggactgaaatacatacattcggcaaatgtcattcatcgagacttgaaaccgagcaatctattgcttaatgcaaactgtgatcttaaaatatgcgactttggtcttgctcgaccaacttcagaaaatgaatgtatgacggaatatgttgtgacaagatggtacagagcacctgagcttcttttgaactctgattatacagctgctatcgatatatggtctgttggttgcatctttctggagcttatgaatagaaggcctttatttccaggcagggatcatgtgcatcagatgcgattattgaccgagcttcttggcacaccaaccgagtcagatcttggttttatccgaaatgaagactcgaaaagatatcttcggcagctacctccacatcctcgtcagccattagcaacggtttttccacatgttcatccgttagcaattgatcttgtggataaaatgttgacatttgacccaacaaagagaattactgttgaagaagcattagcacatccatacctagaaagattgcatgacacagccgatgagccggtttgctcagagccattctcgtttgagtttgagcaacaatacttagacgaagaacagatgaaggagatgatttacagagaggcattggcactcaatccagaatttgcatgaccataaaagcattcgtgctcgaagtgtcgtcttcccgagtaatgacgactttgcatatacaagataacatacaatgaagataacggctcagattggtgtacaaagtgaaatcaaatcagataagagctttgtatgttgaattggctaacttatctgtttcattcatctatcagctcttattaagaataccttaaattgttagtttatttttttgtcccacgtttgatcctttaagtttatgtttttttttctttttttcttttttgttattttctttgtatctttctgtatttgtttgatttgaaaataatgttgaatctatatcttgtacaggaaacaatattaaatgcaaactcattttaataaaacttctatttacgtgttaaaaaaaaaaaaaactaaactgagac

SEQ ID NO: 3536 - DNA, 1933 bp, Glycine max
ctccatcctcttcatctttcttcttctcgtttttactttgacggtttctagagagagaaagtttgttatagagagagaaagcgcgctgctgcttcttctgctgctgcttcgacagtgagaagagagagagaagcgctcttctccgtaccgtttctagagagagaaactgatggccggagttaatccgaacggcgtcgccgattttccggcgactccaacgcacggcggacagttcattcagtacaacatattcggaaacctcttcgaggttacggcgaagtaccgtcctccgatcatgcctgtcggacgcggcgcgtatggaatcgtttgctcgctgttgaataccgagacgaatgagctggtggcggttaagaagatagcgaacgctttcgacaatcacatggacgctaagcgtacgcttcgtgagattaagcttcttaggcatttggatcatgaaaatgtaattggtttgagagatgtaattcctccacccttgcgtagagagtttaatgatgtctacatagccactgaactcatggatactgatcttcaccatatcattcgctccaatcaaaatctgtcagaggagcactctcaatacttcttgtaccagattcttcgtgggcttaagtatatacattctgcaaacgtaatccatagagatttaaaaccaagcaacctgctgctaaactcaaattgtgacttgaagattattgattttggtcttgcgagaccaactttggaaagtgacttcatgacagaatatgtagtcacaagatggtacagagctcccgaattgttgttgaattcctctgattacacctctgctatagatgtgtggtctgttggttgcatctttatggagcttatgaataaaaagcctctgtttccgggcaaagaccatgtgcatcagatgcgcttattgacagagcttcttggcaccccaactgaggctgaccttgggttagtgaaaaatgaagatgcaagaagatatatcagacaacttcctcaatatcctcgccaacctttagctcaagtcttcccccatgttcatccggcagccattgatcttgttgataaaatgttgacagttgatcccaccaaaagaattacagttgaagaagcactagcccatccataccttgaaaaactgcatgatgtagctgatgaaccaatctgcatggagccattttcatttgattttgagcaacaacaattggatgaagagcaaataaaagagatgatctacagggaagcattagcactcaatcctgagtatgcttaaagcagaaaaactcaaggacttgaagcaggcttagaaggaaaaataataattcgttttcaatttttttaatcactttaagttcagttcttacaatcacgaaaggatcaagttgaatgaaaattcaaccttgttgccgatcaaactccctaggtaatttattcaatctgtgtgactaggtaggtgcaattacggcttgatgagtgtccttctgctgtaaagtgccaagtaacgatattaatctccaattttttttaaccctgacgggttattattatttttattttcttttgtgactgttttctcgggttcatcatgtattttacttaagttatttgcatcgtaacttattgctaccttgattttagctattttctgctatattatctgtatagtggatttaaattcagtgagccttttttttttagaaaagtacttcctttatggttagaaaattgaatgcatgatgacttttcatagtttaatgcgtgatttatggattttatattgcgatgtttctgtaataatacgagtcagataagtcagctttttagaaaagcacccatttcttgttgggaagaaatagaagagatatccgtgttcctttctccttttccaaattattacttactctcacacctggttagtgaa

SEQ ID NO: 3537 - DNA, 1764 bp, Glycine max
gtgaagtgaagactcaacgtgcttacttactcggccgagttgaccgagcgaaaaataagaatcactcacatgcccgccggcacgcacgcacgcactgactcggtgacttactcactcgctccttgcggacactatttaaattaaaaacctcttccttccacttctccatcggcttcgtcttctttctcgttcttactttgacggtttctagagagagaaagtgatggccggagttaatccaaacggcgtcgccgattttgcggcggttccgacgcatggcggacagttcattcagtacaacatatttggaaacctcttcgaggttacgacgaagtaccgtcctccgatcatgcctatcggacgcggcgcgtacggaatcgtttgctcactgttgaataccgagacgaacgagctggtggctgtgaagaagatagcgaacgctttcgacaatcacatggacgctaagcgtacgcttcgtgagattaagcttcttaggcatttggatcatgaaaatgtaattggtttgagagatgttattcctccacccttgcgtagagagtttaatgatgtctacatagccactgaactcatggatactgatcttcaccatatcattcgctccaatcaaaatctgtcagaggagcactgccaatacttcttgtaccagattcttcgtgggcttaagtatatacattctgcaaacgtaatccatagagatttaaaaccaagcaacctgctgctaaactcaaactgtgatttaaagattattgattttggtcttgcgagaccgactttggaaagtgacttcatgacagaatatgtagtcacaagatggtatagagctcccgaattgttgttgaactcctctgattacacctctgctatagatgtgtggtctgttggttgcatctttatggagcttatgaataaaaagcctctgtttccgggcaaagaccatgtgcatcagatgcgcctattgacagagcttcttggcaccccaactgaggctgaccttgggttagtgaaaaatgaagatgcaagaagatatatcagacaacttcctcaatatcctcgccaacctttagctcaagtcttcccccatgttcatcccgcagccattgatcttgttgataaaatgctgacagttgatcccaccaaaagaattacagttgaagaagcactagcccatccataccttgaaaaactgcatgatgtagctgatgaaccaatctgcatggagccattctcatttgattttgagcaacagcaattggatgaagagcaaataaaagagatgatctacagggaagcattagcactgaatcctgagtatgcttaaagcagaagactcaaggacttgaagcaagcatataaggaaaaataataattcgtttttaatttttttatcacttaagttccctgcttacaagcaggaaacgatcaagttgaatgaaaattcaatcttgttgccaatcaaactcccttaggtaatttattcaatctgtgtgactaggtaggtgcaattacggcttcatgagcgcccttttgttgtaaagtgccatgtaactatattaatttccatatattttttttaaccctgacggcttattgttgtaaagtgacatgtaacaatattccctgtttgccacacactaatgccatatggggagagggactaaaaaaatcattcctcaagtttgagggactaaataaaacaaacattaatgcagaggacttaaaaaaacattccaaatttaaaggact

SEQ ID NO: 3538 - DNA, 3336 bp, Arabidopsis lyrata
aaaggacgttgagaagacggaagaccgttgacaaagtcaacaacaaacaccaatcgtcgatttgaggcggctctaatctcaaccacacgatcttcccatctttctcttcttcttcatcttcttcttcctcgcaattaccgcgaaaactcatctctgctcaatcctcagtttcagtctctgtattgactcttgactgttatataaaaaccatacaataccttcagattcactacttcaaacctcaaaccaaccactgaagcttgactttgatcgattgagagagagaaatgaacaccggtggcggccaatacacggattttccggcggtggaaactcacggaggacagttcataagttacgatatcttcggtagtttattcgagatcacatctaagtatcgtcctccgattataccaatcggtcgtggagcttatggaatcgtttgctctgtgttggatacggagaccaacgaacttgtagctatgaagaagatagcgaatgcttttgataatcatatggatgctaagcgtacgcttcgtgagattaagcttcttcgtcatctagatcatgaaaacattatagctataagagatgttgttccaccaccactacgaagacagttcagtgatgtttatatttctactgaattaatggatactgatcttcatcaaatcatcagatctaaccagagtttatcagaagaacactgtcagtacttcttgtaccagctacttcgagggcttaagtatatccactcagctaacattatacatagggatttaaagccgagcaatcttctgttgaacgcgaattgcgatttaaagatttgtgatttcggtcttgctagaccgacttcagagaatgacttcatgactgagtatgttgttacgagatggtatagagcacctgagcttctgttgaactcttcagattacacagctgctatagatgtttggtctgttggttgtatctttatggagcttatgaatagaaagcctttgtttcctggtaaagaccatgttcatcaaatgcgattattgacagagttgcttggcacaccgacagaagctgatctcgggtttacacacaatgaggatgcgaaaagatacatccggcaacttcccaacttcccacgccagccgttagcaaaacttttctctcatgttaacccattggccattgatctagttgacagaatgttgacgtttgaccccaacagaagaatcactgttgaacaagctctgaatcaccagtaccttgctaaattacacgacccgaatgatgagccaatctgtcaaaagcccttctctttcgagttcgaacaacagccactggacgaggaacagataaaagagatgatttaccaagaagccatagcactcaatccaacatacgcctagaagagcagcagccccgtgattgcccgaacttcaggccattgttgacaaaaatagtgaaagatttttctgcttgattttgagacatggctagttcagttacaggcgatgcggaaacagtgatatcagcagattcaagcaccaaacgcagcggtggaggttggatcacttttccgtttatgatagttacgttgttaggcttgacaatagctgcgtggggttggttacttaacttgatcgtctacttgattgaggaattcaatgtgaagagcatcgcagcggctcagattgctaacattgttagtggttgtatctgtatggttccagctatggcagccattgcttctgactctttctttggaaccattcctgttatctcagtttcagctttcatttctcttatgggcgtagctctgctgactctaaccgcttcgcttgactctttaagacctagagcctgtgaaacagcttcaagcctatgccagtctccttcgaaaacccagctcggagttctttacacggccataactctagcctctataggaacgggtgggacacggttcacattagcaactgctggtgcgaaccagtatgaaaaaactaaagaccaaggaagctttttcaactggtttttcttcactacgtatcttgccggagctataagtgcaaccgccattgtctacactgaagacaacatcagctggaccttggggtttggtctgtccgtagccgctaatctcttcagttttttggttttcatctcggggaaaagattctacaagcacgacaagcctttgggaagtcccttcacaagtctactatgcgtcattttcgccgcggtacgcaaaagaaaagctgtggtttccaccaacgaaaaagactaccacaatgaatctatcacaatgcccacaaagagtttcaggttctttaaccgtgcagcgttgaaacaagaagacgaggttaaaccagacggctcaattcgcaatccctggagactatgcagcgttcaacaagtagaagatttcaaagcagtcataagaatcatccctcttgcgttagctacaatattcttaagcactccaatcgcaatgcagctaagcttaacagttcttcaaggtctggtgatggaccggaggcttggccctagcttcaaaatccctgcaggctctctccaagtcataacacttctctccacttgcctatttatcatagtcaatgatcggtttctctatccattttaccaaaagttaacgggaaagttccttacaccgctccaacgagtcggtataggccatgctttcaacattctaagcatggccgtgactgccatagttgaagcaaagcgattgaagatagtacagaagggtcattttctcggatcatcatccgttgctgacatgtcagtcttgtggctcttcccacctctagtcatagtaggaattggagaggccttccatttcccagggaatgtagctctgtgctatcaagagtttccagagtctatgagaagcaccgcaacatcgattacctcggtggtgattgggatatgtttctacacaagcactgctttgattgatctgattcagaggaccaccgcgtggttaccagatgacataaaccacggaagagttgacaatgtttactgggttttagtaattggaggagtcttgaatcttggctattttcttgcgtgttctttggtttacagatacagaaacctcaaggatgatgatcatgagcaatctgcaaatgtctctcactgatattttaagctggagagaaagagagaaagaacatgtcctttgttgttatcatttgcattactgtatagcagagggctttgtctgaaagtatcttcaatttgtggccattgaaaacaatttttcgtatgtagaattgatttggaaatttgtggtaatataatcgtattgtttatgtg

SEQ ID NO: 3539 - DNA, 1605 bp, Brassica oleracea
  misc_feature (1344)..(1344): n is a, c, g, or t
  misc_feature (1365)..(1365): n is a, c, g, or t
  misc_feature (1371)..(1371): n is a, c, g, or t
  misc_feature (1373)..(1373): n is a, c, g, or t
  misc_feature (1375)..(1375): n is a, c, g, or t
  misc_feature (1379)..(1379): n is a, c, g, or t
  misc_feature (1397)..(1397): n is a, c, g, or t
  misc_feature (1430)..(1430): n is a, c, g, or t
gagaactgtaaaggacgtcgggaggaagaccgttgacgaagtcaaaaccgaacagcaaccgtcgatctgaggcggctcaaatctcgtccacacaaatctttccatctcccttcttcttcctcgcagttaccgcgaaaactcatctgaaactcgtcttctcatttcagtccctcatctaactgtaatataattatatatataaaggagtcacgcaataccttcagattcactatacctcaaagcgcaacaagtcaagcttgaagttgacttagcgcgtcatcgattgaaagagagagagagagagagagagatgaacaacgccggcggccaatatccagattttccggcggtgcagacgcacggaggacagttcataagctacgatatcttcggtagtttattcgaggtcacatccaagtaccgtcctccgattgttccaatcggtcggggcgcatacggcatcgtttgctctgtgttggattcggagacgaacgagcttgtggcgatgaagaagatagccaacgcctttgataatcacatggacgccaagcgtacacttcgcgagatcaagcttcttcgtcatctcgatcatgaaaacatcatagctataagagatgtggttcctccaccacttagaagagagttcagtgatgtttatatcgccactgagttaatggacactgatcttcatcaaatcatcagatccaaccagggcttgtctgaggaacactgtcagtacttcctgtaccagcttcttcgagggctcaagtacatccactcggctaaagttatccacagggatctaaagcctagcaatcttctcctgaacgccaactgcgatttaaagatctgtgattttggtcttgctagacccacttcagagaacgagtttatgactgaatatgttgttaccagatggtatagagcacctgagcttctgctcaactcatctgattacacagctgctatagatgtttggtctgttggttgtatctttatggagctcatgaacagaaagcctttgttccctggcaaagaccatgtccatcagatgcgcttattgacagagttgcttggcacgccgacagaatcagatctcgggtttacacacaacgaggatgccaaaagatacatccggcagcttcccaacttccctcgccaaccgttagctaaactgttctctcatgttaactcattggccattgatctagttgacagaatgttgacgtttgaccccaacaaaagaatcactgttgaagaagctctgaatcacccgtacctagccaagttgcacgacccgaatgatgagccaatctgtctaaagccattctctttcgactttgnacaacaacctctagacgaggnacagananangagntgatctacagggaagccnttgcactcaatccaacatatgcttagaagagcngcaaccgaatgaatggccaaatatcctgccctctagcatctttgcttgttcttttattcatgtaccttttttccatgtgtaatcctatttgtttgtttaacattgtattactgctagtgagtgagtgcatgtagctcttatgtaaaagtactccagctatgaaatatttacttca

SEQ ID NO: 3540 - DNA, 1456 bp, Solanum tuberosum
atggttgatgctaatatgggtggtgctcaattccctgattttcctaaaattgttactcatggtggacaatatgttcagtatgacatttttggtaattactttgagattaccaacaagtatagacctcctatcatgcctattggccgtggcgcttatggaatcgtctgctctgtgtttaatgcggagctgaatgagatggttgcagttaagaaaatcgccaatgcttttgataattacatggatgctaagaggacgctccgtgaaattaagcttcttcgccatttagaccatgaaaatgtcattggtttaagagatgtgattcctccgcccttacgaagggagttttctgatgtatacattgctactgaactcatggatactgatcttcaccaaataattcgatcgaaccaaggtttatcagaggatcattgccagtacttcatgtatcagcttctccgtgggctaaagtacatacattcagcgcatgttattcatagagatctcaaaccaagtaacctcttgctaaatgcaaattgtgatcttaagatatgtgattttggtcttgcaaggccaaacctagagaacgagaatatgacagaatatgtagttaccagatggtacagggcaccggagcttttgttgaactcttcagattacactgctgccatagatgtttggtctgtgggttgcatcttcatggagcttatgaatagaaaacctttgtttgctggaaaagatcatgtacatcaaatacgcttgctaactgagcttcttggcactcctacagaatctgatcttagcttcctccgaaatgaagatgcaaaaagatatgtcaggcaactcccacaacatccacgccagcagttagcaacagtgttccctcatgtaaatccattagccattgatcttgtagataagatgttgacactcgaccctactagaagaattacagttgaggaagcattagctcatccatacctcgcaaagctccatgatgccgctgatgaaccagtctgccccattccgttctctttcgactttgagcaacaagggataggagaagagcagattaaagacatgatttatcaagaagccttggcgttgaatcctgaatatgcttaagcataagagaaatcagttcttctcttgcttccctagtgtggattttctttcttggaccagccctctcaaagtgcagacatttttatatacctttcttctttatttttttgttaattatggtggtgttcgtgctagcttgtgtgcactcgactattccataggatatatgccatctcccaccaacaaaaacatttatgtcttccactcattcttatgacttgtatcttgtgttctgtttttagcttattgtagcaactattttttattcagtgtatcatgttgtattatgtacagtatgtagaaaatctatcaagaatctatttgtcattttgaa

SEQ ID NO: 3541 - DNA, 1195 bp, Nicotiana benthamiana
atggctgatgcaaatatgggtggtggtggtggtggtcaatttcctgattttccttcggttttaactcatggtggacaatatgtgcagtatgatatttttggtaatttttttgagatcactaccaagtatcgtcctcctattatgcctattggtcgtggtgcttatggaattgtctgctcggtgttgaatacggagctgaatgagatggttgcagttaagaaaatcgcgaatgcgtttgataattacatggatgctaagaggactctccgtgagattaagctcctccgccatttagaccatgaaaatgtaattggtttaagagatgtgattcctccaccgttacgaagggagttttctgatgtttacattgctactgaactcatggatactgatcttcaccaaataattagatccaaccaaggtttatcagaggatcactgtcagtacttcatgtatcagctcctccgtggcctaaagtacatacattccgcaaatgtccttcatagagatctcaaaccgagcaaccttttgctaaatgcaaattgtgatcttaagatatgtgactttggtcttgctaggccaaacatagagaacgagaatatgacggaatatgttgtaaccagatggtacagggcaccagagcttttgttgaattcttcagattacactgctgctatagatgtttggtctgtcggttgcatcttcatggaacttatgaatagaaagcctttgtttgctggaaaagatcatgtacatcaaatacgcttgctaactgagcttctcggcaccccaacagaagctgatcttggcttcctccaaaatgaagacgcaaagagatacatcagacaactcccacaacatcctcgccagcagttagcaaatgttttccctcatgtgaacccattggctattgatcttgtcgataaaatgttgacactcgatcctactagaagaattacagttgaggaagcattagatcatccctaccttgcaaagctccacgatgcaggtgatgaaccgatctgccccgttccatcctccttcgactttgagcaacaaggaataggagaagagcaaattaaggacatgatatatcaggaagctttgtcgctgaatcctgaatatgcttaaacataagagaaatcaattcttcttcttcttctgtttcccctttgatctggagtatctactttcc

SEQ ID NO: 3542 - DNA, 1639 bp, Silene vulgaris
gacttcttgtgtcatctctcccaactctcaactcagtgttttctattttccccatttctcatcttcttcaattgattccgtaggtcttgtttaagacggtcttaagttaagacggggattgtgaaactagaatttcggcaattgatttcatatccttggttccgtcggaaaaagtctagtaaattgatcggatcaaaactgagagatggctgaggtggcacaaaatgcagcgggaaatggagcattcccggagtttccagcgacgtatacaaatggtggtcagtttatccaatacaacatctttggtaacatgtttgaagttacttccaagtatcgccctcccatcatgcccattggccgtggcgcttatggtattgtttgctcggtgttgaacacggagacgaatgagatggttgcgatgaagaagattgctaatgcttttgataattacatggatgccaagcgtactcttcgtgagatcaaaattctccgccatttcgatcatgaaaatgtgatagctctgagagatgtcgttcctccaactctccgaagagaattcacagatgtgtatattgcgactgagcttatggacactgaccttcatcagataattagatccaatcagaatttatcagaggaacactgtcagtacttcctataccagcttcttcgagggttgaaatacattcattcagcaaatgtcatccaccgagatttgaaaccaagcaatttgctgataaatgcaaattgtgacctgaagatctgtgattttggactagcacgtccaactgcagaaaacgagcacatgactgaatatgtcgttaccagatggtacagggcacctgagcttttgctaaattcttctgattacactgccaaaattgacgtttggtctgttgggtgtatatatatggagctaatgaatcgaacacctctatttcccggcaaggaccatgttaaccaaatgcgccttttgacagagctgctcgggacacccacagaatcggatcttcaatttcttcacaatgaagatgcaagaagatatatccgtcaacttccaccacaacctcgccaggcattaggccaactattctcacacattcatcccttggcaattgatcttgttgagaagatgctcacatttgatcccaccaaaagaattagtgttgaagaagcactatcacacccatacttggcaaggctacatgacacagctgatgagcctacttgcacagagccattctcattcgagtttgagcaacaagcgttgggagaagaacaaatgaaagagatgatctaccaagaagctttagcactcaatccagagtacgcttaggctgcgtatatttattttccgctgaacaacacttgtattgggtcacagggtctagatagctccgttaaggagcccttaaatatgtcacttaattcgatcagttaacgtgaatctgaaattgtttgtttatttggttttgtgttagccttgttgatttgtaaacttgtatcgggtcacagggtccgttgtacatacacttgtaatctttgtaatatgatgagatgaagttgtattcttcttaggtactttgtaaactctttaaattttataaatgtgtaacagggtgagactaataaaaattct

SEQ ID NO: 3543 - DNA, 1637 bp, Solanum phureja
tctccaatcaatcatattatatatagtcatatttgataatcttgtgtaaattaggtttttactaaatctagcaataatggttgatgctaatatgagtggtgctcaattccctgattttcctaaaattgttactcatggtggacaatatgttcagtatgacatttttggtaattactttgagattaccaacaagtatagacctccaatcatgcctattggccgtggcgcttatggaatcgtctgctctgtgtttaatgcggagctgaatgagatggttgcagttaagaaaatcgccaatgcttttgataattacatggatgctaagaggacgctccgtgaaattaagcttcttcgccatttagaccatgaaaatgtcattggtttaagagatgtgattcctccgcccttacgaagggagttttctgatgtatacattgctactgaactcatggatactgatcttcaccaaataattcgatcgaaccaaggtttatcagaggatcattgccagtacttcatgtatcagcttctccgtgggctaaagtacatacattcagcgcatgttattcatagagatctcaaaccaagtaacctcttgctaaatgcaaattgtgatcttaagatatgtgattttggtcttgcaaggccaaacctagagaacgagaatatgacagaatatgtagttaccagatggtacagggcaccggagcttttgttgaactcttcagattacactgctgccatagatgtttggtctgtgggttgcatcttcatggagcttatgaatagaaaacctttgtttgctggaaaagatcatgtacatcaaatacgcttgctaactgagcttcttggcactcctacagaatctgatcttagcttcctccgaaatgaagatgcaaaaagatatgtcaggcaactcccacaacatccacgtcagcagttagcaacagtgttccctcatgtaaatccattagccattgatcttgtagataagatgttgacactcgaccctactagaagaattacagttgaggaagcattagctcatccatacctcgcaaagctccatgatgccgctgatgaaccagtctgccccatcccgttctctttcgactttgagcaacaagggataggagaagagcagattaaagacatgatttatcaagaagccttggcgttgaatcctgaatatgcttaagcataagagaaatcagttcttctcttgcttccctagtgtggattttctttcttggaccagccctctcaaagtttttgttcacagggtcagtagtagtcctttgcaactttaatgtaaggcagccttcaatgtgcagacacttttatatacctttcttctttatttttttttgttaattatggtggtgttcgtgcttgcttgtgtgcactcgactatccataggatatatgccatttcccaccaacaaaaacatttatatgtcttccactcattcttatgacttgtatcttgtgttctgttttcagtttattgtagcaactattttttgttcagtgtatcatgttgtattatgtacagtatgtagaaaatctatcaagaatctatttgtcattttgaagatttgagtgtaattttctgtgttcaactatttgtgcatgaa

SEQ ID NO: 3544 - DNA, 1631 bp, Arabidopsis thaliana
aaaggacgttaggaagaggaagaacgttgacgaagtcaacaacgaacagaaaccgtcgatttgaggcggctctaatctcaaccacacgatcttctctgcctttccctcttctctcttcttcttcttcttcatcttcttcctcgcaattaccgcgaaaactcatctctgctcaatcctcaatctcagtctctctgttgactccgactgttatataaaaccatacaaataccttcagattcactacttcaaacctcaaagcaaccactgaatctcgactttgatcaattgagagagaaatgaacaccggcggtggccaatacacggattttccggcggtggaaactcacggaggacagttcataagttacgatatcttcggtagtttattcgagatcacatctaagtatcgtcctccgattataccaattggtcgtggagcttatggaatcgtttgctctgtgttggatacggagacgaacgagctagtagcgatgaagaagatagctaatgcttttgataatcatatggatgctaagcgtacgcttcgtgagatcaagcttcttcgtcatcttgatcatgaaaacattatagctataagagatgttgttccaccaccactaagaagacagttcagtgatgtttatatctctactgaattaatggatactgatcttcatcaaatcatcagatctaaccagagtttatcagaagaacactgtcagtacttcttgtaccagctacttcgaggactgaagtatatccactcagctaacattattcatagggatttaaagccgagcaatcttctgttgaacgcgaattgcgatttaaagatttgtgatttcggtcttgctagacctacttcagagaatgattttatgactgagtatgttgttacgagatggtatagagcacctgagcttctgttgaactcttcagattacacagctgctattgatgtttggtctgttggttgtatctttatggagcttatgaatagaaagcctttgttccctggtaaagaccatgttcatcaaatgcgcttattgacagagttgcttggcacaccgacagaatctgatctcggttttactcacaatgaggatgcgaaaagatacatccggcaacttcccaacttcccacgtcagcccttagctaaacttttctctcatgttaacccaatggccattgatcttgttgacagaatgttgacgtttgaccccaacagaagaatcactgttgaacaagctctgaatcaccagtaccttgctaaattgcacgacccgaatgatgagccaatctgtcaaaagccattctcttttgagttcgaacaacagcctctggatgaggaacagataaaagagatgatctaccaagaagccatagcactcaatccaacatacggttagaagtgcagcagccccgtgaatgcctggtattacccaataaccatccgaatggctacttagtatctttgcctgttcttttattcatgtacttcttccacatatgtaatcttgtaacttttatttgtttgttcatgttatttactgctagtgattaagtgtagctccaatgtaaagtactccagttattaaagaatatctatagacttttttacttcacatact

SEQ ID NO: 3545 - DNA, 1692 bp, Solanum lycopersicum
ggtaacgcgttctcttcttcttctcatcttcctccttccttcctgcaatttttctccaatcaatctcacattatatattctcataattttttgatgaatttattagtgttttactaaatttctatcaataatggttgatgctaatatgggtgctgctcaatttcctgattttcctaaaattgtcactcatgctggacaatatgttcagtatgacatttttggtaatctttttgagattactaacaagtatcaacctcctatcatgcctattggacgtggcgcttatggaatcgtctgctctgtgtttaatgcggagctgaatgagatggttgcagttaagaaaatcgccaatgcttttgataattacatggatgctaagaggacgctccgtgaaattaagcttcttcgccatttagaccatgaaaacgtcattggtttaagagatgtgattcctccgcccttacgaagggagttttctgatgtttacattgctactgaactcatggatactgatcttcaccaaataattagatcaaaccaaggtttatcagaggatcattgccagtacttcatgtatcagcttctccgtgggctaaagtacatacattccgcgcatgttattcatagagatctcaaaccaagtaacctcttgctaaatgcaaattgtgatcttaagatatgtgattttggtcttgcaaggccaaacgtagagaacgagaatatgacagaatatgtagtaaccagatggtacagagcaccggagcttttgttgaactcttcagattacactgctgccatagatgtttggtctgtgggttgcatcttcatggagcttatgaatagaaaacctttgtttgctggaaaagatcatgtacatcaaattcgcttgctaactgagcttcttggcactcctacagaatctgatcttagcttcctccgtaatgaagatgcaaaaagatacgtcaggcaactcccacaacatccacgccagcagttagcaacagtgttccctcatgtgaatccattagccattgatcttgtagataagatgttgacgctcgaccctactagaagaataacagttgaggaagcattagctcatccctacctcgcaaagctccatgatgcagctgatgaaccagtctgccccatcccgttctctttcgactttgagcaacaagggataggagaagagcagattaaagacatgatttatcaagaagctttggcgttgaatcctgaatatgcttaagcataagagaaatcagttcttctcttgcttacctagtgtggattttcttgcttggaccagccctctcaaagtttttgttcacagggtcagtagtagtcctttgcaactttaatgtaaggcagccttcaatttgcagccatttttatatacctttcttctttattttttttacttaattatggtggtgttcgggctagcttgtgttcactcgactattccataggatacatgtcatctcccaccaacaaaaacgtttgtacgtcttccactcattcatatgacttgtatcttgtgttctgtttgtagcttattatagtaactattttttgttcaatgtatcatgttgtattatgtacagtatgtacaaaatctatcaagaatctatttgtcattttgaagttttgggtgtaattttctgtgttcaactatttgatcatgaa

SEQ ID NO: 3546 - DNA, 1672 bp, Arachis hypogaea
ttattcttcttcaacacactaaccttccttcgtccctctcaacggtttctagagagagagagagagaaactaaaagtctccgtttagagagagaaagtagaaaacaccgatggccggcgttaatccaaacggtgccgcggattttccggcggttccgactcacggtggacagttcattcagtacaacatcttcggtaacctctttgaggtcaccgctaagtaccgtcctccgatcatgcctatcggtcgtggagcttacggaatcgtttgctcggtgttgaatactgagactaatgagctggttgctgttaagaagatagcgaacgcgttcgataatcacatggatgcgaagcgcacactccgtgagattaagctcctgaggcatctggatcatgaaaacgtgattggcttaagagatgttattcctccaccccttcgtagagagtttaatgatgtctatattgcaacggagctcatggatactgatcttcatcacattattcgctccaatcagggcctgtcggaggaacactgccagtacttcttgtatcagattcttcgtgggctgaagtacatacattctgcaaacataattcatagagatttgaaaccaagcaatctgttgctgaatgcaaattgtgacttgaagattattgattttggtcttgcgcggccaactttagaaaatgatttcatgacagagtatgttgtcacaaggtggtacagggctcctgaactgctgttgaactcgtctgattacacttctgcaattgatgtttggtctgttggttgcatctttatggaactcatgaataaaaagcctctcctcccagggaaggatcacgtgcatcagatgcgcctattgacagagcttcttggcactccaactgaggcagaccttgggttagtgaaaagtgaggatgcgagaagatacatccgacaacttcctcaatatgctcgccaacctttagctaggatcttcccccatgttcatcccttggccattgatcttgttgataaaatgttgacaattgatccaactaaaagaattacagttgaagaagcactggcccatccatatcttgaaaagctgcatgatatagccgacgaacctgtctgcatggagccattctcatttgactttgagcaacagcagttggatgaagaacaaataaaagagatgatctacagagaggcattggcactcaatcctgagtatgcttaaagtaaaatgacatgagcaatttgaagtttagaaggtaataataaattattaaaaaaaataatgtgtaatcaattcttttattgcaaagttcaacacagtgggaagttgttacaggcaggaaagaaccaagttagaacgaggattgaatcctattgctgatcaaaccttcccgggtaaatcctgttcaatatgtgagattagttaggttcaatttaatgcttttaaaacaaatgagtgccttagtgttgtaaagcaccatataatgattattactccccagaattcaatatcttgggttcttttcttcttttgggccgaggccctgtttttgtggtcaactcaccttgtgtgttggctaaattattttgctttgtaacttttcgcgaccttgattacagttttatatgctatattatctgtatagatgatttaatttcagtgagctga

SEQ ID NO: 3547 - DNA, 1129 bp, Arnica chamissonis
ctgcgtgtgtgtgtttacagtaacatacaaataggcggaggcagagctgcaataagaatcagctgctgtgtaaatggcagacgctagcggcggaggtcagtacaccgaatttccggcagtggcttgccacggaggtcagttcatccggtataacatattcggtaatgaattcgagatcaccagcaagtaccgtcctcctatcatgcctattggtcgcggtgcttatggaatcgtatgttcgatgttgaactctgagacgaacgagatggttgctgtgaagaagattgcaagtgctttcgacaattacatggatgcgaagcggacgcttcgcgagattaagcttcttcgacacttagatcatgaaaatatcatatctataaaagatataatccctccacctgtacggagagagtttgctgatgtttacatcaccactgagcttatggatactgaccttcaccaaattattcggtccaaccagaacttatctgaagagcattgtcagtacttcttgtaccaactcctacgaggcttgaagtacattcactctgcaaatgtcattcatagagacctcaagcctagtaatctgctgctgaatgcaaattgtgatctgaagatttgtgattttggacttgcccgaacaagtgctgaaaatgacttcatgactgaatatgttgtcaccagatggtatcgggctcctgagctgctgctcaactcttcagattacacagctgccattgatgtgtggtctgttggttgcatcttcatggaactcatgaacaagaagcctttgtttcctggtaaagatcatgtgcatcaaatgcgcctattaacagagcttctaggcacaccaactgaatctgatcttaggtttattagaaatgaagatgcaaaaaggtatcttgctcagcttcctcaacatccccgccagtcattatcaaagatgttcccacacgttcatccattagccattgatttagttgacaaaatgttaacgctggatccaactagacgaatcacagttgaagatgcattagatcacccttatcttgcaagactacatgatgtagctgacgagccaatctgcatggatcctttctcatttgaatttgagcaacaagttctgaga

SEQ ID NO: 3548 - DNA, 1814 bp, Phaseolus coccineus
  misc_feature (1797)..(1797): n is a, c, g, or t
ttttttttctttgacggtttctagaaagagaaagtttgttagagggagagagtttggaggtgcggttcgcgtgtgagaagagagagaaagcgctcttctccgattctccgaacggtttttagagagagaaagtttcattgagagagaaagtgatggccggagttaatccgaacggcgtcgccgattttccggcggttccgacgcacggcggacagttcattcagtacaacatattcggcaatctcttcgaggttacgacgaagtaccgtcctccgatcatgcctattggacgcggcgcgtacggaatcgtttgctcgctgttgaatacggagacgaatgagctggtggctgttaagaagatagcgaacgctttcgacaatcacatggacgctaagcgaacgctccgtgagattaagcttcttaaacatttagatcatgaaaatgtaattgctttgagagatgttattcctccaccattgcgtagagagtttaatgacgtctacatagccactgaactcatggatactgatcttcatcacatcattcgctctaatcaaagtctgtcggaggagcactgccaatacttcttgtatcagattcttcgtgggctaaagtacatacattctgcaaacataatccacagagatttaaaaccgagcaacctgttgctgaattctaattgcgacttgaagattattgattttggtcttgcgcgaccaactttggaaagtgacttcatgacagaatacgtagtcacaagatggtacagggctcccgaattattgttgaactcctcagattacacctctgcgatagatgtgtggtctgttggttgcatcttcatggagcttatgaataaaaagcctctgtttccaggcaaagaccatgtgcatcagatgcgcctattgacagagcttcttggtaccccaaccgatgctgaccttgggttagtgaaaaatgaagacgcaagaagatatatcagacagcttcctcaatatcctcgccaacctttagctcaggtcttcccccatgttcatcccgcagccattgatctcgttgataaaatgttgacaattgatcccaccaaaagaattacagttgaagaagcactagcccatccataccttgaaaaactgcatgatgtagctgatgaaccaatctgcatggaaccattctcatttgagtttgagcaacagcaattggatgaagagcaaataaaagagatgatatacagggaagcattagcactcaatcctcactatgcttaaagcagaaagattcaaggacttgtaagttgttgtatcttagaaggaaaaataaaaattcgtcttcaattttttcatcaccaagttccctgcttacaagcacgaaaagtatcaagttgaatgaaaattcaatcttgttaccaaccaagctccctaggtactttattcaatctgtgtgactagttaggtgcaactacgtcttgatgagtgcccttttgttgtaaagtgccatgcaacgatattaagctccataattttttttaaccctgatgggttattattattatttttattttcttttgggcttgggtaactcatcatgtatcctgcctaagttatttgcattgtaacttcttgtaccttaattttagctattttctgctatattatctgtatagtggatttcattcagtgagcaaaccctttagagaagtagttcctgtaatggttcagaaaatttaatggatgaaccttcgtctgacatttctaatttcaagtttaatgtgtgtcttaagtatgatatattgatttncattaccatatttctgt

SEQ ID NO: 3549 - DNA, 1734 bp, Glycyrrhiza uralensis
gaaaattcaaaatctcggcctgcttcttcgacacaccatctgcaccgtcttctctctccttcaacggtttctagagagagaaagtctccttgagataggaagttaccgcgaagaaaattaattaatggccggcgttaaccataacggcgtcgccgattttccggcggttccgacgcacggcggacagttcattcaatacaacgtattcggtaacctcttcgaggttacggccaagtatcgccctccgatcatgcctatcggtcgcggcgcttacggaatcgtttgctcgctgttgaatacggagacgaatgagttggtggctgttaagaagatagccaacgctttcgacaatcacatggacgcgaagcgtacgctccgtgagattaagcttcttaggcatttagatcatgaaaatgtaattggtttaagagatgttattcccccacccttgcgtagagagtttaacgatgtctacataaccactgaactcatggataccgatcttcaccaaatcattcgctccaatcaaaatctgtcagatgaacactgccagtacttcttgtatcaagttcttcgtggacttaagtatatacattctgcaaacataatccatagagatttgaaaccaagcaacctgctgttgaatgcaaattgcgacttgaagattattgattttggtcttgcgcgaccaactttagaaagtgacttcatgacagaatatgtagtcacaagatggtatagggctcccgaattgttgttgaactcctcagattacacctctgccatagatgtgtggtctgttggctgcatctttatggagcttatgaataaaaagcctctatttccaggcaaagaccatgtgcatcagatgcgcctattgacagagcttcttggcactccaactgaggctgacatcgggttagtgaaaaatgaagatgcgagaagatatattcgacaacttcctcaatatccacgccaacctttaaacagggtcttcccccatgttcatccctcggctattgatctcgtcgataaaatgttgacagttgatcccaccaaaagaattacagttgaagaagcactagcccatccataccttgaaaaactgcatgatgtagctgatgaacctgtctgcacggagccattctcatttgaatttgagcaacagcaactggacgaagagcaaataaaggagatgatctacagggaggcattggcactcaatcctgagtatgcttaaaagttaaagcagaaagacacgaggaattttaagttaaatgggaaaatggaattcattttcgattttttcattgaagtttcctgcagtgcaaatttacaagcaggattgcaggaaaggatcaaattgaatgagaattcaatctgttgccaaccaaactacctaggtgatcctatttaatctgtgtactagttaggtgcaattacagcttgagtactaataagtgccctgctttctgttgtaaagtgccatgtaatgatattaatccccattattttttttaaccctgttttgggttatttttttgttctttttctttcggccctgttttgttggttggttaactcagcatgtattttgctcaagttttttgcattttttttgtaacttcttgctaccatgatttacagtttttttctgctatattatccgtatagtggattcgaattcagtgagaaaaatttagattacttcctttaatgattcagaaaatttgg

SEQ ID NO: 3550 - DNA, 1636 bp, Malus domestica
ctctcttcttcgtcaactcctccaccgccgaatcaacacatcagcagaaaatttgtagagggagaaactgaagactgctggagagagaaagtcgtgtctgggactcccagagtatttcgaaatggcagacctcgttcccactaacggcgatttcgcggcggtcccgtcccacggcggccagtacatccagtacaacatcttcggcaatctcttcgagatcaccaacaagtaccgccctccgatcatgccgatcggccgcggcgcatacggcatcctctgctcggttttgaattcggagacgaaggagatggtggcgatcaagaaaatcgccaacgctttcgacaatcacatggacgccaagcgcacgctccgcgagattaagctgcttcgccatttggatcacgaaaatgtcatagctatcaaggatgtgattcctccacctctaaggagagaattttcagatgtgtacattgccatggaactcatggataccgacctgcatcaaattattcgctcgaatcagggtttatcggaggagcattgtcagtacttcttgtatcagattctgcgagggctgaaatacatacactcggcgaatgttattcacagagacttgaagcctagcaacctcgtgttgaatgccaattgcgatcttaagatatgtgattttggccttgctcgtccgactgcagaaaacgagttattgacagagtatgttgtcaccagatggtacagggcacctgagcttctgttgagctcttcagactatactgctgcaatcgacgtgtggtctgtgggttgcatctttatggagcttatgaataggaagcctttgtttccaggcaaagatcatgtgcatcagatgcgcctattgacagagcttcttggaacaccaactgagtctgatcttgggttcgttcggaatgaggatgctagaagatatataaggcagctcgccccgcttccccgtcagccattggagaggcttttcccacatgttaatcccatggccattaatctcattgacagaatgttgacgtttgatcctactaaaaggataactgtagaacaagcattagcccatccttacctggaaagactacatgacatagctgatgaaccaatctgcactaagccgttctcctttgatttcgagcaacaacccttgggagaagagcaaatgaaagatatgatttacagagaggctatagcactcaatccagagtatgcttgatatgaaaagcagcattagcagttggtttatacatctataaagtagaaagagttgcacttccattggtctttgataaaaaaggttattgtgaccaaaatgttgcaatcatcagtaggctgctgatcaagtaaccgcgatcgtcctatttcgtccacatcgttactaaggtgggtttgctgttcaacaatgatcgcacttcgattttaatagacctctatgttatttttgaggtcagttcctctttgttcttttctttttggcggttgaacttgtattctatttatcttgtttgtgtctttatttttttgtttgttttttgctgtaccaaacatgtatcatgtatagcacgattgtattgatggacctaactacgcttcaataaaatacctttattccttgtga

SEQ ID NO: 3551 - DNA, 1479 bp, Ipomoea batatas
cggggactcaggcatatcgtcgatcacctgccgaggccactgcatccttcgcaatatccaactcagaaccggattgctgacatcaccatggtgggcggcggcgacttccttgcggttcagacgcacggcggccagtatgttcagtatgacatcttcgggaacttgttcgaggtcacttccaagtatgctcctccaattaccccgattggccgcggcgcttacggaatcgtctgttcggctttgaacgctgagacgaacgagatggttgcgattaagaagatcgctgatgctttcgacaatttcatggacgcgaagcgaactcttcgcgagattaagcttcttcgccatttagaacacgaaaatgtaatagctataaaggatgttattcctccaccattaagaagggaattcaatgatgtctatattgccaccgagcttatggacacggatcttcaccagataatccgatcaaatcaaggtttatcagaggagcattgtcagtatttcttgtatcagatccttcgtgggctaaagtacatacattctgcgaatgttattcatagagacttgaagccaagcaacctgttgctgaattcgaattgtgatcttaagatttgtgactttggacttgctcgcacaaatttagacaatgagttcatgacagaatatgttgttaccagatggtaccgggcacccgagcttctgttgaactcttcagattacactgctgctatagatgtgtggtctgttggttgcatcttcatggagcttatgaacagaaaacctctgtttcaaggaaaagatcatgtacatcagatgcgcttaataaccgagcttcttggcacaccaaccgattccgatcttggatctattcagaatgaaaatgcaagaaggtatatcaggcaacttccactacgtccacgccagcagttagcaaatggtttcccacacgtgcatcctttagccattgatctcatggataaaatgttgacatttaacccctccaaaagaattacagtcgaagaagcattagctcatccctaccttgcccagttacatgacaaatctgatgaacccatatgcccggttccattcactgatttcgagaaacaagcctatggagaagagcaaataaaagacatgatttaccaggaggcactggcaatgaatccaggatatgcataacaagagggcactaccattttctccccttttcttcctctgaccaacaaaacctatctgttaacttcaaatacttggatgctcctgggagcaatgcctgtgccatgttattgtaatcaaatttttttttgtgggtattatttgtactatgttataacctgttcaaccattaattattttctttcttccacgtacaatgaagtagttgtacagtggattagagtttgagttatgaaatcaagatgtactattctttggagaggctatatataacagatttgattgcaaatttgcaga

SEQ ID NO: 3552 - DNA, 1485 bp, Populus trichocarpa
aagcgaggcttacattatcgtaaattaacatgtagataatcatagaaagtcgaatctaagtatctccccttctctcttatatattaaatctcctcctctaccctctaattcttcacagcttaaattatacatcgatcaaaaaaagaattcagatattttggttttggatatactcaagagagagacgaaacagacgatcggagatggcaaattacgcaccgggaaatggtgacttcccggcgattccgactaacgggggccagttcattcaacacaacattttcggtaatctttttgaaatcacctcgaaatatcgacctccgatcactccgattggccgtggcgcctacggcatcgtctgctcggtgttgaactcggagacgaacgagaaggtggcgataaagaagatagccaacgcttttgataattatatggacgccaagcgcacccttcgtgagatcaaactgcttcgccatctggatcacgaaaacgtcattggtatcagagatgtcattcctccacctctacgcagagaatttactgatgtctacattgccacggagctcatggacactgatcttcaccatattgttcgttccaaccagggtttgtcagaggagcattgccagtacttcttgtaccagactcttcgaggattgaaatacatacactctgctaatgttattcatagagatctgaaacccagcaatttattggtaaatgcaaattgtgacttgaagatctgcgattttggtttagctcggccaacttcagagaatgagtttatgacagagtatgttgttaccagatggtatcgtgcacctgagttattgctcaactcctcagactatactgctgcgatagatgtgtggtctgtaggttgcgtctttatggagcttatgaatagaaaacctctatttccaggcaaagataatgtgcatcagatgcgcttattgacagagcttcttggcacaccaactgaatctgatcttgggtttgtccggaatgaggatgcaagaagatacatccggcaactcgattcgcatcctcatcggtcgttagctgaacttttcccactttttcaaccgctggccattgatcttgtagataaaatgctgacatttgatcccactagaagaattactgttgaagaagcattggctcatccataccttgcaaggttacatgacatagcagatgaaccagtctgcccagagcctttctcctttgagtttgagcaacaacccttgacagaagagcaaatgaaggatatggtctatgaggaggctatagcattcaatccagaatatgcataatattagggaaaatatatgtgacatccagatttttattttaatgttcctttagcactaccaatcccgatgccatttacggcaatggggggggtcactgtcacagattaaacaagaaatatcagcttttgatggtcttttgtatctgcaaattttgatcctggacttgcta

SEQ ID NO: 3553 - DNA, 1512 bp, Manihot esculenta
gaaatggctaacggtgaatttccggcggttccaactcacggcggccaatttatccaatacgacattttcggaaatcttttcgagatcacctcgaagtatcagcctcctatcatgccgattggccgcggcgcttatggtattgtctgctcggtgttgaattcggagacgaatgagatggttgcaataaagaagatagctaatgcttttgacaatcacatggatgccaaacgaacgcttcgggagattaagttgcttcgccattttgatcacgagaacgttgtagctatcagagatgtgattcctccacctttgcgaagagaattcactgatgtctacattgccacggagctcatggatactgatcttcatcagattatacgctccaaccaaggtttatcagaggagcattgtcagtacttcctgtatcagattctccgaggactgaaatacatacactcggctaatattattcatagggatctaaaacccagtaatttgctgttaaatgcaaattgcgacttaaagatatgtgattttggtttagctcggccaacggcagagaatgagtttatgacagaatacgttgttaccagatggtatagagcaccggagcttttgcttaactctacggactacactgatgcaatagatgtgtggtctgtgggttgcatctttatggaacttatgaacagaaggcctttatttccaggcaacgatcacgtgcatcagttgcgcctattgacggagctccttggcactccaactgaagcagatcttgggtttgtcaggagtgaagatgctagaagatacatccggcaactaagtcaatatcctcgtcagcctttagcccaagtttttcctcgtgtcaatcctttggccattgatcttattgatagaatgttaacatttgatcccaccagaagaatttctgttgaagaagcattagcgcatccgtacctggcaaggttacatgatgtagctgatgaaccagtgtgcccagttccattcacttttgattttgagcaacagcccttgggagaagaacagatgaaggaaatgatttacagagaggctttagcactcaatcctgagtatgcataatggagaaagtagatatgttgcctggtataatattcattcattgttcaaatgttgtttgatagaaaagagctgtggatgaaacaatgcaaccctaagagagaaatcatgttgaacacaaggcgggttactgatcaaacaagtcaaatccctctgtttgatagtcttctgtccttgtcacgggcgtgctgattttgcacccatcactacccatcagctgtacactaccttacaatctttatgaggttagtcaccttacagccttcatatgactaagaatttcttttatttttctcacttcctcttgtaagatttgctgatttgtgatttttttttttgaaatttgaactattctcaatgtagttaatgcttattgtgtgcaatagattgaatacaaatgtaaactgttgcttg

SEQ ID NO: 3554 - DNA, 1738 bp, Gossypium hirsutum
agttatcaggcgagtaagagaccattcacgctactccatcaaatctcaaccatagatctagtggcggctacaatctcagccctctcgcgcttttccttcctcttttcctcctaatacacaccaccctcctttctcactccaacacatcattaacttttcttctctctcttttctttttaatttataaaaagcccttgcgttcttcaattcctcaacacattaaaaaaaagcaagtcaacagaatacaaaatggccaacgttgctccgggaaatgccggcggtcacttcggagattttccggcgtttcatacctacggcggtcaatttattcagtacagtatttttggaaacttatttgagatcacgtctaaatatcggcctcccatcacgccaatcggtcgtggagcctacggcatcgtctgctcggtgttgaattcggagacgaatgaaatggtagcggtaaagaaaatagccaacgctttcgataatcacatggacgctaagcgtacgcttcgtgaaattaagcttctccgacatttggatcacgagaatgttatcgcaattagagatgtcattcctccgcctttgcggagagattttaatgatgtctacattgccttggagctcatggataccgatcttcaccaaataattcgctccaatcagagtttatctgaggagcattgtcagtatttcttatatcagcttcttcgaggactcaagtacattcattctgcaaatgtgattcatagagatttgaaacccagcaacctcttgctgaatgctaattgtgatcttaagatttgtgactttggtctcgctcgacctgcctccgagaatgagtttatgacggaatatgttgtcacgagatggtatagggcaccagagatattgctgaactcttcggactacacggccgccatagatgtctggtctgttggttgcatttttatggagctcatgaatagaaaacctttgtttcctggaaatgatcatgtacatcaaatgcgtttgttgacagagctgcttggcactccaactgaatctgatcttgggtttcttcaaaatgaggacgcgagaagatacatcaggcagctacctgcataccctcgtcaacagctagctaatgttttcccacatgttaatcggatggctcttgatctgattgatagaatgttgacatttgatccaaccagaagaattactgttgaagaagcattggcccatccttatcttgaaaggttacacgacatagctgatgaaccagtttgccctgagccatttaatttcgattttgaacagcaaccattgggagaagagcagatgaaggacatgatttaccgggaagccttagctctgaatccagattatgctcgataacaaaatggagttatcttctaagtgcgccactccaagtaatctttgatgtaagagtgtggtggctgatgatacataccgaccagaatatgcggatgggttgaccgccttgattttagctttcacgaggtcagtcccttgcaagccacaagactctgtgctttcgccatttctgatgtgttgatatgttatttctttgaccttgattttctgaatgtatcacatgcattatttatttgttattattattattttctgattgactgtaacacgggaaaaagatcaatcctgttgtaagaaatataaagtggaagtttacattattttgtataaatttgtcaatcaaatagtattttgtagt

SEQ ID NO: 3555 - DNA, 1749 bp, Platanus occidentalis
actcttaaaatgatcttcctctataaacgaacacctccatctcttcttctgtaaatcttcagaatccatccacatcagagaagaggagaagagatcgctaatgcaaggagctgccgctgcaactaattcggcgatgaacggcgtcccgccgcagaacacgaacgccggtcagatggccgattttccggcagttccgaagcacgacggccgcttcatcgagtacaacatcttcggtaatctgttcgagatcaccgtcaagtatcgccccccgataatgcccattggacggggggcttacggaatagtctgctctgtattgaattcagagacgaatgagatggtggctatcaagaaaattgccaatgcttttgataatcacatggatgccaagcggacgctccgggagattaagcttcttcgacatttagatcacgagaatgtcataggtataagggatgtaattccaccacctgtaccaagagcattttgtgatgtctatattgccacagaactcatggacactgatcttcatcaaattattcgctccaatcaagaattatcagaggagcactgtcagtatttcttgtatcagatccttcgtgggctgaagtatatacattctgcaaatgttattcatagagatttgaagccgagcaacctcttgttgaatgcgaactgtgatttgaagatctgtgattttggtcttgctcggccaactgcagagaacgaatttatgacagaatatgttgtcactagatggtacagggcaccagaattgctgctaaattctcagattacaccgctgcaattgatgtttggtctgtgggatgcatctatatggagctgatgaataggaaaccattatttccgggtagagatcatgtgcatcagatgcgtttactgacagagcttcttggcacacccagtgaatctgatcttgggtttgttcggaatgaagatgcaaaaaggtacatcagtcaacttgccccacatcctcgtcagtcatttgcacagttgttcccacatgtgcatccagatgccattgatctcattgagagaatgctcacatttgaccccttcaaaagaattacagttgaagaagcactggctcatccttaccttgcaagattacatgatatagctgatgaacccgtttgcctggagccattttcctttgatttcgagaaacagcccttatctgaagagcaaatgaaggagatgatattcagagaagccttagcattcaatccagagtatgttgtttagtaagtttgtatccttagtattatagaggaaatggcagtctataaacacgatatggggacaggtggtgcacttgcagggattagtgacttgccattcaccaggtctcatctagaagaacacttatgtcaaaggttaacatgatatctcgttgacttttgaagcatgatatttatttgatggggatctctgcttgtatgccacacgtgttttagttctgtgattataggctgtgttgcctgtatgtaatactctgcttgcaaacctacccattgtaagggcaattagtccccttacaaggtctttaaaattgatgacataaacttgtgagattgactggttttccttgagcctatttgtatagcctagatttgtttgaattttagctttctggtgatgtatagtgaatgagtagagtgtagaacatgttaaagttcaaaagaattgtctgagtgaactcaagaacatttgagaggtatgactaat

SEQ ID NO: 3556 - DNA, 1211 bp, Pisum sativum
taatttgacagtttagagagagagagaaattattcttgagagagaaagtgaagaaaactaatggccggagttaatcaaaacggcgtcgccgagttcccggcggttcagactcacggtggacagttcgttcaatacaacgttttcggtaatctctttgaagttactgctaagtatcgtcctccgatcatgccgattggtcgcggcgcttacggaatcgtttgttcgctcttgaacacggagacgaatgagttggttgctgttaagaaaatagcgaatgctttcgataatcacatggatgcgaagcgtacgctgcgtgagattaagcttcttaggcatttagatcatgaaaatgtcattggtttaagagatgttattcctccacccttgcgtagagagtttaatgatgtctacataaccaccgaactcatggatactgatcttcatcaaatcattcgctccaatcaaaatctgtcagatgaacactgtcagtactttttgtatcagattcttcgtggactgaggtatatacattctgcaaacattatccatagagatttgaagccaagcaatctgttgctgaatgcaaattgcgacttgaagattattgattttggtcttgcgcggccaactatggaaaatgacttcatgacagaatatgtagtcacaagatggtatagagctcctgaattgttgttgaactcctcagattacacctctgccatagatgtttggtctgttggttgtatcttcatggagcttatgaataaaaaacctctatttcctggcaaagaccatgtgcatcagatgcgcttattgacagagcttcttggcactccaactgacgctgatgtcgggttagtgaaaaatgaagatgcaagaagatatatccgacaacttcctcaatatcctcgccaacctttaaatagggttttcccccatgttcatcccttggccatcgatctcatcgataaaatgttgacaattgatcccactagaagaatcacagttgaagaagcactagcccatccataccttgaaaaactacacgatgtagctgatgaacccatctgcatggaaccattctcatttgagtttgaacaacagcatttggacgaagagcaaataaaggagatgatctacagggaggcattagcactcaatcctgagtacgcttaaaccggaacaatagaagaaatattaagttaataagc

SEQ ID NO: 3557 - DNA, 1777 bp, Triticum aestivum
gataaaacagttggcggctggaactgatggcaaacccctcggcttaatccggattaaaccctagctagcgagcgacctttccccatgccgctcccttcctcctcctccgccgccgccgtcgcggccgggccggcggcgtccccgctcgccgcccgaagccggggccgcctcctccgcgcgcgctcgggccacgccgccgtgaggtgccagagggtcgatcctgtgaggctgagggcggtcaatggatcacccccctgtgttcccctgtccgacaggtcgccgtggacccctgcgacgatgccgattttcggggacgcaaacatcaggaaggacgacacgaggctgcgcatcttctcaggaacggctaacccctcgctcgcccaggaaatagcaagctacatgggtctggaacttgggaaggtcaacataaaaaggtttgctgatggcgaaatatatgttcagttacaagaaagcgtaaggggctgcaatgtgttccttgtgcaaccatcatgccctccagcaaacgagaatctcatggagctactcatcatgattgatgcatgcagaagagcatctgctaagaatattactgcagtcatcccttatttcggttatgccagggctgacaggaagtctcaaggtcgtgaatctatagctgcaaaacttgtagctaatatgattactgaagctggtgcaaaccgtgtccttgtttgtgatcttcattcaagtcaggccatgggatattttgacatcccagtagatcatgtttatggccagccggtgattcttgattacctcgccagcaagacaattagttcaaatgacttggtggtggtgtcgcccgatgttggaggtgttgccagggcacgtgcttttgccaaaaagctatcagatgcacctctagcgattgtagataaaagaaggcatggacacaacgttgccgaggtaatgaatcttattggagatgttagaggaaaagtggccgttatgatggatgatatgattgatacggcaggaactattgccaaaggagctgagctgctgcatcaagaaggagcaagagaagtatatgcatgttgtacacatgctgtttttagcccaccagccatcgaaagattatcaagtggtttgtttcaagaagtaatcatcacgaacactatccctttgaaggaggagaagaatttcccgcagctgaccatcctttcagtcgcgaaccttctaggcgagacgatctggcgtgtccatgatgattgctcggttggccatgcgccatactccaccttggatatcgactgacgcttgtgttccactagcggcgcttccgtccaccgggggccctcgtttcatgcctaggtgagaacgggtgccatagagggtcgacctgccgtggtgtcgacaacaacaaatacagttgatagacgagatgcccaagtgataatgagcagaatgtactctttcttaatgcaggaatagttgtacaagtgccctttttttgcatgttctccaatttgttttgtggaataagctctgttagcagaaaaaaaaagacgttgactatgtgtatgagtgtggtagtatatcagatggaagtttgaactgtgtatataggcccgcttaatcccagccgttcctgttttttctttttaccattttagatgaaagtgggcccacttttaagtgtaatgatggggctgttctcactggcataatagttgaccatctatatttccgcttgggttataataattctgcttcgaacaaaaaaaaaaaaaaacga

SEQ ID NO: 3558 - DNA, 1598 bp, Brachypodium distachyon
atgccgctcccttcctcctcctccgccgccgccatcgctgccgggccggcggcgtctcccctcgccgctcgcagcctccgcggccgcccgcgctcaagccccttcttcgtgaagtgtcaaagggttgatcctctgaagctgagggcagtcaatggagcacccccctgcattcctgtgcctgacagttcgctatggactcctataacaatgccagttttcggtgacaacaaggttaggaaggatggcacgaggctgcgtatcttctcaggcacagccaatccttctctttcccaggaaatagcaagctacatgggtctagaacttgggaagattaacataaaaaggtttgctgatggagaaatatatgttcagttacaagaaagtgtaaggggctgcgatgtattccttgtgcaaccatcatgtcctccagcaaacgagaatctcatggagctactgatcatgattgatgcctgtagaagagcatctgctaagaatattactgcagtcatcccttatttcggttatgccaggtctgacaggaagtctcaaggtcgtgaatctatagctgcaaaacttgtagctaatatgattacagaagctggtgcgaaccgtgtccttgttagtgatcttcattcaagtcaggccatgggatactttgacatcccagtagatcatgtttatggccagccggtgattcttgattaccttgccagcaagacaatatgttcaaatgacttagtggtggtatcgcctgatgttggaggtgttgccagggcacgtgcttttgccaaaaagctatcagatgcacctctagcaattgtggataaaagaagacatggacacaatgttgccgaggtaatgaatcttattggagatgttaaaggaaaagtggctgttatgatggacgatatgattgatacagctggaactattgccaaaggagctgagctgctgcatcaagaaggagcaagggaggtgtatgcatgctgtacacatgctgtttttagcccacctgccattgaaagactatcaagtggtttgtttcaagaagtaatcaccacaaacactatccctctgaaggaggataagaatttcccacagctgaccattctttcagtcgctaaccttttaggcgagacgatctggcgtgttcatgatgattgctcggtcggtcacgagccatactccaccttggatattgactgatgcagctcaaggtgtgttccacttaagaagcttatgtctgtggggttcttattccatgccttggtaagaatggtcccatggagggtcaacccaccatggcgtcgataacagcaaagggttgtttttctacggttgatagacaggatagttgtgcaagtgccccttgtttttcgatcttctccgcttccatttttgtggaatgagctatctctgtgtgatctgagatcatgttagcagaaaaaacctttagctatgtctttgaatgatagtaaattagacggaagtttgattagtgtaattcaatgtgtgtgtgtatagctccacttaatcccagctattcaatttttttagaccttttattgcgagagctggtccgtttgagatgtaaaatg

SEQ ID NO: 3559 - DNA, 1638 bp, Panicum virgatum
agcgcaactaatcataaacctcgcttcaatccaccggattaaaccctagccactggcgggtggcggctccgtatccgcgcactccccccatgccgctctgccactcccccacctccgccgccgtcgccgcggcggcatctcccatcgcggcgcgcagcgggggactcctccgccgctcgcgcccagcccccgctgtcgtgagatgtaaaaagcttgattctctgagggcaatcaatggatcaccaccatgcattccagtgcccgacaggtcactattgactcctgtaaccttgccagttttcccggatccaagcatgagaaacgacacaaggctgcgcatcttctcaggcacagccaatcattccctttcccaggagatagcaagctacttgggtctagaacttgggaagattaacataaaaaggttcgcagatggcgaaatatatgtccaattgcaagaaagtgtgcggggctgtgatgttttccttgtgcagccaacgtgccctccagcaaatgagaatctcatggaacttctgatcatgatcgatgcctgtaggagagcatctgctaagaatattactgcagtcatcccttattttggttatgcaagggctgacaggaagtctcaaggccgggaatctatagctgcaaagcttgtagctaatatgattacagaagctggtgcgaaccgtgtccttgtttgtgatcttcattccagtcaagcaatgggatacttcgacatcccagtagatcatgtttatggccagcctgttattcttgattatctcgccagcaagacaatatgttcaaatgacttggtggttgtatctcctgatgttggaggtgttgccagggcacgtgcttttgccaaaaagctttcagatgcacctctagctattgtagataaaagaaggcatggacacaatgtcgctgaggtaatgaatcttattggagatgttagaggaaaagtggctgttatgatggacgatatgattgacacagcaggaactattgccaaaggggctgagctactgcatcaggaaggagctcgagaagtatatgcttgctgtacacatgctgttttcagcccacctgccattgaaaggttatcaagtggtttgtttcaagaagtaatcatcacaaacactatccctcttaaggaggagaagacttttccgcagctgactattctttcagttgctaacctcttaggtgaaacaatctggcgtgttcacgatgattgctcagttggtcatgagccatactccagcttggatattgactaacgcttaaggtgtattactcatgccgcgcccttcatgcctaggaatagtttttcatcttattttgggtgggccttagtttttattttcttgtgtgtgtactccgtaataagtggccctatgttatgtctgattccttcagcaaagaagcaaagaacctcaaacatgtattttcttgtgtgtgtactctgtaataagcggccctatgttatgtgtgattcctttagcaaagaagcaaagaacctcaaacatgtatttgaatgacagtacagtacataatttggaattttgggttgtagatttgtagtgcagtttttcagacttgatgcacgcacataccatgtcagttttcagt

SEQ ID NO: 3560 - DNA, 1514 bp, Oryza sativa
caacttaacccaaattaaaccctagccatccacctccgaccatcccccccccccccccccgcgtcccccgatgccgctctcctactcagccgccgccgccgccgcgccgtcccctctcgccgcgcgcagccgcggcctcctccgccgaccgccgcgctcttcccccgtcgtcgtgaggtgcaagaagattgatcaactgagggcagtcaatggaataccaccatacgctccagtgtctaacagatcgttgttaagtcctgtgacgctgccgattatccgggatgcgaatattaagaatgatacaaggttgcgtatcttctcagggactgccaacccttctctttcccaggaaatagcaagttacttgggcttagaacttgggaagattaacataaaaaggtttgctgatggcgaaatatatgttcagttacaagaaagcgtaaggggatgcgatgttttccttgtgcaaccaacgtgccctcctgcaaatgagaatcttatggaacttctgatcatgattgatgcctgtaggagagcatctgctaagaatattactgcagtcatcccttattttggttatgccagagctgacaggaagtctcaaggccgtgaatctatagctgcaaaacttgtagctaatatgattacagaagctggtgcgaaccgtgtccttgtatgtgatcttcattccagtcaagccatgggatactttgacatcccagtagatcatgtttatggtcagcctgtgattcttgattacctcgccagcaagacaatatgttcagatgacctggtggtggtgtctccggatgttggaggtgttgccagggcacgtgcttttgccaaaaagctatcagatgcacctctagcaattgttgataaaagaaggcatggacacaatgttgccgaggtaatgaatcttattggagatgttagaggaaaagtggctgttatgatggatgatatgattgatacagctggaactattgccaaaggagctgagctgctgcatcaagaaggagcaagagaagtctatgcatgctgtacacatgctgtttttagcccgcccgccattgaaaggttatcaagtggtttgtttcaagaagtaatcatcacaaacactatacctctcaaggaggacaagagtttcccgcagctgactatcctttcagttgctaaccttttaggcgagacaatctggcgtgttcatgatgattgctcagttggtcatgagccatactctagcttggacattgactgaagctcaaggtgtatcacgcccaatccccaatttttggcttttctccacctttggtttcgtggaataagctgtgtaatctgatgctcctactagtgcaagaacttttgagtatttcaatgaaccatagtacataagatcgaaatttaggtagtttggtttgctagcatgctcagtgtaatgtacatattgtttccacgtgatccatttatttctttgcaaagatcaatgctgaatggttcaatttattttctct

SEQ ID NO: 3561 - DNA, 1548 bp, Sorghum bicolor
aattaaaacccttgccaccggacctgattaaaccctagccaccagcctccgcgtatcctttcctttccccgattccacatgccgctctgctgctcccccacctccgctgccgccgccgcggcggcatctcccggcgtcgcccgcagcgggggcctcctgcgccgctcgcgcccagtccccggcgtcgtgaggtgtaaaaagattgattctctgagggcaatcaatggagcactgccttgtattccggtgtccgacaggtcgctactgactcctgtaaacttgccggttttccgggatccaaacatgaggaacgacacgaggctgcgcatcttctcaggcacagccaatccttccctttctcaggaaatagcaagttacttggggctagaacttgggaagattaacataaagaggttcgctgatggtgaaatatatgttcagttgcaagaaagtgtacggggctgtgatgttttccttgtgcaaccgtcgtgccctccagcaaatgaaaatcttatggaacttctgatcatgattgatgcctgtaggagagcatcagctaagaatattactgcagttatcccttattttggttatgcaagggctgacaggaagtctcagggccgggaatctatagctgcaaagcttgtagctaatatgattaccgaagctggtgctaaccgtgtccttgtttgtgatcttcattccagtcaagcaatgggatacttcgacatcccagtagatcatgtttatggccagcctgttattcttgattatctcgccagcaagacaatatgttcaaatgacttggtagttgtttctcctgatgttggaggtgttgccagggcacgtgcttttgccaaaaagctgtcagatgcacctctggctattgtagataaaagaaggcaaggacataatgtcgctgaggtaatgaatcttattggagatgtgagaggaaaagtggctgttatgatggatgatatgatcgacacagcaggtactattgccaaaggagctgagctactgcatcaggaaggagctcgagaagtatatgcttgctgtacacatgctgtttttagcccacctgccatcgaaaggttatcaagtggattgtttcaagaagtaatcatcacaaacactatccctctaaaggaggagaagacttttccgcagctgaccattctttcagttgctaacctcttaggcgaaacaatctggcgtgttcacgatgattgctcggttggtcatgagccatactccagcttggatattgactgatgcttaaggtgtatgacccatgctatgctcttcatgcctaggaatagttgtggcagctcgcaacattttttcttctttttctttggcctcagtttttctgcgtatgtgtaataatcagtgttatgtggaattctgttagcacagaatctcaaccttgtatttgagtgacagtacataagatgatgtcatagattgtagtgcagtgtttcagctatcctcaatatacatacatacggctccatcctccatgacatcccagtttttggtttccgg

SEQ ID NO: 3562 - DNA, 1556 bp, Zea mays
aattgtctcgattttgacatgcacgtagtaagctgggattcttcgtatagaccggattaaaaccctaggccctagccaccgcccaccgtcgcctcagcaaatcctcctcccgtttcaccatgccgccctgctgctcccccaccacctccgccgtcaccgctgcggcggcatctcccggcgcctcgcgcagcgggggcctcctgcgccgctcgcgcccagcccccgccgccgtgaattgtaaaaagattgattctctgaggtcaatcaatggagcaccaccttgcattccggtgtccaacaggtcgttattgactcctgtaaccttgccagttttccgggatccaaacatgaggaacgacacgaggctgcgcatcttctcaggcacagccaatccttccctttcccaggagatagcaagttacttggggctagaacttgggaagataaccataaagaggtttgctgatggtgaaatatatgttcagttgcaagaaagtgtacggggctgtgatgttttccttgtgcaaccgtcgtgtcctccagcaaatgaaaatcttatggagcttctgatcatgattgatgcctgtaggagagcatctgctaagaatatcactgcagttatcccttattttggttatgcaagggctgacaggaagtcccagggcagggaatctatagctgcaaaacttgtagctaatatgattaccgaagctggtgccaaccgtgtccttgtttgtgatcttcattctagtcaagcaatgggatactttgacatcccagtagatcacgtttatggccagcctgttattcttgattatctcgccagcaagacaatatgttcagatgacttggtagttgtatctcctgatgttggaggtgttgccagggcacgtgcctttgccaaaaagctgtcagatgcacctctagctattgtagataaaagaaggcaaggacataatgtcgctgaggtgatgaatcttattggagacgtgagaggaaaagtggctgttatgatggatgatatgatcgacacagcaggtaccatttccaaaggagctgagctactgcaccaggaaggcgcccgagaagtatatgcttgctgcacacatggtgtttttagcccacccgccatcgaaaggctatcaagtggattgttccaagaagtaatcatcacaaacaccatccctctgaaggaggagaagagttttccgcagctgactattctttcggttgctaacctcttgggggaaacaatctggcgcgttcacgatgattgctcggttggtcatgagccatactccagcttggatattgactgatgcttaaggaatagttgtggcagctcgcaaccttctctttcttttcttttggcctcggtttttgtctgtgcgtgtaataagcaatgtttttgtggaattctgttagcgcagaacctcagccttgtatttgagtgacagcacataagatgacattccagattgtagtgcagtgtttcagctatcctcaatcacagcacataatatgtgtttgcttgcagtattattaggctttatata

SEQ ID NO: 3563 - DNA, 2532 bp, Brachypodium distachyon
cgcggcgggggcggggatggcggcggcgccgcctgccgacgggcaggagaaggtgatcgcggcggcgcagcacatcgtcaagtcgctcgccaactccaagaacgccgcggacgacatgatccgcatcctctcgggcttcgacaaccgcttctccctcatgtccgacctcttcccggctccacccaacgccggtcccggatgcggctccgtcccggaggatgagggcgagggcgggggcggggcctacggggaggaggacgactaccagcgggagggccctggccctagcggcggcggcgacgacgaggacgacgagagggacgcggcggtggaggaggcggtgcgggtggtggagcagtgggattcccccgcggcgggggaccggctggtgttcgagtcgtcggaggacgcggaggagtacctcggcgccgccgcgtgcctcgtgggcgcggcggggccgcgcgtggaggcggcgctgcaggtcgccatggcgcggctcgaggaggagttccgccagctgctgatccgcgggacctcgtcgctcgccgccgaggacctgcacgcctccctcctccgccggctctcgctcacggtacccaccttctactccgcagccggcgacctggactgcccctccttcgcgagccacggtgaagagggggacgaatctgcgggcgcgggcagatggagctcggtctcggacggcgagatctcgccctacctcattgccccggacacggtcagcgccctcagggacatcgcggacgtcatgctgcgcgctgggtattcgcctgagctttgccaggtctacagcgaggtgcgccgggacacgcttatggagtgccttgccgtgcttggggtcgacaagatgagcctggaggaggtgcagcgcgtggaatggggcgtcctggacggcaagatgaagaagtggatccaggcgctcaaggtcgttgtccagggccttcttgccgaggagcgccgcatctgtagccagatccttgcgtccgacgctgatgccgaggaggagtgctttactgaggcggccaaggggtgtgtcctgcagctgctcaactttggtgatgccattgcgatcgggaagagatcctctgagaagctgttccgtattcttggcatgtatgaggcgttagctgagttgctgccagagctcgaggcattgttctctggtgaggcgagggatttcatcaaggaagaggcagaggggatactcgtgaggctaggggatgcagtccgaggcacggttgctgagtttgccaatgcgatacgtggggagacttctcgcagaccactgcctggtggcgagatccacccgctcacgcgctacgtcatgaactatgtacgactgcttgctgattacagccgctggctgaacgatctgcttgatggctgtgagtctgagctggaaactgggggtgaaaatgtggatatgactccacttggacactgtgtgctcatactgatcacaaatctgttggacaagattgaggataaatcgaagctgtatgatgatgaggcactgcagaacatatttctgatgaacaatctgtggtacattgtgcagaaggtgaaggattcagagctaaagacattgcttggggataactggatccgcaagcgccgtggtcagataaggaggtactccacaggttacctccgatcctcatggactagggtattagcttgtctgagggacgatgggttgccacaggcaacaggttcatcgagtgcactcaaggctgcactgaaagaaaggttcaagaacttcaacttgacttacgaggagttatacaggacacagacagcatggagggttgtggatcctcagttaagagaggagttgaaaatttctatctcagagaaggtccttccagcataccgctcgtttgttggaaggttccgaggccagctagaggggggaaggaattttgcgaagtatataaagtacaaccctgaggatgtggagaaccaggtctcagatttctttgaagggaaaagattgaatgcttaatcaatctgtctacatttcaagggatgttcatatcaatgttggtggttacaagtccctagcaatattcattcagtccccgtactagggaacttgctctgccaacattcttttgaggtttgaagatggagaaatcagttttgactagaggggcgtaaatgtggtaaattgcaaagcaaacagacatcttgattgtttcatggtgggtgctgacatttgtgcttgggcttccacatggaatttaggaccctgcggtgaactgtgtaactgctattcttacagtttaccttttgttgattgttgacttgttggacttcagaagaatggttgccggtcggtggttggcattttatgtacattttataccagcagttatgttcagttgttcacttttaccttagtgcaaattttgttatcttcagtttagttggttgcttgcagaaagtatgataacttaaaaatgttgactgatagcactgaatccttttgcatatgttcttcaacttcga

SEQ ID NO: 3564 - DNA, 2547 bp, Triticum aestivum
  misc_feature (10)..(10): n is a, c, g, or t
  misc_feature (300)..(300): n is a, c, g, or t
  misc_feature (655)..(655): n is a, c, g, or t
  misc_feature (658)..(658): n is a, c, g, or t
  misc_feature (687)..(687): n is a, c, g, or t
  misc_feature (699)..(699): n is a, c, g, or t
  misc_feature (725)..(725): n is a, c, g, or t
  misc_feature (739)..(739): n is a, c, g, or t
  misc_feature (747)..(747): n is a, c, g, or t
  misc_feature (755)..(755): n is a, c, g, or t
  misc_feature (761)..(761): n is a, c, g, or t
  misc_feature (763)..(763): n is a, c, g, or t
  misc_feature (766)..(766): n is a, c, g, or t
  misc_feature (1189)..(1189): n is a, c, g, or t
  misc_feature (2011)..(2011): n is a, c, g, or t
  misc_feature (2017)..(2017): n is a, c, g, or t
  misc_feature (2537)..(2537): n is a, c, g, or t
acccacgctnccggcctctgccccccttctaccgccgcgactccgctgccccctttcacaactgcctcctccgatcggagaggctcaggcggcgcggcgcggcgcgggggacgggatggcggcggcgccgcccgacgggcaggagaaggtgatcgcggcggcgcagcagatcgtcaagtcgctcgccaactccaagaacgccgcggacgacatgatccgcatcctctccggcttcgacaaccgcttctccctcatgtccgacctcttcccggccgccggggcggggggggccgcggtcgnctccgagcccctcccggagggggattacgcgcgggaggggcttcccggccccggcggcggcgacggcttcggcgacgacgacgacctggaggacgagagggacgcggcggtggaggacgcgctgcggctggtggagcagtgggactcccccgcggccggcgaccggctggtcttcgagtcgcccgaggacgccgaggagtacctcgccgccgccgcctgcctcatgggcgaggccggcccgcgcgtcgaggcggcgctgcaggtcgccatggcgcgcctcgaggaggagttccgccagctgctcatccgcgggaccgcctcgctcgccgccaggacctgcacgcgtccctcctcngcngcctgtcgctcacggtgcccaccttccantccgcctcctcngtcgacctcgactgcccctccttcgncagccacgccgacnagggcgangagtccgnttccgngnccngatggagctccgcctccgacggcgagatctcgccctacctcatttcccccgacaccgttcagcaccctcaaggacatcgcggacgtcatgctgcgcgccggctatgggccggagctctgccaggtctacagcgaggtgcgccgggacacgctcatggagtgcctcgccgtgcttggggtcgacaagatgagcctggaggaggtgcagcgcgtggagtggggcgtcctcgatggcaagatgaagaagtggatccaggctctcagggtcgtcgtccagggccttctcgccgaggagcgccgcatctgtggccagatccttgcggccgatgcagatgccgaggaggagtgctttactgaggcggccaaggggtgtgtcctgcagctgctcaacttcggtgatgccattgcgattggcaagaggtcntccgagaagctgttccgcattcttggtatgtacgaggcgctagctgagttgctgccagagctcgaggccttgttctcaggcgatgcaagggatttcatcaaggaagaggcagaggggatactggtcaggctaggggatgcggtgcgtggcacggtcgctgagtttgccaatgcgatacgtggggagacttctcgcagatcactgccagggggcgagatccacccgcttacgcgttatgtcatgaattatgtgcgactgcttgcagattacagccgctggctgaatcatcttcttgatggttgcgagactgagctggaaaatgggggtgacaatgcggatatgactccactgggtcactgtctgctcatactgatcacacatctattggacaagattgaggataaagcgaagctgtatgatgatgaggcactgcagaacatatttttgatgaacaatctgtggtatgttgtgcagaagatcaaggattcagagcttaagagtttgcttggggataactggatccgtaagcgccgtggtcagataaggaggtactctacagggtacctccgatcctcatggaccagggtattagcttgcctgagggatgatgggttgccacagacaacaggttcatcgagtgcactcaaggctgccctgaaggaaaggttcaagagcttcaacttggcttacgaggagttatacaggacacagacagcatggaaggttgtggatcctcagttaagagaagagttgaagatttccatctcggagaaggtccttccagcataccgttcgtttgttggaaggttccgagggcagctngagggnggaaggaatttcgcaaagtatataaagtacaaccctgaggatgtggagaaccaggtctcagatttctttgaagggaaaaaattgaatgcttgatcaaactgtctatgtttgaagggatgttcatatcaatgttggtggttacaaatccctggcaaaatttattcaggcagtgtgctagtaacctgccctaccatcatgcttgtggggttcgaagatggagaaatcaattttgactgctgctggagcagaaatattgtgaatgcaaggcaccctggctggaatactttgcgtgtcatctttgactctttttaaggggagtgctgacattggcgcttccacatgggatttaggacactgcggtgagctgtgtaactgtcattattacagtttacccttcttttgttgattattgactattgttggatggtcggtggttggcatcttatgtacaatttatacagcggttatgttcactttccccttgttgcaaaaaaacctcggccgcgaccacgctaatcantagtgaattc

SEQ ID NO: 3565 - DNA, 1811 bp, Triticum aestivum
gcgggccaaggagagaaaataggctcctcgcggctcgccaaggccgtattctgcagccagccaccgccactctccgccgccgtgatccgcctcggttccgccgtgccggggctgctcgagagagcgagggagccgctcgtgtctcgccgcctccggccgatatcatattttcctcttatcctgccctccccgtggtttgggtctcagggaccaaaccatcccaccgcggcttgctggcgaggtgaagacataagattgtccttcgctggagtttaccaatgtcggcaggagccactgtaaactggatcagaaccccatttcacacccagagatttcatgacttctcaagtttaagttttagatgccgaaacacttttggatcaattcagccttgctggttggcaactgatcaggattcatccctctccaaagtccgtgtggctgcagactactcagattcagtgccagattccaagtacatgagagatcggggataccatcctcttgaagaaatcaaagaacgcccaaagaaaaaagacatttcactgacagatgtagaaacagctagaacagtagtagaggcaaatagcaagggattgctcgtatttcctgccagggtccataatgaacctcatggacatgtttcttggtcagaatttcagtatgctgttgatgactatggagacattttctttcaagtacctgatgatgggaacatcttggaagatgatgatgcaaacaaccctgtgacagttttgatcggaacggatggtgccattatcggtgaaactagtgcggtaactagtgatttcagcgaccacgtggtcgttgaggattctatggacatgcatgataatgacagcaaggttgacacagaaataacggatattcttatagagtggggaatgccagtgacgatgcgttcaatacatcctatatattttgccaagtgtttgacaaaggctgttcatgataatcatggggagaagatcgataatccatcaaacggtgtctctattgtaggatacctgagacctgcttttatagaagaagagtcttatttgaggagtttatttggtgctgaatgcagtgccgatggttattcatctaattggagagaggaatacaacagagaaccccggccagcttctggaaccaatggcctaattgatggtgataaatcgaaatcggacatcaacgatacggaaagtagcattgattcaaccatctacaagctggaaatgatgtcaattgagctgttttctgtctatggtaagcagtttatgattgatccacaagactttcaagatgcagaaccagatcttctttcaaatcatgcttcggacattataaaacgcgtcaaagaaaacagtgatcagtgtaccatggctctaaggtccctctgtagccggaaaaaaggccttacagtagaggatgcaagtttgataggtgtcgatagtcttggtatcgacgtcagagccttttctggcttggaagctcggaccgttcgattttcattcaatgcccaggcgttatctgaacgttcagctgaaaagaagatcaagcgaatgctttttccgcgttatcgcaagaccgtgaaagcttccgctgaagatgaatgttagccaacttatttaattttagcttcgaacgcctaacagtaaactggtgaggacaaagggtgtgcagggaactcaacagaagatgtgcacccagtcagctcccaattcgtaaggagaagctaacacccgtcgacatgaaatgacctcaagtgctagagtgctcgatcgaggtttcggcttcgtcggcta

SEQ ID NO: 3566 - DNA, 1935 bp, Brachypodium distachyon
aacctctttttgcggccgcctgttggtgagagcataatttggttgtcttttgctagagtttaccaatgtcagcaggggccactataaactggattaaaaccccattcggcaccaggagatgtcatgacttctctagtttaagttttagatgccgaaacacttttggatcaattcagccttgctggttcgcaactgataaggaatcatccctctccaaagttcgtgtggctgcagattactcagactcagtgccagattcgaagtacatgagagagcggggataccatcctcttgaagaagtaaaagaacgtccaaagaaaaaagacctttcactaacagatgtagaaacggctagaactgttgtagaggccaatagcaagggattgcttgtatttcctgccagggtgcataatgaacctcatggacatgttgcttggtcagagtttcagtatgttgttgatgactatggagacattttctttcaagtacctgataatgggaacattttggacgatgatgacgcaaacaaccctgtgacggttttaattggaacagatggtgccattattggagaaactagtgtggtaactagcgatttcagcgaccacatggacattgaggattctatggacatgcgtgatgattacagcaagattgatacagaaataactgatattcttatagagtggggaatgccagtaacgatgcgtgcaatacatcctatatattttgcgaagtgtttgacaaaggctattcatgacaatcatggggagaagatggataatccgtcaaatggtgtctccattgtaggatatctgagacctgctttcatagaagaagaatcttatttgaggagcttatttcgtgctgaatgcaatgctgatggccaatcatctaactggagagaggaacaccacagagaacctgtgtcagcttatggaactaatggcctaatcgatgatgataaatcgagaatagactcgagtgatgcgggaagtagcatggaatcaatgatctacaagctcgaaataatgacaattgagttgttttccatctatgggaagcagttgatgattgatccacaagactttcaagatgcagaaccagaccttcttacaaattacgctccagatattataaaacgcatcaaagaaaacaatgatcaatgtactatggctctgaggtccctctgtagcaggaaaaaaggacttgcagtagagggggcaagcttgattggggttgatagtcttggtattgatgtaagggctttttctggcttggaagctcggactgttagattttcctttaatgcacaggcgctatctgaacgttcagctgaaaagaagatcaggcgaatgctttttccacgttatcgcaagtctgtcaaagtacctgctgaagatgaatgttagacaactaatttatttcccttcgaccaccaaactctgatagtgagtagacaagggtgcaaagggaactcaacaccaatattgcatccagtcttctcccaattcaataggagaagttcacatccgtcgactatgaaattatctcaagtattagagcacctgatcgaggtttcgacttcatcggctatagaaggtcgaccacccatggtttctgacaaataaggtggtggccatgtacaaaagagcatccttgtcggtgcaatctgcaactgactaagttcggtcagccccaagttttcctccgggaaaaaaaaaagggtgcagtgcaggaaacaccaaatacataggatataaataacctcagtgccagcatagagctgttaaattatcgattgtgtcatagtaataagctcttactgcaacttgtaactaactatcagtcaatgtttttcactgaaactggtaattaactaccagaagattttttttttctttccgtaactgaataaatgcgattccatttgcc

SEQ ID NO: 3567 - DNA, 2199 bp, Oryza sativa
cttgggaactgctctgctactaaccctgtattattctgcaggagagaggcagattgcccaaaaagccctcacactgtcccacactcccactgctcgccaagtccaagaaagggaaacaaaaaaaaaaggggggaggagagacgaagagagagacaagaacaagaaagggcaaaggcaggggaagaaagcagcgaaaggattcaacgcagctcgcgaaggccgcgatccgccgcctcgcctatccttcttgacagccgaccttggggcggatttaccgaacatatttgatcgttctttgctggagtttatcaatggcagcaggggtcacttttaactggattaaaaccccacttgacatccggagatttcatgacttttctagtttaagttttcgatgccgaaatacttttggatcaatccaaccttcctggctgacaacagaccaggaaccatctttttccaaagttcgagtggctgcagattactcagattctgttccagattcaaagtacacaagagatcggggttaccatcctcttgaagaagttaaagaacgtccaaaaaagaaggacctgtcactgacagatgtggaaactgctagaactgtagtagaggccaatagcaagggattacttgtgttccctgcaagagtgcataatgaacctcatgggcatgttgcttggtcagactttcagtatattgtagatgactatggagacattttctttcaagtacccgacagtgagaacatcttggaagatgatgctgcaaacaatcctgtgacagttttgattggaatggatggccctattattggagaaactagtgtggtgactagtgattttagcgactacatggatgttgaaaattttatagacatgcctgatgagaacgacagcaagatcgatacagaaataactgacattcttatagagtgggggatgccagcaacaatgcgtgcaatacatccaatttattttgcgaagtgtttgacaaaggctgttcatgataaacacagggaaaagatggatagtccatcaaatggtgtctcaattgtaggatatttgagacctgctttcatagaagaagaatcttatctaaggagcttatttcatggtgagtgcaatggtgatggttattcgtctgattggagagatgaatgcaaaagagaacctgcaccagcttctggaaccaatggcctaattgatgatgataaatcgagatttgatttcacgaatgtgggaagtagcactgattcaacaatctacaaactggaaataatgacggttgagctgttttccatatatgggaagcagttgatgattgatccacaagattttcaagatgcagaaccagatattcttgcaaattctgcttcagaaattataaatcgcattaaagaaaacgatgatcagtgcgctatggcactcaggtccctctgtcataggaaaaaaggcctcactgtcgaggaggctagcttgattagcatcgacagtctcggtatcgatgtaagagctttctctggtttggaagctcggacagttagattttcgtttaatgcgcaggcactctctgaacgttcagcagagaagaagataaggcgaatgcttttccctcgtcgtaagaacgtgaaaccttctactgaagatgaatgttaacctatcaaaacctggttaggacacaagagagtaaagggattcagcataagatgtgcatccaatctgatgcgaattcgttagagatactgcaaatctgccgactatgaaaatgacctcatttcctgaagagttagataactttgatccaggttttgatctgattggtgaaagaaaaaagagaaaagaaagaaggatcacccatggtttcttgcaagcaaagtggtggtcttgtaaaggtgaaagaagtgaagtaagatgctagcatcaatccgcaactgacaaaaagtttcatcagccacccataaatttgtcatcaaagaaaaaaaataaactgtaaaacaggccagattaataagatctctttggcctgtaataatctctccatttcctatcaacctgtaactaatttaactgccatttttcccccctcatgcctgaataaaatgcaactccaatgtaaatccactgagaaatcctgatgttttctgacaagtgacattctcctttcttgacaggcgtgcgtgcttggtcatgagtatta

SEQ ID NO: 3568 - DNA, 4488 bp, Brachypodium distachyon
cactgatccaatcgggaatcctcctctctcctgccacatcgcccgtacacgcaccccacctctctctctctctgtgccgggctccggcgccagcgttgtgcgctcccacttaacatccgcctccaggtgatcgtccatggggtctctcacggcggcggcggaggaggggacggcagctaccgccatcgcggcggaggactggtccgccgaggcggtcatctacgtcaacggcgtccgccgtgtgctccccgacggcctcgcccacctcaccctcctccaatacctccgagatattggccttcgaggaacaaagcttggatgtggtgaaggtggttgtggagcctgcactgtcatggtttcatgctatgatcaaattacaaagaaatcagagcattttgcaataaacgcatgcttggctccactttattctttggaaggaatgcacataatcacagttgagggaattggagatcgccagcgaggtttgcacccagtccaggaatgtttagctaaggcacatggttcacaatgtggattttgcacccctggttttgtgatgtcaatgtacgctctgctgagatcaagcaaagatcctcctactgaagaacagattgaagacagtcttgcaggaaatttgtgtcgatgtactggttacagaccaatcatagacgcctttcgtgtttttgcaaaaacagatgattccttgtatactgattcaccttcagaaaatgctaatggccaagctatctgcccttcaactgggaagccatgttcgtgtagaaacgagacagatgtcagtactaatgaatcgctgttattgtcatctgcaaaaatctacttaccgtgttcatataatgaaattgatggaaatgcatacaatgagaaagagctcattttccccccagaacttcagttgagaaagtttatgccacttaaattgaatggatttaatgggatcaggtggtatagacctcttaaactacagcaactactgcatttgaaatcttgctacccagatgcaaaacttatcattggtaactctgaagtgggagttgaaactaagttcaagaatgcgcagtataaggtcatggtctcagtcagtcatgttccagagcttcataccctcaaagtggaagaagatggcttacgaataggttctgcagttagacttgcacgtctccaaaatttcctcaaaaaggttattatagagcgtggttctgatgaaacttcatcttgtcaagcaatattgcggcagttaaaatggtttgcggggacacaaatcaggaatgttgcttctgttggtggtaacatttgtactgctagtccaatatcagacctaaatccactttggatggctacaggtgcaaaatttcagataatagatgttaacaataatgttagaatcaccgctgcaaaagatttcttccttggttaccgtaaaattgatttaaaacctgatgaactgttgctctctgttatgctaccttggacaagacaatttgaatatgtcaaagaatttaagcaggcacatagaagagaggatgacattgctttggtgaatgctggaatgcgtgtgcatattagagaagcggaaggaaaatggatagtgtctgatgtctctattgtctatggaggggtagctgctgttccgcttactgctacaaaaactgaaaatttccttactggaaagaaattggactccggattgttggatgagaccttcggtttattgaaagaggacatcccactggcagagaatgcacctggtggaatggttgaatttcgcagttcacttactttgagtttctttttcaaatttttcctttatgttactcacgagatgaacataaaaggattgctgaaagacgagatgcatgcagctaacctgtcagctatacagtcttacactaggcctgtcactgttggaactcaggattatgaatcggtgaggcaaggaactgccgtgggccaaccaatgattcatatgtcagctatgcttcaggtcactggtgaggcagaatatactgatgacacaccgacgcccccgaataccttgcatgctgctctcgtgctgagtaagaagcctcatgctcgcatattatctattgatgattcacttgccaaatcttcccctgggtttgctggtctcttcctttcaaaagatgtacctggtgctaaccatactgggccaattatacatgatgaggagatttttgcatctgatattgttacttgtgttggccagatcattggaattgttgtggcggatacccatgataatgctaaagctgccgcaaacaaagtaaatattgagtattctgagctgcctgcaattttatcaatagaggaagctatcaaagctggcagctttcacccaaataccaatagatgccttgaaaaaggagatgttggagaatgttttctgtccaatacatgtgacaaaattatcgaaggagaagttcaagttggaggtcaagagcacttctatatggaacctcaatgcactcttgtctggccagttgactctggaaatgaaattcatatgatttcatctactcaagctccccaaaagcaccagaagtatgtcgcttatgctcttggtcttccactatcaaaagttgtttgcaagactaagcgtattggtggtggatttggtggaaaagaaaccagatcagcaatatttgctgccgcggcatctgtagcttcgtattgtctaagaaggccagtgaagattgttttggacagggacatcgacatgatgacaactggacagaggcacagttttctagcaaaatacaaggtgggatttaccaatggcgggaagatagtagccttagacctcgaaatttataacaatggtggtaattcactagatctgtccctctcagtcctggagcgtgctatgtttagttcagataatgtctatgatatatcaaatatcagagtcagtgggcaagtatgctttacaaattttcccagcaatactgcttttagaggttttggtggtccacaaggcatgttgattgcagagaattggattcagcacatggctacagaactaaagagaagtcccgaggagataaaagaacttaatttccaaagtgagggcattgttcttcattatggccagttgctccagaattgtacaatacattcagtgtgggatgaactaaaggcatcttgcaattttgtggaagctcgcaaagatgtaaatagttttaatggtaataatcgttggaggaagcgaggaattgctatggttcccacaaaatttggcatatccttcactgcaaaattcatgaatcaggctggtgctcttgttcaagtttatactgatggcactgtcctggtaacacatggtggggttgagatgggacaggggttacacacaaaggtagcacaagttgctgcttcgtcattcagtatccctctaagctctgtatttatctcagagacaagtactgataaggttccaaatgcttcaccaacagcagcctctgctagttcagatttgtatggtgctgcagttttggatgcttgtcaacaaataaaggctcggatggaacccatcgctagtagggggaaccacaagtcctttgctgagttggcccaagcatgctacatggaacgggtagatctctctgcccatgggttttatatcacccctgatattgggtttgactggatggtgggcaaggggactccatttaattatttcacctatggatccgcatttgctgaagttgaaattgacaccctaactggggatttccatacaaggacagctgacattgtcatggatctcggctattcaattaatccagcaattgatattggtcagattgaaggtgctttcattcaaggtttgggttgggcagccatggaagagctaaaatggggggatgacaaccacaagtggatccgacctggacacctattcacctgtggtccgggttcctacaaaataccctctgtaaatgatatacctctaaagttcaaggtttcactgttgaagggcgttccaaatccaaaggccatccactcatccaaggctgtaggagagccaccgttcttcctcgcctccgctgttttgtttgctataaaagacgccatcgccgccgccagggctgaggagggtcatgtcgactggttccccctcgataacccggcaacacctgaaagaataagaatggcgtgtgttgattccataacaaagaaatttgcgagtgtatactaccgtccgaagctcagtatatagcggtgactgccagacatgcgacacatgacagatgtgagaaaactacgatagtggttactgccagacatacgacacatgacaaagatgtgtgaagactacgatagtggttactgccagacatacgacacatgacacaaatgtgagaaaagtacgatacagtgtaaccttcatactacgtatttatctggagcgagtatgctgcatttcactttctaccatctacatggtca

SEQ ID NO: 3569 - DNA, 4629 bp, Sorghum bicolor
gtagaatagccccggaccggggcggcggtgcctctctagccgcgcgccagtccgccaccggcgctcgctcgtcgtcgtctcagtcatcgctcacgtccatgcacctttccacttccaccacacttggagttggagagcagaggtgcagactgcagagtcccgagcgcgcatccaacctcgacctagtccgccgggcggccggaacccatttggtctagccgtgcttcttccccacctctgcccggaatctgatggggtcgctcacgagggcggcggaggaggacccagcagcggctgcggaagaggagtggtccgacgaggccgtcatctacgtcaacggcgtccgtcgcgtgctccccgacggcctcgctcacctcaccctgctgcagtaccttagagatattggccttcgaggaacaaagcttggatgtggtgaaggtggttgtggagcctgcactgtcatggtctcttgctatgaccgaattacaaagaaatcactgcattttgcaatcaatgcatgcttggctccactttattctgtggaaggaatgcatataatcacagttgagggaattggagatcgacagcgaggtttgcacccagttcaggaatgtttagccaaggcacatggttcacaatgtggattttgcacccctggttttgtgatgtctatgtatgcactgctgagatcgagcaaacagcctcctactgaagaccagattgaagactgccttgcaggaaatttgtgtcgttgtactggctaccgaccaattatagatgccttccgtgtgtttgccaaaacagataatttggcatacaccaattcatcttcagaaaatacaaatgaccaagctatctgcccttctactgggaagccatgttcctgcaggaatgagacagatatcaatgttaatgagtcctcattaccgtcgtctgtggaaagatattcgccttattcatacaatgaaattgatgggagtgcatacaacgagagggaactcatcttccccccagaacttcagttgaggaaagttatgccacttaaattaaatgggttcaatgagatcaaatggtataggcctcttaaactaaagcaattattacatttgaaatcttgctacctggatgcaaagcttatcattggtaactcagaagtgggagtcgaaacaaagtttaagaatgcccaatataatgtcatgatctcagttactcatattccagagcttaataccctcaaagttaaagaagatggcatacacattggttctgctgtaagacttgcacaacttcaaaatttccttaaaaagattatagcagaacgtgatttgcctgaaacttcgtcatgccaggcaatagtacgtcagttaaaatggtttgcaggtacacaaatcaggaatgttgcatctgttggtggtaacatttgtactgctagtccaatatcagacctaaatccactttggatagctgtaggtgcaaaattccagataatagatgtgaacagcaatgttagaactatccttgcaaaggatttctttcttggttaccgtaaagttgacataaaacctgaagaaatattgctttctattatcctaccatggacaaggccttttgaatatgtcaaagaatttaaacaggcacatagaagggaggatgatattgctttggttaatgctggaatgcgtgtgtatttacaagaagctgaaggaaattggataatatctgatgtttcaattgtctttggtggagtagcagcagttccacttagtgcttcaaggaccgaaaactttcttactggaaagaagttggactctgggttgctggatgatactttcaatttattgaaagaagacatatctctttcagagaatgcacctggtggaatgattgaatttcgcagatcgcttactttgagtttctttttcaaatttttcctttctgttactcatgaaatgaaagtaaaagggttgttagaagatggattgcatgcagatcatctgtcagctgtacagccttacagtaggcctgttactgttggaactcaaagttatgaattagtaaggcagggaacttctgtaggtcagccaatggttcatatgtcagctatgcttcaggtcactggtgaggctgaatacactgatgacacaccgacacctcccaatactttgcatgctgctttggtgctgagtaagaaggctcacgctcgcatattgtctattgatgattcacttgccaaatcttcccctggctttgctgggctgttcctttcaaaagacatacccggtgttaaccataccggaccagttatccatgatgaggagttttttgcatccgacattgttacttgtgttggtcagatcattggaattgttgttgctgatacccatgataatgcaaaaactgctgccaacaaagtacatatcgagtattgtgagctcccagcaattttatctatagaggaagctgtcaagaatggaagctttcatccaaataccaagaaatgccttgtaaaaggcgatgtagaacaatgtttcctgtctggtgcgtgtgacagaattgtatcaggacaagttcatgttggaggtcaagagcatttttacatggaacctcaatgcactcttgtctggccagtggattctggaaatgaaattcatatggtctcatctactcaagctccacagaagcatcagaaatatgttgctagcgttcttggtcttccacaatcaaaagttgtttgcaagactaagcgtattggtggcggatttggtggaaaagaaaccagatcagcaatatttgctgctgcagcatctgtaccctctttctgtctgagaaggccagtaaagcttgttttggacagagacgttgacatgatatcaagtggacagaggcacagtttccttgggaaatataaggtgggatttaccaatgaagggaagatactggccctagacctggaaatttataacaacggtggccattcacttgatctatcccttgcagtactggagcgtgctatgtttcattcagaaaatgtctatgacatagcaaacatcagaatcaatgggcaagtatgctttacaaacttcccaagtaacactgctttccgaggttttggtggtccacaaggcttgttgatcgcagagaattggattcaccatatagctacagaactccaacgaagtcctgaggagataaaagaacttaattttcacaatgatggagttgtgctgcattatggccagttgctccagaattgtacaataggttcagtttgggatgaactaaaatcgtcttgtaattttgtggaagctcgcaaagctgtgaatagttttaacagtaatagccgctggaggaagcgaggaattgccatgattcccacaaaatttggcatatccttcactgcgaaattcatgaatcaggctggcgctcttgtgcaagtttacactgatggcactgtcctggtaacacatggtggggttgagatgggacagggtttgcacacaaagatagcccaagttgctgcttcatcattcaatatccctcttagctctgtatttatatcagagacaagtaccgataaggtcccaaatgcatcaccaacagcagcctctgctagttcagatctgtatggagctgcagttttggatgcttgtcagcaaatcaaggttcgaatggaacccattgctagcaaaggaacccacaactcgtttgcagagttggctcaagcatgctacatggaacgtgtggatctatctgctcatgggttttatgctacacctaatattgggtttgactggacaattggcaagggaactccgttcaattatttcacatatggagctgcatttgcagaagttgagatcgacaccctaactggggatttttacacaaggacagctgatattgttatggatcttggcttttcaattaatccagcaattgacatcggccagattgaaggagcttttgtccaaggattgggttgggcagccatggaagagctaaaatggggggatgataaccataagtggattcgacctggacacctcttcacctgtggtcctggttcttacaaaataccctctgtaaatgatatacctctaaatttcaaggtttctctattaaagggggttccaaatccaaaggctattcattcttccaaagccgtgggagagccaccatttttcctcggctccgctgtcttatttgcgataaaggatgcgatctttgcggcaagggctgaggaggggcacttggagtggttcccactcgacaacccggcgacaccagaaagaataagaatggcgtgtgtggattccattacaaagaaatttgccggcatagattaccgacccaagcttagtgtatagcggctgctgggctgattatacggaagaataaattgtgaatagaagcccacgcttgtaaagtttcatgctcttgtgctagaaataatggagggacggtttagggttactgaacatcgttcagtgcctgaaaatataggtggaaaacaatatactactcctgtatgtatattgtaactgttcggatttcccacagatggcaactgtacaaatccattgggttttgccaaactcatgcctgcgaaaataaaatctgccagttaaa

SEQ ID NO: 3570 - DNA, 4479 bp, Oryza sativa
gcacgtcacccaccccaccccgcttccaaatactcccagagtcccgcggccgcagcgcactactactactacttctgcttcactctctctctctccccgatcccaatctcggagagagagacgtcctcatccatccatcccatccactcgagttgatcgatcgcccggacgccgccgcaggggccatggggtcgctcaccagggcggaggaggaggagacggcggcggccgaggagtggtcgggcgaggcggtcgtctacgtcaacggcgtccgccgcgtgctccccgacggcctcgctcacctcaccctgctccaatacctcagagacattggtcttcctggaacaaagcttggatgtggtgaaggtggctgtggagcctgcactgtgatggtctcatgctatgatcaaactacaaagaagacacagcattttgcaatcaacgcatgcttggctccgctttattctgtggaaggaatgcacataatcacagtagagggaattgggaatcgtcagcgaggtttgcacccaatccaggaacgtttagccatggcccacggttcacaatgtggattttgcacccctggttttgtgatgtcgatgtatgcattgctgagatcaagtgaacagcctcctactgaagagcagattgaagatagccttgcaggaaatttatgtcgctgtactggctacagaccaataatagacgccttccgtgttttctcgaaaagagatgatcttttgtacaacaattcatctctgaaaaatgcagatggccgacctatctgcccttcaacaggaaaaccatgttcctgcggagatcagaaagacatcaatggtagtgaatcttcattattgacacctacgaaaagctactcaccttgttcatacaatgagattgatggaaatgcgtacagtgagaaagaactcattttccccccagaacttcagttgagaaaagttacgtcacttaaattgaatgggtttaatgggattcggtggtatagacctcttaaactaaagcaagtattgcatttgaaagcatgctacccaaatgcaaaactaatcattggtaactctgaagtaggagttgaaacaaagttcaagaatgcccagtataaggtcttgatctcagttactcatgttccagagcttcatacccttaaagtgaaagaggatggtatacatattggttcttctgtaagacttgcacagctccaaaatttcctcagaaaggttattttagagcgtgattcacatgaaatttcatcctgtgaggcaatactgcggcaattaaaatggtttgctgggacacaaatcaggaatgttgcttctgttggaggtaacatttgtactgctagtccaatatcagatctaaatccactttggatggctacaggtgcaacgtttgagataattgatgtgaacaataatattaggaccattcctgcaaaagatttttttctgggttatcgtaaagttgacttaaaacctgatgagatattgctctctgttatactgccatggacaaggccatttgaatttgtcaaagaattcaagcaggcacatagaagggaggatgacattgcgttggtgaatgctggaatgcgtgtctatataagaaaagttgaaggtgattggataatttcggatgtttcaattatctatggaggggtagctgcagtttcacaccgtgcttcaaaaactgaaacctttctcactggaaaaaaatgggactatggattgttggataagacttttgatctgttgaaagaagacgtagttctggctgaaaatgcacctggtggaatggttgaatttcgcagttcacttactttgagtttctttttcaaatttttccttcatgttactcatgaaatgaatataaaaggattttggaaggatggattacatgcaaccaatctttcagccatacagtctttcactagacctgtcggtgttggaactcaatgttatgaattggttagacaaggaactgcagttggccaacctgtggttcacacatcagctatgcttcaggttactggtgaagcggaatatactgatgacacaccgacaccccccaataccttgcatgctgctctggtgctgagtacgaaagctcacgcacgcatattatctattgatgcttcacttgccaaatcttcccctgggtttgcgggtctcttcctttcaaaagacgtgcctggcgctaaccatactgggcctgttatccatgacgaggaggtttttgcatctgatgttgttacatgtgttggccagattgttggacttgttgtggcagatacccgtgataatgcaaaagctgctgcaaataaagtcaatattgagtattctgaacttccagcaattttatccatagaggaagctgtgaaagctggtagctttcatccaaatagcaagagatgcctagtaaaaggtaatgttgaacaatgttttctgtcgggtgcatgcgatagaattatagaaggaaaagtacaagttggaggtcaagagcacttctacatggagcctcagagcactcttgtatggccagttgattctggaaatgaaattcatatgatttcatctacccaggctccccagaagcaccaaaagtatgttgctaatgttcttggtcttccacaatcaagagttgtttgcaagactaagcgtattggtggtggatttggtggaaaagaaaccagatcagcaatatttgctgcagcagcatctgtagctgcttattgtttaaggcagcctgtaaagcttgttttggacagggatattgacatgatgacaactggacagaggcacagtttcctagggaagtacaaggtgggatttaccgatgatgggaagatattggccttagaccttgatgtttataacaatggtggtcattcacatgatttgtcccttccagtcctggagcgtgctatgtttcattcagacaatgtctatgatataccaaatgtcagagtcaatgggcaagtatgtttcacaaatttcccaagcaatactgctttcagaggttttggtggtccacaagctatgctgattgcagagaattggattcagcacatggctacagaactcaagcgaagtcctgaggagataaaagaacttaattttcaaagtgagggatctgtgcttcattatggccagttgcttcaaaattgtacaatacattcagtatgggatgaactaaaggtttcttgtaattttatggaagctcgcaaagctgtaattgattttaacaataataaccgttggagaaagcgtggcattgctatggttcccaccaagtttgggatatccttcactacaaaattcatgaatcaggctggtgctttagtgcaagtttacactgatggaactgtccttgtaacgcatggtggggttgaaatggggcagggtttacacacaaaggtagcccaagttgcggcttcatcattcaatatccctcttagctctatatttatctcagaaacaagcactgataaggtaccaaatgcaacaccaacagcagcctctgctagttcagatttatatggtgctgcagttttggatgcttgtcagcaaattatggctcggatggaacctgttgcttcaagaggaaaccacaagtcctttgctgagttggttctagcatgctacctggaaaggatagatctctctgctcatggattttatatcactcctgatgttgggtttgactgggtgtctggcaagggaactccattctactatttcacatacggagcagcatttgcagaagttgaaattgataccctaactggggatttccacacaaggacagtagatattgttatggatcttggctgttcaattaatccggctattgatattggccagattgaaggaggttttatccaaggattaggttgggcggccctggaagaactaaaatggggggatgataaccacaagtggattcgacctggacatcttttcacttgtgggcctggctcttacaaaataccctctgtaaatgatatacctctaaacttcaaggtctcacttttgaagggcgttttgaatccaaaggtcattcactcatccaaggctgtaggagagccaccgtttttcctcggttcagccgtcttgtttgccataaaggatgcgatatctgccgcaagagctgaggagggtcacttcgactggttcccactcgacagcccagcaacaccggaaagaataagaatggcatgcgtggattccatcacaaagaaatttgctagcgtatattaccgtcccaagcttagtgtatagtggctactgccaaagtacaagggtcattaaaggtttatgcttgtcgtacgtatatttgtacagtcccaagctactgtgtaaacataaatataggcgacagtttaggggataaaaagttaccttttcctcttcttttttaccccccaggaagaaaacactagaaataaaagcaatgttcacatcg

SEQ ID NO: 3571 - DNA, 4672 bp, Zea mays
gaaattttttaacggaaaagctgtatcgcgtcaccgccgccagtacgcccgccaccggcgctcgttcttgtcttcgtccatgcactgtacactacacatcaccgactgtaccgcacccgcacatgcgggaagccgcctcatcctcttcgtcgccgtgatccatccatccacatcactgatcagacccgtgccgtgcagttccaccacacttgggggaggcagagccccaagcgcgcgtccgacctctggacctccgcaggcggaacctattgctccctgcaggttctctcgcgggcctagccgtgcttcttccccacccggaatctgatgggatcgctcacgcgggtgccggcggaggacccagcagcggcggaggaggagtggtccgacgaggcggtcatctacgtcaacggcgtccgccgcgtgctcccggacggcctcgcccacctcaccctgcttcagtaccttagagatattggccttcgagggacaaagcttggatgtggtgaaggtggttgtggagcttgcactgtcatggtctcttgctatgaccgaattacaaagaaatcactgcattttgcaatcaatgcatgcttggctccactttattccgtggaaggaatgcatataatcacagttgagggaattggagatcgtcagcgaggtttgcacccagttcaggaatgtttagccaaggcacatggttcacaatgtggattttgcacccctggttttgtgatgtctatgtatgcactgctgagatctagcaaacagcctcccactgaagaccagattgaagactgccttgcaggaaatttatgtcgttgtactggctaccgaccaattatagatgccttccgtgtgtttgccaaaacagataatttggcatacaccaattcatgttcagaagatgcaaaggaccaagctatctgcccttctactgggaaaccatgttcctgcaggaatgagacagatgtcaatgttaatgagtcctcgttatcatcgtctgtggaaagatattcaccttattcatacaatgaaattgatgggagtgcatacaatgaaagggaactcatcttccccccagaacttcagttgagaaaagttatgccacttaaattaaatgggtctaatgagatcaagtggtataggcctcttaaactaaagcaattactacatttgaaatcttgctacctggatgcaaagcttatcattggtaactcagaagtgggagtcgaaacgaagtttaagaatgcccaatataaggtcttgatcgcagttactcatattccagagcttaataccctcaaagctaaagaagatggcatacacattggttctgctgtaagacttgcacaacttcaaaattttcttaaaaaggttgtagcagaacatgatttgcctgaaacttcgtcatgccaggcaatagtacgtcagttaaaatggtttgcgggtacacaaatcaggaatgttgcatccattggtggtaacatttgtactgctagtccaatatcagacctaaatccactttggatagctgtaggtgcgaaattccatataatagatgtgaacggtaatgttagaactacccttgcaaaggacttctttcttggttatcgtaaagttgatataaaaccagaagaaatattgctttctattatactaccatggacaaggccttttgaatatgtcaaagaatttaaacaggcacatagaagggaggatgacattgctttggttaatgctggaatgcgtgtgtatttacaagaaactgaacgaaattggataatatctgatgtttcaattgtctttggtggggtagcagcagttccacttagtgcttcaagaactgaaaacttccttactggaaagaaatgggactctgggttgctggatgatactttcaatttattgaaagaagacatctctatttcagagaatgcacctggtggaatgattgaatttcgcagatcgcttactttgagtttctttttcaaatttttcctgtctgttacccatgaaatgaaaataaaagggttgttagcagatggattgcatgcagatcatctgtcagctgtacagccttacagtaggcctgttactgttggaactcaaagttatgaattagtaaggcaaggagcttctgtaggtcagccaatggttcatatgtcagctatgcttcaggtcactggtgaggctgaatacactgatgacacaccgacacctcccaatactttgcatgctgctttggtgctgagtaagaaggctcacgctcgcatattgtctattgatgattcacttgccaaatcttcccctggctttgctgggctgttcctttcaaaagacattcccggtgttaaccatactggaccaattatccatgatgaggagttttttgcatctaacattgttacttgtgttggtcagatcattggaattgttgttgctgatactcatgataatgcaaaaactgctgccaacaaagtacatatcgagtattgtgagctcccagcaattttatctatagaggaagctgtcaagattggaagctttcatccaaataccaagaaatgccttgtgaaaggcgatgtagaacaatgttttctgtctggtgcatgcgatagaattgtatcaggacaagttcatgtcggaggtcaagagcatttttacatggaacctcagtgcactcttgtctggccagtggattctggaaatgaaattcatatggtctcatctactcaagctccgcagaagcatcagaagtatgttgcaagtgttcttggtcttccacaatcaaaagtcgtttgcaagactaagcgtattggtggtggatttggtggaaaagaaaccagatcagcaatatttgctgctgcagcatctgtaccctctttctgtctgagaaggccagtaaagcttgttttggacagggacgttgacatgatatcaactggacagaggcacagtttccttgggaaatataaggtgggatttaccaatgaagggaagatactggccctagacctggaaatttataacaacggtggccattcacttgatctatcccttgcagtactggaacgtgctatgtttcattcagaaaatgtctatgacatagaaaacatcagaatcaatgggcaagtatgctttacaaacttcccaagtaatactgctttccgaggttttggtggtccacaaggcttgttgattgcagagaattggattcaccatatagctacagaactccaacgaagtcctgaagagataaaagaacttaattttcacaatgatggagttgtgctacattatggccagttgctccagaattgtacaataagttcagtttgggatgaactaaaagcatcttgtaattttgtggaagctcgcaaagccataaataattttaacagtaataaccgctggaggaagcgaggaattgccatgattccgacaaaatttggcatatccttcactgcaaaattcatgaatcaggctggcgctcttgtgcaagtttacactgatggcactgtcctggtaacacatggcggggtcgagatgggacagggtttgcacacaaaggtagcccaagttgctgcctcgtcattcaatatccctcttagctctgtatttatatcagagacaagtactgataaggttcctaatgcatcaccaacagcagcctctgctagttcagatctgtatggagctgcagttttggatgcttgtcaacaaatcaaggttcgaatggaacccattgctagcaaaggaacccacaactcgtttgcagagttggctcaagcatgctacatggaacgtgtggatctctctgctcatgggttttatgctacacctaatattgggtttgactggacgattggcaagggaactccattcaattatttcacatatggagctgcatttgcagaagttgagatcgacaccctaactggggatttttacacaaggacagctgatattgttatggatctcggattttcaattaatccagcaattgacattggccagattgaaggagcttttatccaaggattgggctgggcagccatagaagagctaaaatggggggatgataaccataagtggattcgacctggacacctcttcacctgcggtcctggttcttacaaaataccctctgtaaatgatatacctctgaatttcaaggtttctctattaaagggtgttccaaatccaaaggctattcattcttccaaagccgtgggagagccaccatttttcctaggttccgccgtcttatttgcgataaaggatgcgatctctgcggcaagggctgaggaggggcacttggactggtttccactcgacaacccggcgacaccggaaagaataagaatggcatgtgtggattccattacaaagaaatttgccggtatagattatcggtccaagcttagtgtatagcggctgctgggctggtcacgggagaataaattggaaacagaagcccgcatttgtaaagtttcatgccctttgtgctaaaaagaatgggagggacggtttagtgttacttgtgggaaactttaaccctaacaaaggattgggtgatgtattaatagattgagttagttgggtctgacatacacatggatgagaagataattacacggtaaactctaaggccctgttcggtttt

SEQ ID NO: 3572 - DNA, 1599 bp, Brachypodium distachyon
ggcgagggagagcatatcccctcgccctcgccctcgctcaatctccaaaggcagcgccatgacagcgactccggcgcctcccagtatatcctcctccttctccccctcccaccgtgccgcatttatatagcccagcgaccgccagccgtttcttgtcccaccccacacctccagcgttgttcgtccagtccaatctcatctccccctcttcttcttctctctacgcatttccagccgccgccgccgaggtccatggggagatggaggcgcgtcagtgtggtggctctggtgctcctgctcttctccgcctgccatggaagagagctctttgtcaagaatcatgagcagagttttatttatgaccatactcttgctaagacccttgtggaatatgcttctgctgtgtatatgacagatttaacagctctgtatacatggacatgctcaagatgtaatgacttgactcaagactttgagatgaggtctctaattgttgatgtggagaactgcttacaggcatttgttggtgtagctcataatctaaatgccataatagttgcaatcagggggactcaagagaacagtgtacagaattggatcaaggacttggtatggaagcagcttgatctaagctatccaaacatgccaaatgcaaaggtgcacagtggatttttctcctcctataataatacaattttgcgtctagctatcacaagtgctgttcacaaggcaagagaaacatatggggatatcaacatcatagttacggggcactcgatgggaggagccatggctaccttttgtgcgcttgatcttgctatcaatcttggaagagacgatgtgcaactcatgacttttggacagccccgtgttggcaatgctgcttttgcctcctgctttgccaaatatgtacccaacacaattcgactggtacatggacatgacatcgtgccacatttgccaccttatatctcttttcttccccacctgacgtaccaccacttccctagagaggtatgggtccatgattctgaaggcaacacgaccgaacagatatgtgatgccagtggtgaagacccaaactgctgcaggtgcctatccatattgagtttgagcattcaggaccatttcacatatctgggagttgacatggaagcagacgactggagcacctgcagaatcatcacggcgcaaagcgtcgagcgattccaaaaggatcttgctagcaacattatcatgaaaaatcacgacgttgatgtttccatcgtcggaggtagtgaagacagacggaacagttttagatagcctacagcaatccttttatcaccaacttagtgcaaaagatggtgcacagtgttcttttcatagcctgtgaatatgtagacatgtacataatgataagctcttgcatcttagattctgtctgatgcatgaaagaaatgttccgacgtatgcatctggtggaatacagtcaagcaagaatgcacccatgcatgatatctatgcaggtgtctgtaatttggatctatacttgaccaaagaaagagacaaattctgctaacattgacataagatgcacatgtcacagattttaagttg

SEQ ID NO: 3573 - DNA, 1634 bp, Sorghum bicolor
ctgcccagcggcctggcctaccgccttcaagttcttggcacaaccaacccgaccggaggagagggagaggaggagccgggcatattctcccctccggtgctccctccagcggtccagccgcagcgccctgaaagagagggaggcgctcccactcttcttcctcgccgagcactcgctgttcaggttcatggagagatgcagcctgggtgccagcgtggtggctctcctactcttgctgtctggtgcttctcatggaagagagctgcctgtcgaggatagtgaccacagttttatctacaatcatactctcgcaaagactcttgtggaatatgcatcagcggtgtatatgacagatttaacttctctgtttacgtggacatgttcaagatgcaatgacttgactcaaggtttcgagatgaggtctctaattgttgatgtggagaactgcttgcaggcatttgttggtgtagctcataatctgaattcgataatcgttgcaatcaggggaactcaagagaacagtgtacagaattggttaaaagacttgatatggaagcagcttgatctaagttatccaggcatgccaaatgcaaaggtgcacagtggatttttctcctcatataacaatacaattttgcgtctagctatcacaagtgctgtgaacaaggcaagaaaatcatatggagacatcaatgtcatagtgacaggccactcgatgggaggagctatggcttctttttgcgcgctcgatcttgctatgaagcttggaagtgacagtgttcaactcatgactttcgggcagcctcgtgttggcaatgctgcattcgcctcatgctttgccaaatatgtacccaacacaattcgagtgacacacggacatgatatcgtgccacatttgccaccttatttctcctttcttccccatctgacataccaccacttccccagagaggtatgggtccaggattctgatggcaacataactgaaaagatttgtgacgacagcggtgaagacccagattgttgcaggtgcctctccatgttcagcttgaggattcaggatcatttcacttacctaggagtcgatatggaagcggacgattggagcacttgtagaatcattacagctcaaagcgttcggcaattccgacgggagctagccagcaacatcatcatgacaaagcatgatatcgacgtttccattgttgaacctagtgtacaaacagatcggagcagttctagttagctggagcattccttttgtccaaaaagattcagagaagaagcagcctcttcttaatgtaatagatttgttcagcgaagaaggcgagccttgttttctctattatagtccagccagattgggatgcttttttagataaaggaaataaatccggtttcatctcttgtaacaaagagaatcagagaccatgatgtaaacatgtagactgtaggtatgtacataagaaaggaaggaagatcatagacacagtgtatgttggatgatgatagggattgcttctgtaaatatatatacacggtgtatgtaaacttgcaataacacagaatgtggctgtacaggtagatatacagatggacctgatcaaggtcaacgcgcttttgcgatgtgcatg

SEQ ID NO: 3574 - DNA, 1369 bp, Panicum virgatum
agcgaacgcccgccgcaggcgagggagccgtccactcttcttcctcgccgagcaccagccgttcatggggagatggacgtgcaccggcgtagtggctctcataatcttgctgtctgctgcttcgcatggaagagaattgcctgtcaagaaaagtggccagagttttgtctacaatcacactcttgcaaaaactcttgtggaatatgcttcagcggtgtatatgacagatttaactgctctgtatacatggacatgctcaagatgcaatgacctgacccaaggctttgagatgagatctctaattgttgacgtggagaactgcttgcaggcatttgttggtgtagctcatgatctaaattcgattgttgttgcaattagaggaactcaagagaacagtgtacagaattggttcaaggacttgatatggaagcagcttgatctaagatatccaaacatgccaaatgcaaaggtgcacagtggatttttctcctcctataataatacaattttgcgtctagctatcacaagtgctgttcgcaaggccagaaaatcatacgggaatatcaatgtcatagtgacaggccactcaatgggaggagccatggcttctttttgtgcactcgaccttgctatgaaacttggaagtgacagtgtgcaactcatgacgttcgggcagcctcgtgttggcaatgctgcgtttgcctcatacttttccaaatatgtgcccaacacaattcgagtgacacacggacatgatatcgtgccacatttgccgccttatttctcctttctttcccagctgacataccaccacttcccaagagaggtatgggtccatgattccaaaggcaacacaactgaacagatttgtgataatagtggtgaagacccgaagtgctgcaggtgcgtctctatgttcagcttgagcattcaggaccatttcacctacctgggagttgatatggaagcagatgactggagcacctgtagaatcattggagctcaaagcgttcagaaattccggaaggagctcacaagcagcattatcatgacaatgcacaatgtcgacgtctccattgttgaacctagcgtacagacagatttgagcagttttagatagccacagcattccatatatacaaattcagagcgaaaagcaaagccttgtttttctcttgaggatttcattctgcttgggataatactcttgatgtcttgtaaatgtgtaggactgtagatatgtacataagcaagatagattccttctgcttggatgatgatgatgtcctctagatattagatgcatgctgtaatgtaaacatgcaataaaattagaataatcctattgatacacggtatcgatgtttac

SEQ ID NO: 3575 - DNA, 1341 bp, Pennisetum glaucum
gcttcgttctccttggtcaatggggagatggaggtgcgccggcgtggtggctctcgtactcttgctctctgctgcttctcatggaagagagctacctgtcaaaaaaagtgaccatagttttgtctacaatcacactcttgcaaagactatcgtggaatatgcttcagcggtgtatatgtcagatttaactgctctgtatacatggacatgctcaagatgcaatgatttgactcaaggctttgagatgagatctctaattgttgacgtggagaactgcttgcaggcatttgttggtgtagctcataatctaaattcaattgtcgttgcaatcagaggaactcaagagaacagtgtacagaattggatcgaggacttagtatggaagcagcttgatctaagctatccaaacatgccgaatgcaaaggtgcacagaggatttttctcctcctataataatacaattttgcgtctagctatcacaagtgctgttcgtaaggcaagaaaatcatatggggatatcaatgtcatagtgacaggccactcaatgggaggagccatggcttctttttgtgcactcgatcttgctatgaaactgggaagtgacagggtgcaactcatgacgtttgggcagcctcgtgttggcaatgctgcattcgcctcatgcttcgccaaatacgtacccaacaccattcgagtgacacacggacatgatattgtgccacatttgccaccttatttctccttcattccccagtggacatatcaccacttcccaagagaggtgtgggtccaggattctaacggcaacacaactgtgaagatttgtgacgacagcggtgaagacccacactgctgcaggtccatctccatgttcagtttgagcattcaggaccattttacctacctgggagtcgatatgcaagcagatgattggagcacctgtagaatcattgcagctgaaagtgttaagcaattccgaaaggatctcaccagcaacattatcatggcaaagcacaatgccgacatctccattgttgaacctagcgtacagacagatcggagcagttctagatagccacagcatttcttagaatatgcaaattcagagcgaaaaccaagccttgttttctctggaagatgaaggccaaattagttcagttggaggatttcatttcagattgggatgcaaatgctcttgatgtcttgtaaatgtgtaggcccgtagatatgtacataagcaaggtagactcatagcgttataggtcatggcttctgttggatgatgatgatagaacactctgtaaatgcacgctgtatacttgcaataaagttaaagatcaa

SEQ ID NO: 3576 - DNA, 2319 bp, Zea mays
atgtggaaatggtattctagctctagaactaggagagggaaatctcagctccatgcttcatggcaggtgaggattgtgaagcctgtgcgcgcccatgttctccacgaaaagacgaactcgttctccttcacgatttcgacagcattgacacgaaaacagttgttaatccctagcctaggtatccatagatccaacccagatgctgatgcgggggtgcaacagtgcaagaacaactctggattcctccggatgatgccatgccaccaatcctcactaaccaattattattatccaacaaatccacgagaaaaggacgtcctttttttctctctgaagagtgggagtgtacccggcggcctggcctaccgccttcatttcttggcacaaccaaccgggggctcggaagaggagaagagccgaccagccgggcatattctctcttcctccctccggtgctctctccagcggtccagccgcagcgccctgaaagagggaggcttccactcttctttctccccgagcacccgccgtacgtctcctgcaccttcttccagtttctcccatttcagtttgtccactccctgtcattcctgccgcctcgacctccccgctctggaaggtcaaatccttcgcccctaagcttttatttctgtttgtatttggttctggaatcgttgcctgctggctgctgctgctgcacattacccccgtattctgtgctccggccgtgggattgccctgctcgctttctttcaaaaaagaaaaggaaaaggagcaattgctctgctcgctttcagtttgtgtggttgacgtctctctctgagtctctgtgcttcagcaggttcagatttagcctgggtgcgtctgcaggttccggttcatggagagatggagcctgggtgccaaagtggtagctctcgcactcctgctgtctgctgcttctcatggaagagagttgcctgtcaagagtagtgaccgcagttttatctacaatcatactcttgcaaagacgcttgtggaatatgcatcagcggtgtatatgacagatttaaccgctctgtttacgtggacatgctcaagatgcaatgacttgactcaaggattcgagatgagatctctaattgttgatgtggagaactgcttgcaggcatttgttggtgtagatcatagtctgaattcgataattgttgcaatcaggggaactcaagagaacagtgtacagaattggataaaagacttgatatggaagcagcttgatctaagttatccaaacatgccaaatgcaaaggtgcacagtggatttttctcctcgtataacaatacaattttgcgtctagctatcacaagtgctgtgcacaaggcaagaaagtcatatggagatatcaatgtcatagtgacaggccactcgatgggaggagctatggcttctttttgcgcgctcgatcttgctatgaagcttggaggtggcagtgtgcaactcatgacttttgggcagcctcgtgttggcaatgctgcattcgcctcatacttcgccaaatatgtacccaacacaattcgagtgacacacgggcatgatattgtgccacatttgccaccttatttctcctttcttccccagctgacataccaccatttcccaagagaggtatgggtccaggattctgatggcaacacaactgaacggatttgtgacgacagcggtgaagacccagattgttgcaggtgcatctccatgttcggcttgaggattcaggaccatttcacttacctaggagttgatatggaagcggacgactggagcacctgtagaatcatcacagctcaaagggttcagcagttccgactggagctagcgggcaacatcatgatgaccaagcacgatatcgacgtctccatcgttgaacctagtgtacaaaacagattggagcagttctagataggcggaacattcgttttgtccagattcagagaagcaacagcctcttgttaatgcagtggaaattgttcagagacgaaggcgacccttgttttctctattagttcggtcagaatgggatgttctttcagatcaaggaaataaatcgggagtcatctcttgtaacaaagagaatcagagcatgatgtacataaggaaaaatcataggcacggtttatgctggatatggtagggattgcttctgtgtaaatatatgtatacaatgtaaacttgcaatggctatatttgcagcaacataagcaccaagctaactgaaaaatatcagttaaccgaatgaatgaggcgtatctatatatacatgatgtgagcttgcaatagcgtat

SEQ ID NO: 3577 - DNA, 1766 bp, Oryza sativa
tgcaggtctctctcatcatctcatgatcgattaggtcttcgtaattcgtcgcaaatgtgttggttcgcctcctcttctgcactcgatcggtgccgttcacgattaggaaacacgagctccatccaatctgagatatccgggctccatttctttctccgatctacgcgtcctcacgttcgcgtcgaagcctcgctggagccgccagcgacggccacctgccctgacagcggcggcgatccatccagtgattcatcgatcctccctcatttcttcagatccagaatgtcctggatacaatttcttcagattattcagtgacaagagtagtacagttcatggagaggtggagatgcgtcagtgtgttggctctggtgctcttgctgtcaaatgcttcccatgggagagatatctctgtccagcactctcagcaaactttgaactatagccatactcttgccatgactcttgtggaatatgcttctgctgtgtacatgacagatttaacagctctttatacatggacgtgctcaaggtgtaatgacttgactcaaggctttgagatgaaatctctaatcgtggatgtggagaactgcctacaggcattcgttggtgtggattataatttaaattcaataattgttgcaataagaggaactcaagaaaacagtatgcagaattggatcaaggacttgatatggaaacaacttgatctgagctatcctaacatgcctaacgcaaaggtgcacagtggatttttctcctcctataataacacgattttacgtctagctatcacaagtgctgtccacaaggcaagacagtcatatggagatatcaatgtcatagttacagggcactcaatgggaggagccatggcatccttctgtgcgcttgatctcgctatcaatcttggaagcaatagtgttcaactcatgactttcggacagcctcgtgttggcaatgctgcttttgcctcttattttgccaaatatgtgcccaacacgattcgagtcacacatggacatgatattgtgccacatttgcccccttatttctcctttcttccccatctaacttaccaccacttcccaagagaggtatgggtcaatgattctgagggcgacataaccgaacagatatgtgatgatagtggtgaagatccaaattgctgcaggtgcatctccacatggagtttgagcgttcaagaccatttcacatacctgggagttgatatggaagctgacgactggagcacttgtagaatcatcacagctgaaaatgttaggcaactccaaaaggatctcgccagcaacatcatcgtctccaagcactctgtcgatgtcactattgtagaacctagttcacaaacatattgaaagcaattatggatagtctacggtatttcttttatccgatttagagcaaaggatggatccttcctcttttctcgaagatgaaggcttgattagaaattcattcagatttggatgtacatacagggttcttttcatagcttgtgaatatgtagagatgtacataggatgatagattcatatttcataggtgttagttttttattttttccttttctgatgcatatgcttatgcattttgtaaatgcaataaaaacaagaatagttccacccatgtatgaatatccatacaattatctgtatctgccactgtgtaagtaaaagatatatgattatctgtgactttaggcatgaaacggaaatatgagttcattgctggattgtgactcttct

SEQ ID NO: 3578 - DNA, 2006 bp, Avena sativa
ggtacacctcggacacgctcgaggagccggagcgcaagcagcacaagaagaagcaggcgatggtggacgaggcgccgccggtccctaaccagaaacagacgcgctgctccactccactctgagccgccgcggccatggagctcgccaccgcggccgtcgtctccactgcctccacccaccctggccgcacaaacagcttctcatccccacgcgcagcctcgtggtccgtttcctcgttaccctcctcctctctctctctgtccacctctgcctccgcctcgcggttccagagacgacggggagctgtcgtctcggccgccgtagagctccgtgaggcctccgcggggggcggagactccgtccgcgtcaccgagaccccgcagcccaactccagtgttaagttcagcgtggaggtgcctccgtcgatatgccaggaatgctaccagaccactcttatggagtactcaaagcgtttcaaggtccctggatttcggcctggaaagatagttccagaaaatgtacttttaaactacgttggaccgcaacatgtacgggctgctacagttgaagctatcttgagacatacgcttcctcaggcattgtcctcggtggaagataaggcattagaagattctgtacagattctcactaaatttgatgatatgaatgagtctttctccctcgaccatgtgtttagatatgatgttgcagtggatgttgttcctgaactccaatggttatctgaagacaaatataagaacctcaaagtggttattgaaatagatgaaattgttgatgctgaaaaggcagctgagttagagcttaagcgtcgtcgtaaatctctagggggtcttcgagtagtatctgacagaggtctacaggtcggtgatgtaacagtaatagatatattggctgaaactatcacaaccgatggctctaaaggtgaaaaaattccatcagctgaggctacagggttccagttggacactgaagaaaatgataaccttgttcctggatttctgggttcgctaattgggattcgtcctggtgagactagatcatttcctattcagttccctgagtcctttgatcaagaaagtctgcaaggtgtccgcgcgcagtttactgttgtttgtaaagaactcttcttcagagagttgccagagttggacgattcgcttgccgcaaagctccttccaggatgcaccaccatggatcaggttcgagaacgaattttggaaagatgcaaagaagtggagaagacagctatagaacaagcgacagataatgcaatcctcgaccaactgggaaagttggttgaggttgatgttccgcgtgccatgtttcaagaacaaggccaacagttgtatggagccaaacttctgcaacttcaggcagaaaggcagctaaataaagatcagttagcatccctttcaagcgaaaggtcggtccaggagtacctaaagagtgagagggagaacattaccagaatcattaaacaaatgctagctgtcggtgaaatattcaaggccgaaaacttacagtactcaaccgaccagctcgtcaaggaagttgagaactctatcgaagagttcaaacgctataatcaggactacgacgaggggaacatcaagcagcaggttcaagatgttctcgaggctgcgaaggtgctcgagtggctcaaggagaactgcacaatcgaatacatcagacaatgagggcggtgctagatgctctgtcggttttcaaagatggcaggcaggcacgccaacttcgagatgagctacctttggtgttgcagactggtgcaaacaaatatttgatttgttcatagcacgagagaagtgtcatacatatatagatggcaagtttgctttatactatacatcttttacacggcggtaatcgactccgctacagacaattgtcacagttgtgttgtttataatatgatgtaataaatgaacggttaaatgtgcttaaacataatatgtctccattgagaa

SEQ ID NO: 3579 - DNA, 1239 bp, Leymus cinereus x Leymus triticoides
  misc_feature (80)..(80): n is a, c, g, or t
  misc_feature (895)..(895): n is a, c, g, or t
ccgtcgctgtcggcacactgtgcactgcatctgctctacaaaggaaccgaggaagattcagagaatcaccagcccacccnatccaatccatcttctcttctccttgctgcagtagcgagtgtgcctctgtgtagatgagcatggcggcgacggcagccacggcctggccatccacctcctccttcgtcctcacccctcgcacccgccaccacgccgctcccagcacccctacccgcgccctccgctccggcttcctcggccgcgccctcacgctctgcccgcacccggtggacgcccgcgcagccatctccgtctccgccgccgtgtccgtgcgcgccgcctgggacgggcccctctcctcggcgcgcctcatcatgcagggccgcaacgtcaagctgacggagaagctcaaggagcacatcgaggacaaggtgggtcgtgcggtgtccaaccacgcgcacctggtgcgggaggtggacgtgcgcctctccgcccgcggcggcgacctcagcaagggccccaagctctcccgctgcgaggtcacgctcttcacgcgccgccacggcgtcgtccgcgccgaggaggaggaggagtcctcctacgcctccatcgacgccgccgccgccgtcgtcaagcgcaagctccgcaagatcaaggagaaggagacggacgtgcgccacctcaagggcaccaaggagtggcagtcctctgggctgtgtccgacgtggaggacgagtcggaggttgaggagctggaggaggaggaggacgacgatctcgtcgaggtcatcggcgccgaggacgaggagacagtgctcaccaaggttgtgcgcaccaaggtgttcgagatggcgccgctgacggtggacgaggcgctggagcagctcgagaacgtngaccatgacttctacgccttcaggaacgagcagacaggggaggtgaacatcctgtacaagaggaaggagggagggttcggcctcatcgtccctaagcaggacggccacgtcgacaaggccaccgtcaacgccaagggcaaggaggagcaccccgtcgccggctgacctctccatgacaccaagtcactagctgtagctgcattagttggtctgttttctggatggtggtgggtgtctgtcaagtgtcaacaactgctggtgtttcatcagaccagacagccccttgtgcaaattaacaaacgctttctgagctgtgttaacttatgatgatcccacacaccagt

SEQ ID NO: 3580 - DNA, 1251 bp, Avena sativa
ctgaatcaagctcgagttttttttttcagatgagcatcgcggcaacggcagctgcggcggcggcgtggccgtcgacctcctcctccgtcctcgccccacactcccaccatgccactcccaggacctgctgccacctccgctccggcttcctcggccgcgccctcgccgtggccccgcacccggcgaccgccgccgtctccgcctccgccgccgtgtccgtgcgcgcggcctgggacgggcccctctcctcggcgcgcctcatcatgcagggccggaacgtcaagctgacggagaagctgaaggagcacatcgaggacaaggtggggcgcgcggtgtccaagcacagccacctggtccgggaggtggacgtgcgcctctctgcccgcggcggggacctgggcaggggccccaaggcgtcccgctgcgagatcacactcttcaccaggcgccacggcgtggtccgcgccgaggaggaggaggagtccagctacgccagcatcgacgtcgccgcagggatcatcaagcgcaagctcaggaagatcaaggagaaggagacggacgtcaggcacctgatgaaagggaccaaggagtggatcgatgccggggatgccttggcgtcggagtcggacgtggaggtggacgaggaggaggaggaggacgatgagctcgtggaggtcatcggcgccgaggacgaggagacggtgctcaccaaggttgtgcgcaccaaggtgtttgagatggcgccgctgacggtggacgaggcgctggagcagctggagaacgtcgaccacgacttctacgcattcaggaacgagcagacaggtgaggtgaacatcctgtacaagaggaaagagggagggttcgggctcatcatccccaagcaggacggccacgtcgacaaggagaccgtcgccaagcaggccaacggcaaggagcaatccctcgccggctagactgctcctcttcttctcaggggtcactactaagtcattgctagcagtagctttgttctagttcgtctgttttttcttcttttccgatggaatggatggatgtctgtccgtcgactgatgaatgttggtttcatcgtgtccccagacgagaccgagccccgtgcccgtgtgcgaatttaacacttttctgttatgagcccgccgcaccacttgctaatgtactactccctccgtcctcttgtacaggatgttcacctcacctgtctgctcgttcctgaatgcgtagaagtcgtggtcg

SEQ ID NO: 3581 - DNA, 701 bp, Hordeum vulgare
ctaggtagcaaagcaaatggcctcaggagtgtttggtacccccatttcggagaagacggtgatagccactggtgagtataaggaacccattactcaaaaggatgttgcagactataccatgaagatgatcaacgccggtggtaaggatgttaacgcgcaaaagttcgtcgacaacctcaaggagaggtacggtaacggaatagctgtaaaatgcctcatctacaatgccactggtgccactttgagcttggctaagtacaacgattggcacggccatatctatgatacaccctacccatcagatattcagaatgggcaatggggtgcattcctccacgtccacccaagtggtgctgcggttggttcagctggtgccgttgtgtatcgtagcaagatcccctccagcaccaggtcctgcgattggttgttttcctggaccgtcccctacattggtgccaacggggtgtacaccgaaatccgagaggaagggcactacccaagtgtgggaagctggagttatatctacgatgtgaaacttgcaaattcaaatctcaactctaccgataaaaactatggatatgtttccaagactaatatcggtgaaggctctaccatgaacgcccgtggagttttccagtttccctactagatctcgttatcaacatcgcgtggttattgtggtcttcaaaggcttgtgtggc

SEQ ID NO: 3582 - DNA, 851 bp, Hordeum vulgare
tagtacacctatatatcacagtgtgtgtgcaaagcaatggcctctggagtgtttggtacccccatttcagcgcagacggtgatagccactggagagtataaggaacccattacccaaaaagatgttgcagactatgccatgaagatgatcaacgccggtggtaaggatgttaacgcgcaaaagttcgtcgacaacctcaaggagaggtacggtaacggaatagctgtaaaatgcctcctctacaatgccactggtgccactttgaactttgctaagtacaacgattggcacggccatatctatgatacaccctacccatcagatattcagaatgggcaatggggtgcattcctccacgtccacccaagtggagctgccgctggttcagctggtgccgttgtgtatcgtagcaagatcccctccagcagcagctcctgcgattggttgttctcttggaccgtcccctacattggtggcaacggggtgtacactgaaatccgcgaggaagggcactacccaagtgtgggaagctgggattatatctacaatgtgaagctgaaaaattcaagtgtcacctctattgatagcaactatggatacgtttccaaggctgacatcggtgaaggcactaccatgaacgcacgtggagttttcgagtttccctactagatctcgttgcaagcagcgagttgttattgtggtcttcaagtcttgtgtggcgtccatgtacgcttgtgtagtttttttctttactgtctttatggtgcatttttatagatctgatgatccacgaataagcgaaggaagatggggaccaaagagatgtaccgtgtaattgtattttattttac

SEQ ID NO: 3583 - DNA, 905 bp, Hordeum vulgare
tatcacagtgtgtgcaaagcaatggcctctggagtgtttggtacccccatttcagcgcagacggtgatagccactggagagtataaggaacccattacccaaaaagatgttgcagactatgccatgaagatgatcaacgccggtggtaaggatgttaacgcgcaaaagttcgtcgacaacctcaaggagaggtacggtaacggaatagctgtaaaatgcctcctctacaatgccactggtgccactttgaactttgctaagtacaacgattggcacggccatatctatgatacaccctacccatcagatattcagaatgggcaatggggtgcattcctccacgtccacccaagtggagctgccgctggttcagctggtgccgttgtgtatcgtagcaagatcccctccagcagcagctcctgcgattggttgttctcttggaccgtcccctacattggtggcaacggggtgtacactgaaatccgcgaggaagggcactacccaagtgtgggaagctgggattatatctacaatgtgaagctgaaaaattcaagtgtcacctctattgatagcaactatggatacgtttccaaggctgacatcggtgaaggcactaccatgaacgcacgtggagttttcgagtttccctactagatctcgttgcaagcagcgagttgttattgtggtcttcaagtcttgtgtggcgtccatgtacgcttgtgtagtttttttctttactgtctttatggtgcatttttatagatctgatgatccacgaataagcgaaggaagatggggaccaaagagatgtaccgtgtaattgtattttattttatatgtcgttgtgtatcaagttgtccttcttttgtatcggttacctttttacttaataattaaagatataa

SEQ ID NO: 3584 - DNA, 915 bp, Leymus cinereus x Leymus triticoides
  misc_feature (5)..(7): n is a, c, g, or t
atctnnntagctggagtagtcgtatatacaaagcaaagcaaccaaatggcctctggagtgtttggtaccccaatttcagagcagacggtgatagccactggagagtataaggaacccattacccaaaaggatgttgcagactatgccatgaagatgatcaacgccggtggtaaggatcttaacgcacaagagttcgtcgacaacctcaaggaaaggtacggtaatggaatatctgtaaaatgcctcatctacaatgccaccggtaccactttgagcttggctacctacaacaattggcacggccatatatatgatacaccctacccatcagatatccagaatgggcaatggggggcatttctccacgtcaaaggaggaggtgcggttggttcagctggtgccgttgtgtatcgtagcaaggtcccctccagcaccagctcctgcgattggttgttctcctggaccatcccctacattggtgataacggggtgcacaccgaaattcgtgaggaagggcacttccctaagcactgggattatatctacaatgtgaagctggcaaattcaaatctcagctctactgataaaggctatggatatgtttccaagcttgacatcgctgaaggcactaccattaatgcgcgtgcggttttccagcttccctactagatctcgtttctagcagggagtgattattgcggtcttcaaagccttgtgtggcgacgtcgtttgcaggtgttcttctctttactgtctttgtggtgcatttttcaagatttggtggttagcgaataatcgaaggaagaagacgaccaaagagatgtatggtgtcaaaaaaaattataggtcgttttgtatcaagttgtccttttgtaccggctattgttttccttaataaatatcagatataagata

SEQ ID NO: 3585 - DNA, 2800 bp, Triticum aestivum
gggcgcaggcgctggacgaggcggcgctgctgcgctacgcggccgcgcacgtcccgggcttccccgggcccgcgccgtcgctcgccctcacgcagttcggccacggccagtccaaccccacctactgcatccaggcctccgcgcccggcggggaggcccggcgctacgtgctgcggaagaagcccgccggcgccatcctccagtccgcccacgccgtcgagcgcgagttccaggttctcaaagctttgggtgcctacacggatgttcctgtccctaaggtgttttgcctttgcactgatgccagtgtgatcggaaccccattctacataatggagtatctggaaggagcattatatcttaataacaagttaacgggaataaccccagataaacggaggaatatatacttggctgctgcgaaaactttggctgctatacacaaaattgatgcgaccgcagttggactgcagaagtatggaaaaagagacaattattgcaaaagacaagtagacagatgggggaaacaatatcttcattcaactggtgaagggaagcccgcgcgttatcagaagatgcttgatctgattgattggctgaaagaaaatataccagaagaagattcatcaacaggattgggaactggccttgttcatggtgattatcgtgttgataaccttgtttttcacccaactgaggatcgagtgataggtgtacttgattgggaattatctactttggggaatcagatgtgtgatgttgcttacagctgtatgccatatattattgatgcaacactcagtgaaaatagttcgtatggaggatttgaacattctggcattccagatggcattcctcaactggaagagtacctagctgtgtactgctctatgtctgcacgaccttggcctgcagcaaattggaagttctacattgccttttcactgtttcgaggggcatctatctatgcaggagtataccacagatggactatgggtaatgcttcaggtggtgagcgtgctagatttgccggtaaggctgccaatgttatggttgactgtgcctggcattacattaatagagaaaatgtcctgcgagcacaccctgctacaggtatgcatgtcttgaaggctccccggcaaggttttcatgtagagcaggaagattcaactttgacaaatggtcaaggaaaatttgttcctagcgaaaaggttatgcagctacggcaaaaaataatgaagttcatgaaagatcatatatatcccaaggaggatgagttatacaaacatgcacaatcaacctcacggtggacaatccatcctgaagaagaaaatttgaaagcattagcaaaagaggagggattgtggaacttatttattccgcttgacagtgcagctagagcaagaaagctactacttgaggaccaatctcatgtttctgctggaagttcaaatgatcttttgctaggtgctggtctcacaaatcttgagtatggatatttatgtgagattatgggccggtcagtttgggctccacaaatatttaactgtggtgcacccgatacgggtaatatggaggtcctgttgagatatgggactaaggagcaacagaagcagtggcttgttcctctactggaagggaaaattcgttcgggatttgcaatgacagaaccacaagttgcatcttcagatgcaacaaacatagaatgtgcagtatccaggcagggagatttctatgtgataaatggcaggaaatggtggaccagtggggctatggacccgaggtgtaaaatcctgatattaatgggaaaaacagatttctctgcacctagacataaacagcagtcgatgatcttagtggatatcaacacacccggagtgcagataaagagaccattgttagtctttgggttcgatgatgcaccgcatggacatgcagagattacttttgataacgtgcgtgttcctgtcacaaatatcctcctcggagaaggacgtggtttcgagattgctcaaggaagactaggtcctggaagattacatcattgcatgcgactaataggagcagcggaacgtggcatgaatatgatggttgagagggccttaagtaggaccgcttttggaaagaagattgcacagcatggttcctttcagtcagacctggcaaagtgtcggatagaactggagcaaactaggcttctggtgcttgaagcagccgatcaactcgaccggcatgggaacaagaaagcccgtgggatcctcgcaatggccaaggtggcggctccaaatatggccctgaaagtgcttgacatggcaatacaagtccacggcgctgctggggtctcatccgacacggtcctatcccatctatgggcaaccgctaggacactgcggctcgccgacggccctgatgaagtccatctcggcacgatcgcaaagctggagctgcaaagggcgaggatgtaagatcaggaccatatatattgaataaaaagggggacggcaaacttctggagaaggtcagttaaggacatcatcagagtcacgggtagatagaatggtgaaataagtggcgttagattcctcctccatgtacactccctgtttgccttgtcgattcccttgtcatttgtccactagaaccatgacacatctttaattttcgtcctctgttgtaaagagtccaaccctaccagcacagttacatgagtaccagtgactattacagatctgaacaatagttatacactaccaatgggcattgcagatctgaacattggctggcaaaaaaaaaaaaaaaacga

SEQ ID NO: 3586 - DNA, 2967 bp, Brachypodium distachyon
gatggcggcgggggcgaggcggacgcgggagctgctgcggccggtggacgcggcgcaggcgctggacgaggcggcgctgctgcggtacgcggcggcgcacgtcccgggcttcccttcgcccgcgccttcgctggcgctctcgcagttcggccacggccagtccaaccccacctactgcctcgaggtctccgtgccaggaggaggaggggagacgaggaggtacgtgctgcggaagaagccccccggcgccatcctccagtccgcccacgccgtcgagcgcgagttccaggttctcaaagctttgggtgcttactcagatgttcccgcccctaaggtgttctgtctttgcaccgatgcaagcgtgatcggaacccctttctatataatggagtatctagaaggaatattgtaccttgataccaagttgccggaaacaacaccttctaaaaggaaggctatctattttgctgctgccaaaactttggctgctatacacaaagttgatgtggctgcagttggattgcaaaagtatgggagaagagacaattattgtaaaagacaggtagacagatgggagaggcaatatcttcattcgactggtgaagggaagcctgcacgttaccctaagatgcttgatctggttcgttggttgaaagaaaatgtaccagaagaagattcatcaacaggattaggaactggccttgttcacggtgattatcgtgttgataaccttgtttttcacccaacagaggaccgagtaattggtgtactagattgggaactatctactttggggaatcagatgtgtgatgttgcttacagctgtatgcaatatattattgattcaacacccaccgaaaatagttcttatggaggatttgagcgctctggcattccagatggcatccctcaactggaagagtaccttgctgtatactgctccatgtctgcaagaccctggcctgtggcaaattggaaattctacattgcattttcattgtttcgaggggcatctatctatgcaggagtataccacagatggacgatgggtaatgcttcaggtggtgaacgtgctagatttgctggcaaggcgggcaatgctatggttgactgtgcctggaattacataaatagagaaaatgtcttgcgagaacagcctgccacaggcatgcttgtctcgaaagctccacggcaagaattccacagagagcaggaaggttcaacttcaactaatggccaaggcagatttgttcctagcgaaaaggttatgcagctcagggaaaaaataatgaagtttatgaaagatcatatataccccaaggaggatgaattatacaaacatgcacaatcaacctcgcggtggacaatccatccagaagaagaaaatttgaaagcactagcaaaagaggagggactgtggaacttgtttattccgcttgacagtgcagctagagcaagagaactactacttgaggaccgatctcatatttctcctggaagttccgatgatcttttgctaggtgcgggactcacaaatcttgagtacggatatttatgcgagattatgggccgatcagtttgggctccacaaatatttaattgtggtgcacccgatacgggtaatatggaggttttgttgagatatggaactaaggaacagcagaagcagtggctcgttcctttacttgaagggaaaattcgttctggatttgcaatgacagaaccacaagttgcatcttccgacgcaacaaatatagaatgtgcaatttccagacaaggagatttctatgtgataaatggcaagaagtggtggaccagtggggctatggacccaagatgcaaaatcctgatattaatgggaaagacagatttctcagcacctaaacataagcagcagtcaatgattttagtggatatcaacactcctggagtgcagataaggagaccattattagtctttggtttcgatgatgcgcctcatgggcatgcagaaattacttttgacaatgtgcgtgttccagtcaacaatatcctccttggtgaaggacggggttttgagattgctcaaggaagactaggtcccggaagattacatcattgtatgagactaataggagcagcagaacgtggcatgaatatgatggttgagagggccttaagtaggaccgcatttggaaagaggattgcacagcatggttcgtttcaatcagaccttgcaaagtgtcggatagaactggaacaggccaggcttttggtgcttgaagcagctgatcaactcgatcggcatgggaacaagaaagcccgcgggatcctcgcaatggccaaggtggcagctccaaatatggccttgaaagtgcttgacatggcaatgcaagtccatggcgctgctggggtctcgtccgacacggtcctatcacatctatgggcaacagctaggacactgcggatcgcagacggtcccgatgaagtccatctgggcacaatcgcgaagctggagctgcaaagggcaaggctgtaagagtaagaatgatgtcgttgaataacagggggacaacaaaacctcaggaaaataataatgacagcatcacagcacacaggtagtaggtaataagtggcgttaaattcgtccatgtacgactccagttagccctgtcgattgcactgttatttgtccaaagagaccaaccctggcagtacagttacaggagtacaaataactcaacgagtattgcagatctgaacgctagttacaggggtaccaatcactcaatcagtatcacagatctgaacattattgtcactaacaactcctctttggtgtacaggtgagccgaatcgctcaataagtgagaagcctaacccccctgcttcatgtgtagccttcggccattgtccattttaaccactggaggtcagatcctcgtaagcagaaaaccagctggttctacttctagccgaggcccagcg

SEQ ID NO: 3587 - DNA, 3361 bp, Sorghum bicolor
gatggcgaagctaacatcggagctgctacggccggtggacccggcggcggcgctggacgaggcggcgctgctgcgctacctggccgccaacgtcccgggcttcccgggccccgcgcccgcgctgtcgctgacccagttcggccacggccagtccaaccccacctactgcatccacgcctacgcctccgcccccggcgggggaccggctaggcgctacgtgctcaggaagaagccgcccgggtccatcctccagtccgcgcacgccgtcgagcgcgagtaccaggttctcaaagctctgggtgatcacacagatgttcctgtcccgaaggtttattgtctatgcacagatgcaagtgtaattggaactcctttctatgtaatggagtatctggaaggaataatatatcctgatagcgcgttgccgggggtgactccatctaaaaggcgagctatatatttttatactgccaaaactttggctgctatacacaaagttgatgttgatgccattggattgcagaagtatgggagaagagacaattattgcaaaagacaagtacaaagatgggagaggcaatatcttgcatccactggtgaagggaagcctgcacgttatcagaggatgcttgatctagctcgttggttgaaagaacatgtaccaaaagaagattcctcagcaggatcgggaacaggtcttgttcatggtgattaccgccctgataatctagtttttcatccaacagaggatcgagtaattggcgttattgactgggaactatctactttgggaaatcagatgtgtgatgttgcttatagctgcttgccatatattattgatgcatctatcagtgaaaggacttcttatggagggtttcaagataatggcattccagatgggattcctcaactggaagagtacctttccgtatactgctctttctctgcgagaccctggcctgctgcaaattggaaattctacattgctttttctttgtttcgtggggcctctatctatgcaggagtatatcacagatggactatgggtaatgcttcaggtggtgagcgcgctaaatttgctggcaaggttgctaatgctatggttgactgcgcctgggacttcataaatagagtaaatgtcctgcaagaaccaccttctaagggttttcaagtctcaccagcaccgtggcaagaatttcacagagaggaagaaagttcaacatctgaaaagaatcaaggcaaatttgttcctagtgaaaaggttatgcagcttcgaaagaaactaataaaatttatcgaagatcacatataccctatggagggtgagttctacaaacatgcacaatcaacctcaagatggacaattcatccagaagaagaaaatcttaaagcattggcaaagaaggagggcctatggaacttgtttattccgctagacagtgcagctagagctagaaagctactgttggaagaccattctcaaatttcccttgggagttcgaatgatattttgctaggcgcgggtcttacaaatcttgaatatggatatttgtgtgagattatgggacgttcagtttgtgctccacaaatatttaactgtggtgctcctgatacaggtaacatggaggtcctattgaggtatggcactaaggagcaacagaagcaatggctagttcctttattggaagggacaattcgttctggatttgcaatgacagaaccacaagttgcatcttcagatgcgacaaatatagaatgctcaatatccaggcaaggagatttttatgtgataaatggaaggaagtggtggaccagtggagccatggatcctaggtgcaaaatcctgatattaatgggaaagacagatttttctgcacctaagcataagcaacagtccatgattttagtggacatcaacactcctggggtgcagataaagagaccattgctagtctttggttttgatgatgcacctcatggacacgcagagattacatttgaaaatgtgcgtgttccagtaacaaatatcctgctgggagaaggacggggttttgagattgctcaaggaagacttggtcctggaaggttacatcattgcatgaggctagtaggggcagcagaacgtggcatggatctgatggtagagagggccttaagtaggaccgcatttggaaagaggattgcacagcatggttcctttttatcagaccttgcaaagtgtcggattgaattggagcaggctaggcttttagttcttgaagcggccgatcaactcgatcggcatgggaacaagaaagctcgtggtatcctcgcgatggccaaggtggcagctccaaatatggccctgaaggtgcttgacatggcgatgcaagttcatggtgcagctggtgtctcatcggacacggtcctgtcgcacctgtgggcaacggctaggacactgcggatcgcagacggtcccgacgaagtacatctcgggacaatcgctaagctggagctgcagagggctcggttgtaacttgagggggaagtacagttgtttaggagaataaatggacatggacctgtttgcaaggttaagggatggcaggcagcacgagcacatcgctggcacatagataatgagtaaataatggcgttgtatattcatcaatgtacgatgttgtacacttgtattctctgtggtacttaaccatgtcaacggccggcattagatactatgagcccacaaaaccaaatcagactccaatgtttgatccgaatgatggatgtacagtgattaactggccgtaaaacctgtaatgagtgttaagaatgtatgtgcttttcttgtacatcagagaaagaatcagagcttaacaagcagtgagatgtcatttacttccatacatagatgactagccttcggctgttgtcgattattaaccaaagaatcatcatacagtagtacagtagtaggcatgagatgaaacacatgcagtggttgcaggtccagctttcaggattactgctagctaggctcgatatatatatatatagatataaactttgaactgatgaaaacaaacctgagtgagctagctgaaccgtttttacagtattaattccagaggaacccaaaaattctactagctagctacgctgtataaacatagctaggtgaagcccaatgtgtaggggaaggatgtggagttgagccagaggtctccctggatgaagtcgagcacggtgaagttggcggcgtcggtggcgttggtgagcacgtggtaccccgaccacgccacccttgcggaagtgtcggctccaggcccgcggttcatgtactcggcgtagtatagcgtgtcgagcgcgaaggtgccgttccact

SEQ ID NO: 3588 - DNA, 2807 bp, Zea mays
accaaatccgtccacgctgtctcgtcccctcggcatcgcagtctcctacccaaatcgtcctcgtttcctcctccccgaactgacccgctgttgccgacggctagtaggatgacgaagctgacctcggagctactgcggccggtggttccggcggcggcgctggacgaggcggcgctgctgcgctacctggtggccaacgtcccgggcttcccgggccccgcgcccgcgctatcgctgacccagttcgggcacggccagtccaaccccacctactgcatccacgcctccgcgcccggcggggggcagcccaggcgctacgtgctcaggaagaagccgcccggggccatcctccagtccgcgcacgccgtcgagcgcgagtaccaggttctcaaagctctgggggatcacacagatgttcctgtcccgaaggtttattgtctctgcacagatgcaagtgtaattggaactcctttctatataatggagtatctggaaggaataatatatcctgatagcgcgttgccgggggtaactccatctaaaaggcgggctatatatttgtctactgccaaaactttggctgctatacacaaagttgatattaatgccattggattacaaaagtatgggagaagagacaattattgcaaaagacaggtagaaagatgggagaggcaatatcttgcatccactggcgaagggaagcctgcacgttaccagaggatgcttgatctagctcgttggttgaaagaacatgtaccagaagaagattcctcaccaggaccaggaacaggccttgtgcatggtgattaccgccctgataatctagtttttcatccaacagaggaccgagtaattggcgttattgattgggaactatctactttggggaatcagatgtgtgatgttgcttatagctgcttgccatatattatcgatgcagcacccagtgcaaggacttcttatggagggtttcaagatactggcattccagatggaattcctcaactggaagagtacctttctatatactgctcttttgctgcaagaccctggcctgctgcaaattggaagttctacattgctttttctttgtttcgtggggcatctatctatgcaggagtatatcacagatggactatgggtaatgcatcaggtggtgagcgcgctaaatttgctggcagggttgctaacgctatgattgactgtgcctgggacttcataaatagagtaaatgtcctgcaagaactgccttctaagggttctcaagtcttaggagcatcgtggcaagaatttcacagagaggaagaaagttcaacttctgaaaagaatcaaggaaaatttgttcctagtgaaaaggttatgcagcttcgaaagaaactaataaagtttatcgaagatcacatatacccaatggaggctgagttctacaaacatgcacaatcaacctcaagatggacaattcatccagaagaagaaaatcttaaagcattggcaaagaaggagggcctatggaacttgtttattccgctagacagtgcagcgagagctagaaagctattgtttgaagaccattctcaaatttcccttggaagttcgaataatcttttgctgggcgcgggtcttacaaatcttgaatatggatatttgtgtgagattatgggacgttcagtttgggctccacaaatatttaactgtggtgcacctgatacaggtaacatggaggtcctgttgaggtatggcactaaggagcaacagaagcaatggttagttcctttattggaagggacaattcgttctggatttgcaatgacagaaccacaagttgcatcttcagacgcgacaaatatagaatgctcaatatccaggcaaggagatttttatgtgataaatggaaggaagtggtggaccagtggagctatggatcctaggtgcaaaatcctgatattaatgggaaagacagatttttctgcacctaagcataagcagcagtccatgattttagtggacatcaacactcctggggtgcagataaagagaccattgttagtctttggttttgatgatgcacctcatggacacgcagagattacatttgaaaacgtgcgtgttccagtaacaaatatcctgcttggagaagggcgtggttttgagattgctcaaggaagacttggtcctggaaggttacatcattgcatgaggctagtaggagcagcagaacgtggcatgaatctgatggtagagagggccttaaacaggaccgcatttggaaagaggattgcacagcatggttcctttttatcagatcttgcaaagtgtcggattgaactggagcaggcaaggcttttagtccttgaagctgccgatcaactcgatcgacatgggaacaagaaagcacgtggtatcctcgcgatggccaaggttgcagctccaaatatggccctgaaggtgcttgacatggcgatgcaagttcacggcgcagctggtgtctcgtctgacacggtcttgtcgcacctatgggcaacggctaggacactgcggattgcagacggccccgacgaggtccatctcgggacaatcgccaagctggaactgcggaggtctaggttgtaactcgagggcgatgtacagctcgcccgtcttgcgaatgaataaagaaggaacatcacccgtcgtcatttaacgtccatgtgaatacttagatgaataaataaatcctactttcagtagcagttactcttattttcaataaaccatatataatatcaatctttaataaatcatatcatttactcatcttcattaaa

SEQ ID NO: 3589 - DNA, 2832 bp, Oryza sativa
tggacaagatatccgcgacgaccagtagtggcatcggcgcatcgcctcctccccttccttctcttctctctcctagtcgtcgccggcggggagcgagcgatgctgacctcggggctgctgcggccggtcgacgatgcgcacgcgatcgacgaggcggcgctgctgcgctacgcggcggagcacgtcgccgggttcccctccccggcgcgggggctggccctgacgcagttcggccacggccagtccaaccccacctactgcatcgaggcctccgcccccggcggggtcaccgcgcgctacgtgctgcggaagaagccgcccggcgccatcctccagtccgcccacgccgtcgagcgcgagttccaggtcctcaaagctttgggcacttacactgatgttcctgtccctaaggtgttctgtctttgcactgatgcaagtgtaattggaactcctttctatataatggagcatctagaaggactaatatacccagacaacaagttgacgggagtaactccaactaaaagaaagactatatatcttgcagctgctgaaactttggctgctatacacaaagttgacgtgactgcaattggactgcagaagtatgggagaagagataactattgcaaaagacaagtagaaagatgggggaggcaatatctctcttccactggtgaagggaagcctgctcgttaccagaagatgcttgatctagctcattggttgaaagaacatataccaaaagaagattcatcggcaggatttggaacaggtcttgttcatggtgattaccgtgttgataatcttgtttttcatccaacagaggaccgagttattggtgtacttgattgggaactatctactttgggtaatcaaatgtgtgatgttgcatacagctctttgccgtatattattgatgcaacaactagtacaggttattcttatggtggatttgaatatactggcattccagatggcattcccccactggaagagtacctcgctgcatactgctctatctctgcaagaccctggccggctgcaagttggaagttttatgttgccttttcgctttttcgaggggcatctatatatgcaggagtatatcacagatggactatgggtaatgcttcaggtggtgagcgtgctagattttctggcaagattgctaatgctatggttgaccgtgcctgggatatcataaatagagaaaatgtcctgagagaacagcctgctaggggtatgcatgcctcaaatggcccatcgcaagaattccaaagaaagcatgaaggatcaatttcgacaaaagatcaaggaaaatttgttcctagtgaaaaggttatgcagcttcgaaacaaattgatgaagtttatggaagattacatatacccgatggagagtgagttctataaacgcgcacattcgacctcaaggtggacaattcatccagaagaagaaaaactaaaagccttagcaaagagagagggactatggaacttgtttattccgctagacagtgctgctagagcaagagagcttctgtttgaggacatgtctcatggttctcctggaagttctgaggagcttttgctaggtgcaggtctcacaaatcttgaatatggatatctatgtgagattatgggccgttcaatttgggctccacaaatatttaactgtggtccacctgatacaggcaacatggaggtcctgttgagatatgggactaaggagcaacaaaagcagtggcttgttcctttgttggaagggaaaattcgttctggatttgcaatgacagaaccacaagttgcatcttcagatgcaacaaacatcgagtgttcaatatcaaggcaaggagatttctatgtgataaatggaacgaaatggtggaccagtggggctatggatccaaggtgccaaattcttgtattaatggggaagacagatttttctgcacctaaacataaacagcaatcgatgattttagttgatgtcaaaacacctggagtgcagataaggagaccgttgttagtatttggtttcgatgatgcacctcatgggcatgcagagattacttttgagaatgtgcgcgttccagccacaaatattctccttggggaaggccggggttttgagattgctcagggaagactaggccctggaagattacatcattgcatgagactaataggggcagcagaacgtggcatgaatttgatggtcgagagggccttaagtaggaccacttttggaaaaaagattgcgcaacatggttcctttttagcagatctggcgaagtgccgggtagaactggagcaggctagacttctggtgcttgaagcagccgatcaacttgaccgacatgggaacaagaaagctcgtggtatccttgcaatggccaaggtggcagctccaaatatggccctgaaagtgcttgacatggcaatgcaagttcatggtggtgctggtctctcatcagacacagttctatcacatctatgggcaactgctaggacactgaggatcgccgacggccctgatgaagttcatcttgggacaatcgctaagctggagctgcaaagagcaaggatgtagtctcgcgtcatcaggatgccgcccagatttcatgaataataaatactaggggagagggaaatcgttgtgtaacatgtccccgtttttattgaacgaaattggaaatgacactacgatagttgtcacttgtatagaatggttgatatgtggcgtgaaatttgtggatgttgtactgcgggtattacttcaactgttagctattgcactgtcatctgtccataattcgacaccaacaaa

SEQ ID NO: 3590 - DNA, 2518 bp, Triticum aestivum
ccacgcgtccgcacgtgatgttcctgtccctaaggtgttttgcctttgcactgatgccagtgtgatcggaaccccattctacataatggagtatctggaaggagcattatatcttaataacaagttaacgggaataaccccagataaacggaggaatatatacttggctgctgcgaaaactttggctgctatacacaaaattgatgcgaccgcagttggactgcagaagtatggaaaaagagacaattattgcaaaagacaagtagacagatgggggaaacaatatcttcattcaactggtgaagggaagcccgcgcgttatcagaagatgcttgatctgattgattggctgaaagaaaatataccagaagaagattcatcaacaggattgggaactggccttgttcatggtgattatcgtgttgataaccttgtttttcacccaactgaggatcgagtgataggtgtacttgattggcaattatctactttggggaatcagatgtgtgatgttgcttacagctgtatgccatatattattgatgcaacactcagtgaaaatagttcgtatggaggatttgaacattctggcattccagatggcattcctcaactggaagagtacctagctgtgtactgctctatgtctgcacgaccttggcctgcagcaaattggaagttctacattgccttttcactgtttcgaggggcatctatctatgcaggagtataccacagatggactatgggtaatgcttcaggtggtgagcgtgctagatttgccggtaaggctgccaatgttatggttgactgtgcctggcattacattaatagagaaaatgtcctgcgagcacaccctgctacaggtatgcatgtcttgaaggctccccggcaaggttttcatgtagagcaggaagattcaactttgacaaatggtcaaggcaaatttgttcctagcgaaaaggttatgcagctacggcaaaaaataatgaagttcatgaaagatcatatatatcccaaggaggatgagttatacaaacatgcacaatcaacctcacggtggacaatccatcctgaagaagaaaatttgaaagcattagcaaaagaggagggattgtggaacttatttattccgcttgacagtgcagctagagcaagaaagctactacttgaggaccaatctcatgtttctgctggaagttcaaatgatcttttgctaggtgctggtctcacaaatcttgagtatggatatttatgtgagattatgggccggtcagtttgggctccacaaatatttaactgtggtgcacccgatacgggtaatatggaggtcctgttgagatatgggactaaggagcaacagaagcagtggcttgttcctctactggaagggaaaattcgttcgggatttgcaatgacagaaccacaagttgcatcttcagatgcaacaaacatagaatgtgcagtatccaggcagggagatttctatgtgataaatggcaggaaatggtggaccagtggggctatggacccgaggtgtaaaatcctgatattaatgggaaaaacagatttctctgcacctagacataaacagcagtcgatgatcttagtggatatcaacacacccggagtgcagataaagagaccattgttagtctttgggttcgatgatgcaccgcatggacatgcagagattacttttgataacgtgcgtgttcctgtcacaaatatcctcctcggagaaggacgtggtttcgagattgctcaaggaagactaggtcctggaagattacatcattgcatgcgactaataggagcagcggaacgtggcatgaatatgatggttgagagggccttaagtaggaccgcttttggaaagaagattgcacagcatggttcctttcagtcagacctggcaaagtgtcggatagaactggagcaaactaggcttctggtgcttgaagcagccgatcaactcgacaggcatgggaacaagaaggcccgtgggatcctcgcaatggccaaggtggcggctccaaatatggccctgaaagtgcttgacatggcaatacaagtccacggcgccgccggggtctcatccgacacggccctatcccatctatgggcaaccgctaggacactgcggctcgctgacggccctgatgaagtccatctcggcacgatcgcgaagctggagctgcaaagggcaaggctgtaagaagacgatgaggtccagattcaataaaagggggacggcaagcctctggagaaggtcagttaaggacataatcagtcacgggtagatagcatggtgaataagtggcgttagattcctccatgtacactccctgtttgccttgtcgcttcccttgtcatttgcccactagaaccatgacacatccttaattttcgtcctctgttgtaaagagtccaaccctaccagcacagttacatgagtaccagtgactattacagatctgaacaatagttatacactaccaatgggcattgcagatct

SEQ ID NO: 3591 - DNA, 2659 bp, Panicum virgatum
aacgtcccgggcttcccggggcccgcgccggcgttggcgctcacccagttcgggcacggccagtccaaccccacctactgcatccaggcctcagcccccgggggagggaccaggcgctacgtcctgcggaagaagccgcccggggtcatcctccagtccgcacacgccgtcgagcgcgagtaccaggttctcaaagctctgggttctcacacggatgtccctgtcccaaaggtttattgtctttgcacagatgcaaatgtaattggaactcctttctacataatggagtatatggaaggaattatatatcctgacagcatgttgccgggggtagctccatctaaaaggcgggctatatatttttctactgccaaaactttggctgccatacacagagttgatgttaatgccattggattgcaaaagtatgggagaagagataactattgcaaaagacaagtggaaagatgggagaagcaatatcttgcgtctactggtgaagggaagcctgcacgttatcaaaggatgctcgatctagctcgttggttgaaagaaaatgtaccagaagaagattcctctgcaggagcaggaacaggtcttgttcatggtgatttccgcgctgataacctagtttttcacccaacagaggatcgagtaattggtgttattgattgggaactatccaccttggggaatcagatgtgtgatgttgcttatagttgcttgccatatattattgatgcaacactcagtgaaaggacttcttacggagggttccaacatactggcattccagatgggattcctcaactggaagagtacctttctgtatactgttctttctctgcaagaccctggcctgctgcaaattggaagttctatgttgctttttctctgtttcgtggagcatctatctacgctggagtatatcacagatggactatgggtaatgcttcaggtggtgagcgtgctaaatttgctggcaggattgctaatactatggttgactgtgcctgtgacttcataaatagagaacatgtgttgcaagaacaaccttctatgggttttcaagtctcagcagctctatggcaagaatttggtagagagcaggaaggttcaatttccacaaaggatcaaggcaaatttgttcctagcgaaaaagttatgcaccttcgaaagaaattgatgaagtttattgaagatcacatatacccaatggagagtgagttctacaaacttgcacaatcaacctcaaaatggacaattcatccagaagaagaaactcttaaagcattggcaaagaaggagggcctatggaacttgtttattccgctagacagtgcagctagagctagaaagctactatttgaggacggctctcttgtttcccctggaagttcaaatgaccttctgctgggtgcgggtcttactaatcttgaatatggatatctgtgtgagattatgggacgttcagtttgggctccacaaatatttaactgtgctgcacctgatacgggtaacatggaggtcctgttgaggtatggcaccaaggagcaacagaagcaatggctagttcctctattggaagggaaaattcgttctgggtttgcgatgactgaaccacaagttgcatcttcagatgctactaatatagaatgttcaatatccagacagggagatttctatgtgataaatggaaggaaatggtggaccagtggggctatggaccctagatgcaaaatcctgatattaatgggaaaaacagatttttctgcatctaagcataagcaacagtcgatgatcttagtggacatcaacactcctggggtgcaaataaagcgaccattattagtcttcggttttgatgatgcacctcatgggcatgcggagattgtttttgagaatgtgcgtgtcccagtaacaaatatcctgcttggggaaggacggggttttgagattgctcaagggaggctcggtcctggaagactacatcattgcatgaggctaataggggcagcagaacgcggaatgggtctgatggtcgagagggccttaagtaggactgcatttggaaagagaattgcccagcatggttcctttttatcagaccttgcaaagtgccggattgagctggagcaggctagacttttggttctagaagcagctgatcaacttgaccgacatgggaacaagaaagcccgcggtatcctcgcaatggccaaggttgcagctccaaatatggccctgaaggtccttgacatggcaatgcaagttcacggtgcagctggtgtctctacggataccgtcttatcgcacctatgggcaactgccaggacactgcggattgcagacggccctgatgaagtccatctcgggacgattgcgaagctggagctgcaaagagcaaggttgtaaggacagggtgaagtaaagtttcgagaataaacgaagtaacagcaatctgctcacgagactaggggatggcagcatcactgctggtagtggttgatagacaatgagtaaataaaggcgttatatccatcaatgtgttgtacgattgtactgttagtggcattggatcgatatatctgtccacgaaagtgaatacgactttttcaatcttcgcgctgccgcacagtgatcggcactagatttgaac

SEQ ID NO: 3592 - DNA, 1884 bp, Triticum aestivum
ctctctgattctccaaagcggcggcgcggtgggcattgactggtgtctggtatggcgacaccgccggaagccaacacttcgcccgcgcccaacggcggcggctgcggcgggatcagggtcgagaattgctacgtcttcaagagcaggctgcaggagtacgcgcagaaagccggcctcatgacgccggagtaccaaaccctcaaggaggggccttcccatgagccaatcttcaagtccagcgtggtgattaacaacgtcaagtacgactcgctgcccgggttcttcagccgcaaggctgcagagcagtcggccgccgaagtcgcgctcatggaaatcggcaagtctgtggcgttaccaaccaatgcaaccatcccggcagtccaagaaactggtctgtgcaagaatcttcttcaggagtatgctcagaagatgaattatgctattccatcttatatttgcaacaaacaaggtccatacatatgcaccgtagagattggtggaatacaatacattggtgctacagcacggacaaagaaagaggcagagataaaagctgcccgaactgctcttcttgcaatccaaggccaatcagagggttgtgcaaatggtaccacaaaatatattgttgtgcctggcaaaaggcaaggtaaggagatcgagaaaaagcctgttgaaactccaaaatcacttaagaccaagaaaggtggtttcaagaagcaacggaacaagaataaattcatcaagaagaatggccaagttaacgaggaaaaggatgaaactggagtgcctggagatgctcatcattcagatgtccctatgaagccagctgtaacaacagaagatccattgaccaacactgaaatgatacaacctgatgaagcttggccattcgaacatgaaccgaccggtgacactgcaatgctgcaacctgatgaagacgcttggccatccaaacatgaaccgaccggtgacactgcaatgctgcaacctgatggcgaagctacaaaagtggaacaggagcaactcagtgacacagcaatgctgcaacctgatgatgaaggtggaagagtagaacatgagcaactcagcaacgctccaatggtgctacataatgaggaagctagaaatgtaaagcaggaagcactcattggcactgcaatgccccaacctcacgtggaagacagaagagtgggagcagagccacctagagatgctgcaatggtgcaatctaatgatgaagctagatgcgtaaagcaggagctactaattgacgctgcaatgcctctccccaatgaggaggccggagcagctgcaaatcctgtgccattgagtgactccataacagcgcaacctaatgcagagactacaaatataaatgagtcactgaggaatgcagcatcagcgcaacataatgaagaagctaggaccgtaaaccaggagccacccagcagtgcttcgctgctgcagccaaaggaacccagagtcgagatcggtgaatttgtttctgaaaacaaggaccaaactctgggagatgcatctcgtgaggcaaataggtccatcgaagatatgccagaaaagtgctcagataattcatctgcttttacaagcgtggaataatatttgctgtttgaatcaaaatgcaatggccttccaattttacatcttgattttgcaaactagtaaaacctgaatagctggtttctcattttagaaatataattgcataacagatggatgtacgtggaccgaccgaggtcggttggtggtccatgttggccattagttattaggaagcttgcatgcctgatggtatgatcttggatccatggatgatgtatctcaagttgcttatctgatcaatgaactattagtgaactattatta

SEQ ID NO: 3593 - DNA, 1237 bp, Triticum aestivum
cccaatggaggcagagtacccccaaataaaccctctcctcctctgctccaggcgccggaaaagggaggaggacgagggagggctcgagctgctgctgtccatggatctcgacgaggaggagacgcgctcggagcagcaggcgccgcctcgggttccggacaagctgaaagcagtgtcacaagagcttggacatgacatccggatatttacaagcacaacatttgagctaatgactagcaaattgtccaaggcagatcaggaggaagacgatgacttttatgagcttcagcctagtgattattacaagttgatttcaaataggcttgcagaacaatcgaaagttctgaagactcgtaaaataagggaagcagaacttgctgctcaacgagcaaggctaacaaaggcagtggcgagggttcgattccctgatggttacattcttgaggctgagttccatccatcagagacggtacatagtctggtggatcttctcatgaaagtaattgctagaccagacctgccattctatctttacacagttcctccaaagaagcgaataatggacacctcgcaggacttctacacaattggctttgttcctggagctaatgtcttcttttcttatgatctgccagaagggtcggagttaaatacagatgctgtaaaatccggaccatatctccgtgaagaaattcgaactttggatggactgtcacttcagtcggaaccttctgaccaacctgatgattcaaagacaaattctgattcagctcatcagtcttatgcattccaatctgattctgcaccagcagcagcaaataagaaatcagccaaaccaaagtggttcaaaaggtgagagcatcagagcgtcaatagtgcagcaccagcgcgcaatagcacttgattaggcctctcagcaatcccaatgcatgattgatcagatttcatggttcaacgacttcagccatgccgccgtagtaggacaattcatcctatgttgcataggagttgtcgaaccgtcggaattagatctcatatgttcctggtggtagcatgtaaatttggcgtgtcaaactgctttgttgggtgggtattggttaacccacctctcagatatctgtaaaaggccccatagaaacggaggaaatgacagggcccatgttgtttatactgatatacagtagcatcttcgtgggaagatggcttgagttgaccggaaaattaccaataaagcatg

SEQ ID NO: 3594 - DNA, 1226 bp, Leymus cinereus x Leymus triticoides
  misc_feature (16)..(16): n is a, c, g, or t
  misc_feature (21)..(21): n is a, c, g, or t
  misc_feature (48)..(48): n is a, c, g, or t
cccccaaataaacccnctccncctctgctccaggcgccggaaaagggnagaggacgaaggagggctcgagctgctgctgtccatggatctcgacgaggaggagacgcggtcggagcagcaggcggcgcctcgggttccggacaagctgaaagcagtgggacaagagcttggacatgagatccggatattttcaagcacaacatatgagtcaatgactagcaaattgcccagggcagatcaggaggaagacgatgacttttatgagcttcagcctggtgattattacaagttgatttcaaataggcttgcagaacaatcgaaagttctgaaaactcgtaaaatacgggaagcagaacttgctgctcaacgagcaagaataacaaaggcagtgatgagggttcgattccctgatggttacattcttgaggctgagttccatccatcagagacggtacatagtctggtggatcttctcatgaaagtaattgctagaccagacctgccattctatctttatacagttcccccaaagaagcgaatactggacacctcgcaggacttctacacaattggctttgttcctggagctaatgtcttcttttcttatgatctgccagaagggtcggagttaaatacagatggtgtaaaattcggaccatatctccgtgaagaaattcgaactttggatggtctgtcacttcagtcggaaccttctgaccagcctgatgattcaaagacaaattctgattcagctcatcagtctgaagcattccgacctgattctgcaccaccagcagcaaataagaaatcagccaaaccgaagtggttcaaaaggtgagaccaccatcagagcgtcaatagtgcaccatcagcgcaatagcacttgattaggcctttcagcaatcagaatgcatgagtgatcagatttgatggttcaacgacttcagacatgtcgccgtagtgcgagagttcatcctgtgttgcataggagttgtcgaaccatcggaattagatctcatatgttcctggtggtaccatgtaaatttgacgtgtcaaactgctttgtgggtcttacccacctcagatatgtgtaaaaggccccatagaaacggagaaaatgacagggcccgtgttgtttacactttactgcatgatatccagtagcatcttcgtgggaagatggcttgagttgacctgaaaattaccagtaaagcatgttggcttca

SEQ ID NO: 3595 - DNA, 1176 bp, Triticum aestivum
cccaatggaggcagagtacccccaaataaaccctctcctcctctgctccaggcgccggaaaagggaggaggacgagggagggctcgagctgctgctgtccatggatctcgacgaggaggagacgcgctcggagcagcaggcgccgcctcgggttccggacaagctgaaagcagtgtcacaagagcttggacatgacatccggatatttacaagcacaacatttgagctaatgactagcaaattgtccaaggcagatcaggaggaagacgatgacttttatgagcttcagcctagtgattattacaagttgatttcaaataggcttgcagaacaatcgaaagttctgaagactcgtaaaataagggaagcagaacttgctgctcaacgagcaaggctaacaaaggcagtggcgagggttcgattccctgatggttacattcttgaggctgagttccatccatcagagacggtacatagtctggtggatcttctcatgaaagtaattgctagaccagacctgccattctatctttacacagttcctccaaagaagcgaataatggacacctcgcaggacttctacacaattggctttgttcctggagctaatgtcttcttttcttatgatctgccagaagggtcggagttaaatacagatgctgtaaaatccggaccatatctccgtgaagaaattcgaactttggatggactgtcacttcagtcggaaccttctgaccaacctgatgattcaaaagacaaattctgattcagctcatcagtcttatgcattccaatctgattctgcaccaccaccagcagcaaataagaaatcagccaaaccaaagtggttcaaaaggtgagagcatcagagcgtcaatagtgcaccaccagcgcgcaacagcacttgattaggcctctcagcaatcccaatgcatgattgatcagatttcatggttcaacggcttcagctatgccgccctagtaggagaattcatcctgtgttgcataggagttgtcgaaccatcggaattagatctcatatgttcgtggtggtagcatgtaaatttggctagtcaaactgctttgtgggtgtgtattggttaacccacctctcagatatgtgtaaaaggccccatagaaagcgaaggaaatgacagggcccgtgttgtttacact

SEQ ID NO: 3596 - DNA, 1714 bp, Avena sativa
gagagtacacccaaataaaccctcctctcccactctgccccaggcgccggaaaagggaggacgaagaagggctcgcgctgctgctctccatggatcttgacacggacgagacgcggccgccacagcaagcggcggctccggtcccggccaagctgaaagcagtggcacaagagcttggacatgagatccgtatattttcaagcacaacatttgagtcaataaccagtagtctgcccaaggcagaccaggaggaagacgatgacttctatgagtttcagcctgctgattattacaagttgttttcaaacaggatggcagaacaatcgaaagttctgaagactcgtaaaatacgggaagcagaacttgctgctcaaagagcaaggataacaaaggcagtaatgagggttcgattccctgatggttacattcttgaggctgagtttcatccatcagagacggtacatagtctggtggatcttctcatgaaagtaattgctagaccagacctgccattctatctttatacagttcctccaaagaagcgaatactggacacctcacaggacttctacacaattggctttgttcctggagccaatatcttcttttcttatgatctgccagcagggtcagtgttaaatacagatggtgtaatatcaggaccatatctttgtgaagaaattcgagctttggatggaatgtcacttctctcggagccttctgtacagcctgatgattctaagacaaatgctgattcagcttatcaatctgatgcaccccgatctaatcctgcaccaccagaaaataagaaatcaggcaaaccgaagtggttcaaaaggtgagaccatgagagcttgaagagtgcgccaccagcacattagcactcggttaggcgtttcagcactgacaagacatgattcgtcaacttccatggttcaacgacttgagtttggaaaaggccgtgtggaaccattggaactagatctcatatttttcctggtggtagcatgtaaattgatgtgtcaaaacgtgttggtgggtttgtggtgctttacccacctttagaaatgtgtaaaagatcccacagccacagaaacagaaacacaggaaaatgacagcgctttggtgttgttaacactttactgcatggttgtgtgtccttacagtaaaaaaaaaaaaaaagggcggccgccctttttttttttttttgtaattgctaaataaaatggctcgccagaatctttattaaattttaaggataaaaaatgaactatgaacccaaatttatgaataaattaaattacatgatcggtaaaaatatatacagatttaccaaaactttcacttcttggttaaaaaaggtaaataaacagtaaacagttttaacaaaagtgagaagatatttagttcttgtaatattgatagtaatccttggattccttgctgctagaagtcttggcgcaagcctccgtcttggtgacggtggctgtgactgccttggtgatggtggctgtgactgccttggtgatggtggctgtgactgccttggtgacagtaacggtacttgcgccgccgccgtaaccgtaaccgtaatcgctggccatggccatagcgctcaataaaacgaagaagaagagagtgatgaagacttgtgcgaatttcatgattgatgtttctttgtttgtttgaattgattaattgtttgaattgtttg

SEQ ID NO: 3597 - DNA, 743 bp, Pseudoroegneria spicata
gggctcgagctgctgctgtccatggatctcgacgaggaggagacgcggccggagcagcaggcggcgcctcgggttccggacaagctaaaagcagtgtcacaagagcttgggcatgagatccggatattttcaagcacaacatttgagctaatgactagcaaattgcccagggcagatcaggaggaagacgatgacttttatgagcttcagcctggtgattattacaagttgatttcaaataggcttgcagaacaatcgaaagttctgaagactcgtaaaataagggaagcagaacttgctgctcagcgagcaaggataacaaaggcagtgatgagggttcgattccctgatggttacattcttgaggctgagttccatccatcagagacggtacatagtctggtggatcttctcatgaaagtaattgccagaccagacctgccattctatctttatacagttcctccaaagaagcgaatactggacacctcgcaggacttctacacaattggctttgttcctggagctaatgtcttcttttcttatgatctgccagaagggtcggagttaaatacagatgctgtaaaattcggacaatatctccgtgaagaaattcgaactttggatggactgtcacttcagtcggaaccttctgaccaacctgatgattcaaaggcaaaatctgattcagctcatcagtcttatgcattccaatctgattctgcaccagcagcagcagcaaa

SEQ ID NO: 3598 - DNA, 3346 bp, Triticum aestivum
gcgcgctgtgcctccgcggctctccccttcttcctcctcccgctcccacccgctccacatcccgccgctcaaaaccctaaccctagatcgcgagggccggctgacatggccagcaagttcgggctcgccggcggaatcccggagcggcgggtgcggccgatctgggacgccgtcgactcgcgacagtacaagtccgcgctcaagctctgcaccgcgctcctcgccaagcaccctacctcaccctacgccctcgctctcaaggctcttactttggaaaggatgggaaagcctgatgaagcactgagtgtctgtttggaagccaaggagctattgtactcaaataacattttccattttgacgatctcacccttagcacacttcagatagtgtttcaaaggcttgagagattggaccttgcaacttcatgctatgagtatgcttgtacaaaataccctaataacttggaattaatgatgggactctttaattgctatgtcagagagtactcatatgtgaagcaacaacagacagcgcttagaatgtacaaaactgtaggagaagaaaggtttttgctttgggcagtctgcagtattcaactgcaggcatattttagcagcggaggtgagaaattgttagcatttgctgaagcattgcttaaaaagcacataagttcacatagtttacatgagccagaagcactttctctctatgtttcaattctggaacaacaggcaaagtatgatgctgctttggaagttctatctggagacttggggtctcttatgggaagggaggaggacaagcttcgtttgcagggacgccttcttactcaagcgtgtaattatgtggctgcttctgagatatatcagaaggttcttgaatcttgtcctgatgactgggagtcctttctccattatttaggctgtctgctggagcgtgacgtggagctgcctaaaccaaccactggcgaacatacttgttcttcctgctctgtagatttgaacaaaacttctctcagtgaggaggtggtcgaatctcgccttgcaagtgcattgttatttgtgcaaaagctacaaaaaaatgactccagtgactgtgttagaggtcctcatctagccaatattgaaattgaacggcaacaccgcctcagtggaaactcaacaaagtttatggaagctttggtaaactatttccacagatttggtcacttgtcttgctcatcgtcagatgttgaaatatacctccacatgctatcgggtgatgaaataacggagttgctagatacaatttccagatcttttgatgcatcatcggtttcagtaaaagcactgggtttgacaataactgcttttaaggttcaagaacttttgggaactttattatcaaagtcaactacagatcttcagtgcattgcaaaaggaatggtcgagacattttacaaaaacttacctctctcaagagacttagatcctcaggaaagcatgcatggagaagaactgctgtctatggctagcaatattcttgtgcagcttttttggcgtacaaggaacttagggtacttacttgaagcagttttggtgctagagtttggattgactgttcgcaagcatgtctggcaatacaagattactctggtgcatctgtactcttacttgggggctcttccgttagcacatcgatggtatgtaagcctggaggtcaaaaacattcttctagaatccgtctcacaccacatcttgccacagatgttgagttctcctttcttgcaacaaactgccagtcttgtgaaggattatcttaggttcatggatgatcatttgaaagaatctgctgatcttacctgtcttgcatataggcaccgtacttactcaaaggtaattgaatttgtgcagttcaaaaatcgcttgcaacgctccatgcagtatcttgctgtaaaatctgattctgtaatactgagtctgaagcagaagtctgagtctcttgacgaagtggagtctgttcttgaaaatgtgaatcatggaggaggcttggttgatctatcaagtgaagacaacatgaaacatttaacttttaatgaagatctcgaggcacgcccttggtggacaccaacaaccagtgtaaattttctttcagaaccaattgatgaaagttcgacacctgcgtgctttagggccaaagtgtgcaagcacaaatctactgagaaggatggccctaagatgagagatgctgagagaaaatgtcttgtcccccggcttgtttacctttccatgcatggttgtgtatcttccctcagggagactgagcccaacgggtctgtttctgatataactgttggggaaatgaaaaccttacttgagaaatatgctaggactattggctattccatggatgatgctctaagcatgattcttggtatatcttcaggcaagaagtctatgaaggattttgctcctgatattgtgagctggatgagttttgctgtatttattaatgcaatgaacttgtggtcaaatgaatcagtgatccccagaactgatccgagcagcccaagttcttgggagattgtggacagcttagtgaaaatttgcatagaggagcacctgactgatgccaatcgaatcctgacttgtcctggaaataaaattccactgttagttcagatggttacagaacccatttcttggcatctcatcataatccagtcctgcatgagagtggtggccccgcaaggaaagaagaaaaagaaaagcggcccatcggtgcgaccaaacatgcctcagttgcaaggaattcaaagatctgttcagtgcttgattgaaacactccgaagtgtccaaaaatggttatctgatcagatgagtccagaggagcaaggtttggatatcttaatgtcatatttgcaaggaactggcgatgaaggcccaggacagacattcagagtcttggaagagaaaccaattgcacatgcctctgagcttggtgatcgaattgctcagtctctggaagcatggagttctactggcgtggtaagaagaattgttggagcagaacatgaggtgctagccgagttcaagaaaatggttgactctaaactcaagctgctcatgtcagaatcggcttctctatcttcgatgttacactagagttgatgaaattttgcacatgaattttgttctattcttgttgtggcgttccattatacatatgttgtaacagtataacagaatggctgtgcgcttttgttgtttgactttcttttattcgattgaggacatctttttcccctttgcttttgtgtctctgctcctgatttggtattgtggtatagttattgtattactccaa

SEQ ID NO: 3599 - DNA, 3626 bp, Brachypodium distachyon
ccttcttcctcctcccgctcccacccgcgccaccacctgctccaaaaaccgaaccctagatcgcgaggtgtcggctgagatgtccagcaagttcgggctcgccggcggaatcccggagcggcgggtgcggccgatctgggacgccgttgactcgcgacagtacaaggctgcgctcaagctctgcaccgcgctcctcaccaagcaccccacctccccctacgccctcgctctgaaggctctcattttggaaaggatggggaagcctgatgaagcactgagtgtctgtttgaatgccaaggaactattgcactcaaataacattttccattttgatgacctcactcttagcacgctacagatagtgtttcaaaggcttgagagattggatctggcaacttcatgctatgagtatgcttgtacaaaataccctaataacctggaattaatgatgggactttttaactgctatgtgagagagtactcatatgtgaagcaacaacagacagcaattagaatgtataaaactgtaggagaagaaaggtttttgctttgggcagtttgcagtattcaactgcagttctatttcagcagtggaggtgagaaattactagcactggctgaagcattgcttaaaaagcacataagttcgcatagtttacatgagccagaagcgctcgctatctatatttcaattctggaacaacaggcaaagtatgatgctgctttggaagttctttctggagacttgggatctcttatgggaagggaggaggacaaacttcgtttgcagggacggcttcttactcaagcatgtaactatgtggctgcttctgagatatatcagaaggttcttgagtcttgtcctgatgactgggagtcctttctccattatttaggctgtttgctggagcttgatgtgaacatgcctaaaccaaccactggtggacacacttgctcttcttgctctgtagattcgactatgttgaacaagacttctcttagcgaggaagtggttgaatctcgccttgcaagtgcattatcgtttgtgcaaaagctacaaaaaaatgagtctggtgactgtgttagaggaccccatttagctaatattgaaattcaacgtcagcgccgtctcagtggaaacacaatcgataggaagttcattgaagctttggtaaactacttccacagatttggtcacctgtcttgttcatcgtcagatgttgaaatatatctccacatgctatcgagtgatgaaataactgagttgctagacacaatttccaggtcttttgacgcatcatcagtttcagtaaaagcactgggattgacaattactacttttaaggttcaagagcttttgggaattttattatcaaaatcaactacagatctgcagcgtattgcaaaaggtatggttgagacattttataaaaacttgcctctctcaagggacctggatccccaggaaagcatgcatggtgaagaactactttctatggctagcagtattcttgtgcagctattctggcgtacaaggaacttaggatacttacttgaagcagttttggtgctagagtttggattgactgttcgcaagcatgtctggcaatacaagattactctggtgcatctgtactcttacctgggagctcttccattagcacatcgacggtatgcaagcctggaggtcaaaaacattcttctagagtccatctcacaccatattttgccacagatgcttagttctcctttcttgcaacaaactgccaatcttgtgaaagattatcttaaattcatagatgatcatttgaaagaatctgctgatcttacctgtctcgcgtataggcatcgtacttactcaaaggttattgagtttgttcagttcaaaaatcgcttacaacgctccatgcaatatctttgtgtaaaatctgattccgtgatacttagtctgaagcagaagtccgagtctcttgaggaagtggagtctgtacttgaaaatttgaaccacttggtgtatctatcaaatgaagacaacatgaaacacctcacttttaatgaagatcttgaggcacgaccttggtggactccaacaaccagtgtaaactttctttcagaaccaattgacgaagtttcaacacctgtgtgctttagggccaaagtgtgcaagcacaaatctactgagaaggatggtcctaagatgagagatactgagagaaaatctctcgttcctcggcttatttatctttccatgcatggttgtgtatcttcccttggggagactgaactcaacggggctgtttctgacattaccattggggaaatgaaaaccttacttgagaaatatgctaggagtattggctattccattgatgatgctctaagcatgattctgggtatgtcttcaggcaagaagtctatcaaggattttgctcctgatatagtcagctggatgagctttgctgtatttattaatgcgatgaacttctggtcaaatgagtcgctgatccccagaactgatcagagtggccctagttcctggcagattgtggatagtttggtgaaaatctgcgtagaggagcagctgactgaagccaatcgaatcctgacttgtccaggaaataacatcccagttttagtgcagatggttacagagcccatatcttggcatcttatcatgattcagtcctgcatgagagcgatggctccgcaagggaagaagaaaaagaaaagcggaccagctgagcgatcaaacatacctcagctgcaaggaatccaaagatctgttcaatgcttgattaacacagtccaaagcatccaaatatggttatctgatcagatgtgcccagaggagcaagctttggataccttgttgtcatatttgccagcagccagtgacgaaggtcctggacagatgctccgtgtcttggaagataatccagcagcgcatcactctgagcttggtgatcggattgcccagtctttgaaaacatggaattgtactgacgcgctaagaagaattgtgggagcagagcatgagctgctagctgagttcaagaaaacatgcgactcaaaattaaagctactcacgtcagaagcggcttctctttcttcggtgttacattagcgttcataaacttttgcacatgaattttgctctcggctttacattatatatgttgtaacagtaaaggaattgctgtgcgctgtccattgtttgacttctctttatatgattttgttggagtgacatcatctccctttaccttgttttatatttccgctgctggctggaaatggtggctatcagtgaaattgtatcagtcgatgaatcgatgacgggcgcaattagtgaaccttcgtgatacatctttgtagtcatgtggcttattatatgtcacataggggcggccaacaacaacggtgaagctggtgcacctgattacctccatcactggtccgcgccatggcccctagcttcaccgcctggtcaccagcagcagtgtgagactctagcgcggacagtatcgaacacatcaatacaactgcgaagcagtattgatccctctacagaacttcttagggcatctgcatagtcatttgtcaaatcttagccatttgatgggtcg

SEQ ID NO: 3600 - DNA, 3433 bp, Oryza sativa
gcttccgccgctgcggcgtctctctccctttctctccccctcccttcccttcccatcaccgccgcggaacgcgccgccgccagaaaccctaaccctagatcgcgaggggtggtgggtggccgggccggcggggggtggggggatggcaagcaagttcgggctcgccgggggcatcccggagaggcgggtgcggccgatctgggacgccgtcgactcgcgccagtacaaggctgcgctcaagctctgcaccgcgctcctcgccaagcacccgacctccccttacgtcctcgctctcaagggtcttattttggaaaggatgggaaagcctgatgaagcactcagtgtgtgtttgaatgccaaggagcagttgtattctgacaacatctttcattttgatgatctcactcttagcaccctgcagatagtatttcaaaggcttgagcgattggatcttgctacttcatgctatgagtatgcttgtacaaagtaccccaataacttggagttaatgatgggcctttttaattgctatgtcagagagtactcatatgtgaagcagcaacatacagcaataaaaatgtacaaaaccgttggagaagaaaggtttttgctctgggctatttgcagtattcaactgcaggtacactttagcattggaggtgagaagttattaccactggctgaagcgttgcttaaaaaacacataacttctcatagtttacatgagccagaagcactggcactctatatttcaattctggaacagcagtcaaaatatgatgctgctttggaagttctttctggagacttggggtctcttatgggaagggaggaggacaagcttcgtctgcagggacggcttcttgctcaagcatgcaactacactgctgcttccgagatatatcaaaagatccttgaatcttgtcctgatgactgggagtcctttctccattatttaggctgcttgctggagcatgatgtgaacttgcctaaatcaaggacaagtgaacacccttcttcattacctgtagattctgctctggcccttaagacttctttaagcgacgagctggtagagtctcgccttgcaagtgcattgtcattcgtgcaaaagctacaggttaatgacaccagcgactgtgtcagaggacctcatttagccagtattgaaattgaacggcaacggtgccgaagtggaaacccaactgatagaaaattcattgaagctttgataaattactttcacagatttggtcatttgtcttgtgcagcatcagatgttgagatatacctccacatgctatcaagtgatgaaacaactgaattgttagatacaatctccagatcttttgatgcatcatcactttcagtaaaaggactgggtttggcaataaccacttttaaggttcaagaactcctgggaacctttttctcaaaatcaactacagaactccagcacattgcaaaaggaatggttgaggcattttataaaaacttgcctctctcaagagaccttgatcctcaagaaagcatgcatggtgaagaattgctatgtatggccagcagtattcttgtgcagctattctggcgtacaaggaacttaggatacttaattgaagcaattctggtgctagagtttggattgactgttcgcaagtatgtctggcaatacaaagttatgctggtgcatctctactcttacctaggagcacttccattagcacatcgatggtatgtaaccctggaggtgaaaaacattcttcttgaatctgcgtcgcatcacatcctgccacagatgttgaattcacctttactgcagcaaactgctgatcttgttaaggactatctaaaatttatggatgatcatttgaaagaatctgctgatcttacctgtcttgcatatagacaccgtacttactcaaaggtaattgaatttgttcagttcaaagaacgcctgcaacactccatgcagtatctttctgtaagatctgattccataatattgagtctgaagcagaaggctgagtctcttgatgaagtggagtctattcttgaaaatgtgaaccatggggcaaggttggttgaactatcaaacgaagacaacgtgaaacgctttacttttaacgaagatcttcaggcacgcccttggtggacaccaacaacaagtgttaattttctgtcagaaccatttgatgaaggttctacacctgcatgctttagagccaaagcgtgtgaacacaaatctactgagaaggatgactcaaagataaaatatgctgagagaaaagctcttcttcctcgtcttgtttatctttcgatgcatggttgtgcatcttccctcagggagactcaactcaatggatctggtttggatactgatgccacagagatgaaaccattacttttgaaatatgctaggagtattggatattccattgatgatgcccttagtgtgattctgggtatgtcatctggcaagaagtctgtcaaggattttacccctgatatagtcagttggatgagctttgctgtatttatcaatgcatggaacttgtggtctaatgaatcggtagtccccagagctgatgagagcagcccaagttcctggcaaattgtggatagcttggtaaaaatttgcgtagaggagcagctgattgatgccaaccgaatcctaacttctcctggcaataacataccagtcctagtgcagatgattacagaacccatttcttggcatctcgtggttattcagtcttgtgtgaggtcgatggctccacagggaaagaagaaaaagaagggtggtccatcggagcgaccaaatgtacctcggttgcaggcgattcaaagatctgtgcagtgcatgatcgacacactccgcagtgttcaatcctggttatctgaccagatgaggccggaggagcaagctttggatattttgttgtcatatttgcaaggaggtaatgaggatgggccaggacagatatcctgtatcttggaggagaattcagcaagacataaccctgaactcggcgaacggattgctcaatctttggaaacatggagttctgctggtgtggtcagaagaatcgttggagcagagaaggagctgttagttgagttaaagaaaatatgcgactcaaaactaaagctgcttgcttcagtatcggcttctctatcatcggccttacattgaaattgaaaaattttgctcgtgaattttgttccattgttgtgacatatgttgtgagtgtaactgtttggctttgcgccgtccattctttactttgtttctatgagattttgctggagtgatccctgcttctcccctctgttttgcatttctccattttttactgccattgctggtcacgcattcttttggaagtaaaatgcttaatcatcgagatgtggactggcaacgacgaaagcatct

SEQ ID NO: 3601 - DNA, 616 bp, Triticum aestivum
caaagaacacaacagcacatacacacagcaagcagaagaagcttttttttttcaaggagcggcgaggatgcagacggccaaggtgaaggtgaaggacgcggtgagctcggccaaggagaaggcgaaggagggcacggccaaggcgcagggcaagacgggcaaggccacggccaccacgcacggcgagaaggagatggccaaggaggagacgcgcgccaacaaggcccaggccaaggccgagatgcaccaggagaaggccgagcaccgcgccgaggccgcggccgggcgccacggcgccacgcacgtgcccctcaccgggccgcatggccaccaccgtcccgtcggcgcggctcctgccgccgccgaccctgcgtacccgggcaccggcgcgtacccgaccacggacaagtacgtgtagacgtgagatgatcgagggacaggagctggcagctagtgttttttatgtgtggctagttatcctgcccgtgtgtcgtaggtggcgcgcgcgtgtatgctgtgcccacatgcgtgtgcccgaataaaatgtatcggtcagttgtaaaatgcacctttgatgtactagtaatttgtgacttgagcgctcttgcctgttttc

SEQ ID NO: 3602 - DNA, 628 bp, Triticum aestivum
caagcacccacacaaagaacacaacagcacatacacacagcaagcagaagaagcttttttttttcaaggagcggcgaggatgcagacggccaaggtgaaggtgaaggacgcggtgagctcggccaaggagaaggcgaaggagggcacggccaaggcgcagggcaagacgggcaaggccacggccaccacgcacggcgagaaggagatggccaaggaggagacgcgcgccaacaaggcccaggccaaggccgagatgcaccaggagaaggccgagcaccgcgccgaggccgcggccgggcgccacggcgccacgcacgtgcccctcaccgggccgcatggccaccaccgtcccgtcggcgcggctcctgccgccgccgaccctgcgtacccgggcaccggcgcgtacccgaccacggacaagtacgtgtagacgtgagatgatcgagggacaggagctggcagctagtgttttttatgtgtggctagttatcctgcccgtgtgtcgtaggtggcgcgcgcgtgtatgctgtgcccacatgcgtgtgcccgaataaaatgtatcggtcagttgtaaaatgcacctttgatgtactagtaatttgtgacttgagcgctcttgcctgttttc

SEQ ID NO: 3603 - DNA, 740 bp, Pseudoroegneria spicata
cgcatcagtagaacgcccaagcaccagcacaagaacacatacgtacacaccagcagaagctttttccgaggagcggcgaggatgcagacggcgaaggtgaaggtgaaggacgcggtgagctcggccagggagaaggcgaaagaagggacggccaaggcgcagggcaagacgggcaaggccacggcgaccacgcatggcgagaaggagatggccaaggaggagacgcgcgccaacaaggcccaggccaaggccgagatgcaccatgagaaggccgagcaccgcgccgaggccgcggcggggcgccacggcgccacgcacgtgcccctcaccgggccgcacggccaccaccgccccgcgggcgcagcgcccgccgccgccgaccctgcgtacccgggcaccggcgcgtacccgaccacggacaagtacgtctagatgcgagatgatcgggggatcaggagctagaagctagtgttttttgtttgtagctagtgatcctgcccgttgatctgtgttggcgctcgcctgtatgctgtgtgcacatgcgtgtgccggaataaaatgtactccgtatcggtcagttgtaaaatgtatcggtcagttgtaaaatgcacctttaatgtattagtaatttgtgagggctcttgcctgttttgaagtataattcgtggtgctgtttattttagtatttttgtaatgctgttgtacgatggaattaattctccatttctttatgctggatc

SEQ ID NO: 3604 - DNA, 586 bp, Triticum aestivum
cacagcaagcggaagaagcttttttcccgaggaagagcggcgaggatgcagacggccaaggtgaaggtgaaggacgcggtgagctcggccaaggagaaggcgaaggagggcacggccaaggcgcagggcaagacgggcaaggccacggcgaccacgcacggcgagaaggagatggccaaggaggagacgcgcgccaacgaggcccaggccaaggccgagatgcaccaggagaaggccgagcaccgcgccgaggccgccgcggggcgccacggtgccacgcacgtgcccctcaccgggccgcatggccaccaccgccctgcgggcgccgccgccgaccctgcgtacacgggcaccggcgcgtacccgaccacggactagtacgtctagacgccagatgatcgggggatcaggagctggcagctagtgttttttgtgtgtggctagtgatcctgcccgtgtgtcgtagttggcgcgcgcgtgtatgctgtgcgaacatgcgtgtgcccgaataaaatgtatcggtcagttgtaaaatgcacctttgatgtactagtaatttgtgagtccagtgctcttgcatgttttc

SEQ ID NO: 3605 - DNA, 629 bp, Triticum aestivum
  misc_feature (41)..(41): n is a, c, g, or t
gccgagacacccaagcacccacacaaagaacacatacacanagcaagcggaagaagcttttttcccgaggaagagcggcgaggatgcagacggccaaggtgaaggtgaaggacgcggtgagctcggccaaggagaaggcgaaggagggcacggccaaggcgcagggcaagacgggcaaggccacggcgaccacgcacggcgagaaggagatggccaaggaggagacgcgcgccaacgaggcccaggccaaggccgagatgcaccaggagaaggccgagcaccgcgccgaggccgccgcggggcgccacggtgccacgcacgtgcccctcaccgggccgcatggccaccaccgccctgcgggcgccgccgccgaccctgcgtacacgggcaccggcgcgtacccgaccacggactagtacgtctagacgccagatgatcgggggatcaggagctggcagctagtgttttttgtgtgtggctagtgatcctgcccgtgtgtcgtagttggcgcgcgcgtgtatgctgtgcgaacatgcgtgtgcccgaataaaatgtatcggtcagttgtaaaatgcacctttgatgtactagtaatttgtgagtccagtgctcttgcatgttttcatcac

SEQ ID NO: 3606 - DNA, 712 bp, Triticum aestivum
ttcggtacggtcccccattccctgggtcgacccacgcgtccgcacagcaagcagaagaagcctttttccgaggagcggcgacgatgcagacggcaaaggtgaagatgaaggacgcggtgagctcggccaaggagaaggcgaaggagggcacggccaaggcgcagggcaagaccggcaaggccacggcgaccacgcacggcgagaaggagatggccaaggaggagacgcgcgccaacaagtcccaggccaaggccgagatgcaccaggagaaggcggagcaccgcgccgaggccgcggccgggcgccacggcgccacgcacgtgcccctcaccgggccgcacggccaccaccgccccgtgggtgcaggtgcaggtgcagcgcctgccgccgccgaccctgcgtacccgggcaccggcgcgtacccgaccacggacaagtacgtctaggtgtgtgatgaccgggatcaggagctggcacctgttttctttgtgtggctagtgatcttgcccgtctgtcctagttggctcgcgcgtgtatgctgcgcgcacatgcgtgtgcccgaataaaatgtatcggtcagttgtaaaatgcacctttgatgtactagtagtaatttgtgactcgagtgctcttgcctggtttcatccccaaagtttgatttgtaatttgtaacttgagtacttgtttattcgcttggcgtgcgtgcgaatcc

SEQ ID NO: 3607 - DNA, 658 bp, Triticum aestivum
caagcacccacacaaagaacgcatacacacagcaagcagaagaagcctttttccgaggagcggcgacgatgcagacggcaaaggtgaagatgaaggacgcggtgagctcggccaaggagaaggcgaaggagggcacggccaaggcgcagggcaagaccggcaaggccacggcgaccacgcacggcgagaaggagatggccaaggaggagacgcgcgccaacaagtcccaggccaaggccgagatgcaccaggagaaggcggagcaccgcgccgaggccgcggccgggcgccacggcgccacgcacgtgcccctcaccgggccgcacggccaccaccgccccgtgggtgcaggtgcaggtgcagcgcctgccgccgccgaccctgcgtacccgggcaccggcgcgtacccgaccacggacaagtacgtctaggtgtgtgatgaccgggatcaggagctggcacctgttttctttgtgtggctagtgatcttgcccgtctgtcctagttggctcgcgcgtgtatgctgcgcgcacatgcgtgtgcccgaataaaatgtatcggtcagttgtaaaatgcacctttgatgtactagtagtaatttgtgactcgagtgctcttgcctggtttcatcacaaaagtttgattcgtaaaaaaaaaa

SEQ ID NO: 3608 - DNA, 1959 bp, Triticum aestivum
ggaagatgcaggcgacgccggcggcggccgctccaccgcccggaagctggtgccgtggtcgagctgggcggagtggcgcttcgtccgcgacgctatcttctccccctaccccgaccctggcgccgctcttcgcaggatcgcggcgtggcggagcaggggctgcctccctatccccgtggaggtcactgcggccctcttcgagataaggctgcgggatcccttcttccggaatggagtggcttcagatgataagctggagtcagacgagatgctcgccttgctgtacagtatggcaatcatcagacttgtaaatggttttatggagagcccgcacaaggaaactggtcgttcaatatctgatttagctgagactgttggagtaccacgaattctcgttgacattcgtcatgagagttcacatcgcggcatcccctctctgcgactgctacatttggcagccattaaggcatttgattggttgaagtgtaattactgggattcccagactagtgcaattcctgatgttcgactagaactaaactcagtattgcatgacatcgctcaatccctgaagggaaaagattctgaaaatgcaaaatcaggttccaaaaggaaacgttcccagaaacatattttaaatgccatcagatatgtacgtcgactttactatacatgtccctctgaggctgtctctgttcttttggagttttgtcagctcgatgccccagaaatctctgaaaacagcgatgtacatcaatctgatagtttggatgtgaatcactcatctgatgttcaaattcagaatcaaatatcaaatggagatatgaaaaccatcataacaaaactatcagaaaaagaaccaagagtgcttcttggcttactaaagtcggtaattgaaatgattgaggccaggaacgaccttgaacacaaaggtggatcatatgtatgcctgccagctgagtcatcaacaatgaaaaacttgtgctccctggttctatggattgtcacaagcataaaagagttaaaggattccggccgtattggacttgtccacgagataggagtactctcttcggacaggaatgcggtccctcgtttctgtctcgcaaaacttctgcagaagttattgagtttgcccgctataggtgaaagatgcattgcagatgcagcactattgttgattgagatggccggcaataacaatgtgaaggagaaactgaggaagcttcctttgttgtccctgcgaagatcacccaaagattgtaccctccttgaatccagaatcttgcccaatggacaagaatcggttgaaagcgcaacacagaagctggaagcgttcaagttgcagttgagaaaaacagataatgcgagtttagctgaaaatggaactgagggaacgctcaacacaagcatgccagagaaacgtaataggtggtctatagcgaagtcctggaccccctgtccgctaggaatgataccatgttcatatagttcaactgctgttctgccggtccttgatgtcattgatgatgaactgaagcatgacacagcagaacatgaaaattttgagcctgatggtcaaatcgaaattttcgactgctattctcaaccggagcagcagttggatggtgaaggcatcctagaaatatcaagattaccacctgaacatgggatttctgatatgccagaatcgacctttggtctcaggggtacattactggttggtggcgtgtggaaaaaggtgaccgaagaagagttgctctccataaagtcaagcatgaaaattttgttgtaatattggctagttaatctcccttcagcagtaaattagttttcttctttatgcgcaaaaaaaagttagttttcttctgaacaatcaaacagtactacagcttttactggggcatgacaaaaccctctttaatcagttgtgctcagtttcttcactatttgagataa

SEQ ID NO: 3609 - DNA, 2038 bp, Triticum aestivum
  misc_feature (283)..(283): n is a, c, g, or t
  misc_feature (301)..(301): n is a, c, g, or t
  misc_feature (343)..(343): n is a, c, g, or t
  misc_feature (607)..(607): n is a, c, g, or t
  misc_feature (788)..(788): n is a, c, g, or t
  misc_feature (874)..(874): n is a, c, g, or t
  misc_feature (1072)..(1072): n is a, c, g, or t
  misc_feature (1093)..(1093): n is a, c, g, or t
  misc_feature (1165)..(1165): n is a, c, g, or t
  misc_feature (1179)..(1179): n is a, c, g, or t
  misc_feature (1217)..(1217): n is a, c, g, or t
  misc_feature (1230)..(1230): n is a, c, g, or t
  misc_feature (1240)..(1240): n is a, c, g, or t
  misc_feature (1243)..(1244): n is a, c, g, or t
  misc_feature (1872)..(1872): n is a, c, g, or t
gtggactcgccgctcaagctcggctcccatggaggcggcggaagatgcaggcgacgccggcggcggccgctccaccgcccggaagctggtgccgtggtcgagctgggcggagtggcgcttcgtccgcgacgctatcttctccccctaccccgaccctggcgccgctcttcgcaggatcgcggcgtggcggagcaggggctgcctccctatccccgtggaggtcactgcggccctcttcgagataaggctgcgggatcccttcttccggaatggagtggcttcngatgataagctggagtcngacgagatgctcgccttgctgtacagtatggcaatcatcagncttgtaaatggttttatggagagcccgcacaaggaaactggtcgttcaatatctgatttagctgagactgttggagtaccacgaattctcgttgacattcgtcatgagagttcacatcgcggcatcccctctctgcgactgctacatttggcagccattaaggcatttgattggttgaagtgtaattactgggattcccagactagtgcaattcctgatgttcgactagaactaaactcagtattgcatgacatcgctcagtcnctgaagggaaaagattctgaaaatgcaaaatcaggttccaaaaggaaacgttcccagaaacatattttaaatgccatcagatatgtacgtcgactttactatacatgtccctctgaggctgtctctgttcttttggagttttgtcagctcgatgccccagaaatctctgaaaacagcgatntacatcaatctgatagtttggatgtgaatcactcatctgatgttcaaattcagaatcaaatatcaaatggagatatgaaaaccatnataacaaaactatcagaaaaagaaccaagagtgcttcttggcttactaaagtcggtaattgaaatgattgaggccaggaacgaccttgaacacaaaggtggatcatatgtatgcctgccagctgagtcatcaacaatgaaaaacttgtgctccctggttctatggattgtcacaagcataaaagagttaaaggattcnggccgtattggacttgtccangagataggagtactctcttcggacaggaatgcggtccctcgtttctgtctcgcaaaacttctgcagaagttnttgagtttgcccgntataggtgaaagatgcattgcagatgcagcactattgntgattgagatggncggcaataanaanntgaaggagaaactgaggaagcttcctttgttgtccctgcgaaggtcaccgaaagataccctccttgaatccagaatcttgtccaatggacaagaatcggttgaaagcgcaacacagaagttggaagcgttcaagttgcagttgagaaaaccagataatgcgagtttagctgaaaatggaactgagggaacgcttaacacaagcatgccagagaaacgtaataggtggtctatagcgaagtcctggaccccctgtccgctaggaatgataccttgttcatatagttcaactgctgttcttcccgtccttgatgtcattgatgatgaactgaagcatgacacagcagaacatggaagttttgagcctgatggtcagattgaaattttcgactcttattcttaccctgagcagcagttggatggtgaaggcatcctagaaatatcaagatcgccacctgaacatgggatttctgatatgccagaaatggcctctggtctcaggggtacattactggttggtggcgtgtggaaaaagctgaccgaagaagagttgctctccataaagtcaagcatgaaaattttgttgtaatattggctagttattctcccctcattagtaaaatatttctnttctgtaaacgatcaaacgttagcttttactggggcatgacaaaaccctctttaatcagttttgctcagttttttcactattttagataacagagacaattttttctttgacctgaattgagattttgttctgttatcacttaaaatgttttcagtgcgggtaaca

SEQ ID NO: 3610 - DNA, 2257 bp, Brachypodium distachyon
aggattcagcatcgggagagttcagatacttcagctgtaacgcaagagaggcctaaaaaaaattcaggatcaggaccgtccagttgcgattgtatgcttgtttggttttcagcaggttcgggcgttcggcatataggcgggctgtacaaagcaaaaacactcctctcagttgtcgtctcgctcctctgtacgcgggggattagctagggtttaacggaccgcgagagcaccatgacggccacaaccgcagcggcggaggtggatgcggaggtcaggggcatcctagagcgggtcgcggcggactccttcccaccgctccacgccgtccaccacctcctctccgtcggggtttgcgtgccatgcacctttcgcatgtttggagcattcagccatgtctgctcatgcacgtctcttacggcatcagttttgcattcatttcttgaagatcatgatgattcagcaaaaggtgggccttgctcatgtttgtcaacggatgaggcatgctgctctgtttgctttggagtattgctacccacctgccatcaagatgatggtgtagtatcgttcaatggcatttctcctatcgacagaattacttcaatggtatttcaagcagtccaaagagagagttatcaacttgatgagttttttcttgaaatttcactgcctgcagttgtagcagctaatgaacgtgccatcaggttacatatgaaagaaaaatatggcaacgaaaattggttcaaggacaaaatattttctcaacaaaccatgtcagtgaaggaagccctgagactattgttagtgccatcactcgagaagaaactggatgttaaacatggtaacaattcatttcgaattcgcttaacatatactcacgacgatgcttcacggaagctcaaaagtttattgccaaatgaccgtaatcgtaaaagaaaaacagagtcaagagaaggaactgatactagaaggaattcaacatatgaagataaccagatattaagtgaaacagattcattcatccacaagacccttgagtgtattcaagatcaggagttctgtagtttatttcagctccctcctgaaaaggtgttcaaaccttgccatcttgtaatatcctgcctaagatcgcccatatatattggtggaagatacttgaagctttcaagaaatgtgagtcagtcatgttggataattgatgatgaaagaatgggggaagcatcagttgaggagataattggagaggatgtacgtaccatctgcagaggtgatggctgcaaatttcatgctgctggaagagaagatatcgatgtacggatgcttggatctggtcgtccgtttctaattgaagtattgaatgcgcgatctattccatctgcaattgaagttgaacaaattgctgagaagattaatagctccgaaaagaaatatgtcagagttaggaatctgaagttggtagaccgtgaaatatggtccatgatgcgggaaggagaagcggagaagcagaagcagtatgccgccctcatatggacttctagatctctgacggatgttgacctgcagaaaatttcgggtgttaatgatatggaaattgtgcaaaataccccgataagggttcttcatcgaagaagcccattagagcggaaacggataatacattggatggagattgagaaagttgagggaagctccaattactatttgttgcatctatgcactcaggctggaacatacattaaggagtttgtgcacggcgatcttggacgcacacatcctagtattggtgccatattaggttgcagagccgagatactgcaactcgatgtcactgacgttaagatggacttactgcagtagtatgcagtagtatgctgctgctacattatatcattcgccacaactactgtttgtagagaaggcgtactgataaaccaagattcttgcagaagaagtgctctgatagaaagtgcgcgaaggatgattaattactctcctcatcgagcgtgtaaagtatgtcaattggaaaatgtagaccaaggcaaagagcagcaattttgagaacaaaaactgaggaattaatccattcaactccaatgcaaccttattttcgttcgttaactttgcagtctcgtcacagatgtagcttgtgatctcgcctaaaacaggttagttttgaagctgacggccagtgtccaatctatgcctccattttggtttattatgctttgtttccgacgtgttgtattattaaacatcaaca

SEQ ID NO: 3611 - DNA, 1783 bp, Triticum aestivum
ggagggaaaccgccaaaccctccaaaatatgccgccctcccgggagcagcccgccgccgccgccgccgatggcggcgtcgaggagaatgtgatggccatcctcgactctttcgtcggcatcaaggattcccgtgacctccacgacgaccgagccgcttttttggaggccgtgcgctccgtctgcctggccggcgacaaaccctcgacccccactgagagaatgtacgatgctgtctttcagatctttcaaagcagcagctctttggagctaaccattgcaagtttccatctcttaatggagctgggcaagcaatatccaagagtatatttgacaaattctggttcccatccaactctagttatagttaaagagtcatggtcaccatttctccttggcaacaatgtagcttctggtgagcttgggagaaacaccagtcgctcagatcacctctttgattctttgagattttctttgttgaccgaagctatggttgaagcatcgaatgacacaggtgctaataatgggcttaagcatatagagaacatggtgctgttccaatatctcgttcgcacacttgaggctgattttgtacctcgtcatattgcatataaagagtcattagactgggtgattatcagggaatctgttttaagcgtgcttctgggatcgcgaaaactggtattcaaaatgtttgtcaagaactgcatatcccttctgaaccaacatcagcgggaagttgaagatgacatatcttctaaatcagcatctgatttagattcttccttaaccttttcattgcttgagtttgaaagagaagcgcttatatccgtgaaaaaacttttcattatggttataaaccttgacttgattaggaaagaagcagacaaattgggcctgacttcaagggctgatggcctcaggaatcctatcctggaagttattctagaggagctaacttacaacacaatctacttatccccatttcttttggccttcacggagtggaagtggaaattgcagattatcctgcagtacttctcaagatatcaagttaagtctgcagtccgtactcggaggtcagataactctcaacaagatttgacagtggaaagcgctctgagtatgttttcaacagaagcaagcgcaaaggccatggttaagatgatgtgtccagaagttgctcagcttctcttagcacatgcataccaggtctgcctatccgttgatggtgattctagcgaagctaatgatgcagcaaaaatgatgggagcgtctcttctcgagatatcttgcaagtttgtgttggctttccagaatctgagaaaaatcaacacgaacattcagatttcacagtttgagaaagaagctttgttcactgcagcaacgctgacaagaaaactgcagaacgagtgaagattggagacttggaagtattcattttggattttggagacttggaagcgatgggatcaaatggtttatcttaagagaacgatggatctttgtctcgtctattgcacggcaaagtatgttacctgtgtatatatatttcggttatctatttcctctgtagtagagtatccgaccctgacgtaaagaactgaagcatctgggttgctcatctcggggcagatatcaaattcacttggttttctgctcggcaaatatgtactagagaatgctggtttcgtcttagatggtaaccaagcaaaccagcccgggtgtactagaagaggctgaaatctagggccttgttgttagccctgagagcaaggctaatct

SEQ ID NO: 3612 - DNA, 3884 bp, Oryza sativa
gctagggtttgggggtttggagctctcgcggcggccattggagagggaggggggaggcgcaaaccctagctgccaccgtccctgaggcctcgccatggaggtggacccgccgccgcctccgccgccgccgatggcgaactacttcgacccggagtcgtccggccgccgggaggagtaccgccgctacagaaagagattatcttcttcaaatgcctctccactgttgggtactgcggtctccaaattttcagaagcaaggctgttctgtgatggaaacagcatacagaggcggcccaatgctggtctactccttgaagatatcaagcaggaggctgctgatatttctgattttgatagcctggatgaatctaagctgtttggatcaggaaaaaaaagggcatcattggatgcctcagatgcaggtttcagttcaggtaggcaggcagtgcggtcggcattgaaatcagtcaaactggaggaggatatgccacatgaaggagaaacaacttctacaatttttgcatccctccttgattctgcaatccaaggattgatgcccttctcggatgtgattttacaatttgagaggacatgtcgaaatgcttcagagtcgataaggtccgctgggacaggaaagcttcggatggtggaggatagacttatgcagcaaaaagcgcaattgttactggatgaggctgcttcttggtcacttctttggtacctctatgggaaaggaaatgaggagcttcctggagagctatttgtggcaccgactacttcccatcaagaagcttgccgctttgttgtaacagaccttacggcacagttatgtctacggattgtactttggcttgagggtcttgcttctgaagctcttgatttggagaaaaaggtgagaggatctcatgttggttcatacctaccaagttctggtgtttggcatcgtacacaaaggtacataaagagaaagaacaatgatactactatagtgaagcatgtggattttgatgctccaactcgtgaaggagcccaacttcttcctgatgacaagaagcaagatgaattgcttttagaggatatctggactctcttgagagcaggaaggttagaagaggcatctgaactgtgtcggtctgctggtcagtcatggagagctgcaactctttgcccctttggtggcatagatttgtttccttccttggaggccatgctgaagaatggaaagtctagaacactgcaagcgattgaattggaaagtggtgttggacggcagttatgtctttggaaatgggcttcatattgtgcttcagagaaaattgctgaacaagatggtggccgatatgagatggcagtatatgctttacaatgcagtaacttaaagcgtatcttgccgatctgtactgactgggagtcagcttgttgggcaatgacaaaatcctggttaggtgttcaagtggatctagtattgtctcagtaccaaaccagtagaccagaagagaaacagtttgatgacgagatgaatggaacccaacctatgttgaactcagctggcccagaaagttggccacacagtgttcttgatcagcaaccccgtgatatatctgcgcttctgcagaaactccactcgagcgaccttgtccatgaaactgtttctcgagcatgccgggagcagcatagacaaatcgagatgaatctcatgagtggaaatatagctcatcttcttgatcttttatggtcatgggtgtcaccgtctgaagacgaccaaaacatattgaggccccgtgatgaccctgatatgatacgcttcggagcacatattgttcttgttctgagataccttttcagcgacgaaatggaagatgagtttgaggaaaagctagttgctgttggtgatctcatcatcaacatgtatgtgaggtacttgttttcagagcagcaagaggaattggttggagtatatgcttctcagcttgagcgtgacctttgcattgagttgtttgttgaaatgatggaactaagattaaatagcagcttgcataccatgttcaagctcttcctgtctgctgtggagtatttgccattctcatctggagatgcatccaaggcttctcttgaagagatcattgagagggttctttcaagatcccgcgaaccgaaacccattaagtatgacgaagatatttttgatgttgcggaaatgcatcacttacaagcactccagaaagcaacggtcattcagtggctttgcttcacaccgccatcctcgattccagattttcagatgatcagtggaaagcttctgatacgggcactgatgcacagcaacacactattcagagagttttccctgatatcaatgaggagagttcctgagctaccagtaggaccacacaagttgcttgccatcctggctgaaccattgaaacaaaaagaaaatttaatttcactcgaagatcctgaggtatctgataatttacgggagtttgaagattggcatgaatattactccctggatgctacttaccggagttggcttaaatttgagatggagaatgcgtctatttctcctgaaatgctttcagcagaagaaaagagtcaagctgttgctgcagcgaaagaaacgctggagttagcattcttattattatacagggaagatattccatggttaaatgctgtcgagagtagtccaatcgagccctcagaacatgtttttcttgagttacatgcaactgcaatactctgcctaccttctggggagtgcatgctgccagatgcaacatcatgcacagctttgacaagtgcattgtactctactgttagtgaaacggaagtgttgcatcgtcaattgaaggtggatgtgaatgtttcatctaaagatccttgctgtattcaagtttctctcctctgcctagcagtagaaggtgatggtttggggcttcatgaagccaatgatggaggtcttcttgctgcaattatggctgctgggttcaaaggtgaactcaatcgatttcaacctggagtttcaattgaaatatcacggcttgatgcttggtattctgatggtcatggttcagtagaaagcactgctgcatacataattcgtgggctttgtcgtagatgctgcctgccagaaactattctacgatctatgcaggcatccatcgctctatctgaagcaggtgattctctagatcattgtgataagctcattgagttggttgcttcatcggaatctggaataatgcatttgttcagccaacagcagttgcaggaattcctgctttttgagagagaatgctacctatctaaaatggagcttgaggaagagcagttagagcagttacctgctgatggctaaaaggatgtgtatacctgtgatgggtgtatccaccagctgtccaaatctagtttgcaaacatggcgtaccccaccgtgtggttaggtatcacttgtaatccattcacgaaagaaatagaaagtaccagctgtaagtaactgtgttgttcatgctccatcagaagagttgaaaacaaatgtaaaaaggttatctggttgtcaaactcaatatctattgatctcagccttttattttcactatatttcttttgcactgtttgaaagactgaactggctgatagcagcagcaaatgaacttgaattctattacagagcagaaaagactcaaaccggtaaatggctttcaacaagtgcatggaccgacaaaaaagtgtcagggcttctgttttccctttggcacctatgtgctactattcattgaggcctgaatctcctccagagttttgccttttgtctctggcacgatcttcacaatgaaaaggatggccactgcgcaaactaatgcgaaaaggaagaatgtccct

SEQ ID NO: 3613 - DNA, 3939 bp, Sorghum bicolor
ttcgttcgagctctcgcggcgcgcagtcactgactccggcgaggcgggcgagggaccaaaaccctagctgaaccctcccgagtcccgacccgcgcagcagcctgcagccgcgtccatggaggtggacccctcgccttcgccgcgctcgtccaggccgctgccgcctccgccgctggcaccgacgccgagctacttcgacccggagtcctccggccgccgggaggagtaccgccgctacagaaagagattgtcttcttcaaatgtctctcctctgccgggaagctcactctccaagtcctctggaccaagactgttatacgatggagaaagcatcccaaggcggcctaatgctggtttactccttgaggatataaagcaggaagccgccgattattccaacatggaaagcttggatggatcgatactgtacagttcagcgaaaaggacatctcttgatggtggttctgcatcagccgcagcatacagttcgggcaggcaagcagtgaggcaggcgctgaaacccgtcaaactggaggacgatatctatgtgccgcatgaaggagaaacgtcttttacaatgtttgcaactctccttgattctgcgaaccaaggtttgatgcccgtcccagatgtaattcaacaatttgagaggacatgtcgaaatgcttctgagtcaatcagatctgctgccactggaaagcttcggatggtggacgataaacttatgcagcaaaaggcacaacttttactggacgaagctgcttcctggtcacttctttggcacctctatggcaaaggacatgaggagctttctggagagctgttggtgccgccaattacatcccatcaggaggcttgccgctttgttgcagcagaccttacagcgcaactgtgtctgcggatcatactttggcttgaaggtcttgcttctgaagctcttgatttggagaagaaggtgagaggacctcatgttggttcatacctaccaagttctggtgtttggcaccgtacacagaggtacctaaaaagaaataataatgattctactatagtgaagcatgtggattttgatgctccaactcgtgaaggagcccaacttcttcctgatgacaagaagcaagatgaattgcttctagaagatatatggactcttttaagagcaggaagattagaagaggcatctgagttgtgccgttctgctggccaggcatggagagctgccactctttgtccttttggtggcatagatatgttcccttccctggacgcattgcacaagaatggaaagtacagaacactacaagccattgaattagaaagtggtgttgggcggcagtggcgtctttggaaatgggcatcgtattgtgcttcagagaaaattgctgagcaagatggaggccgttatgagatggctgtatacgctttacagtgcagtaacttaaagcgtatcttgccaatctgtactgactgggagtcagcttgttgggcaatggcaagatcctggctagatgttcaagtggatctagaattatctcagtaccaaacaagtagaccggatgaaaagcagcttgacgatgacatgaatggagcccaaagttcagttggtccagaaagttggccataccatgttcttgatcagcaacctcgtgacttaactgctcttctgcagaaactccactcaagtgaccttgttcatgaaactgtgtctcgagcatgccgcgagcagcatcgacaaattcagatgaatctcatgagtgggcatatatctcatcttcttgaccttctatggtcatggttatcacctgctgaagagaaccatagtaatactgcaaggccccttgatgaccctgagatgatacgcttcggggcacatattgttcttgtgctgaggcaccttttcagtgatgaaatggacgatgagttggatgaaaaactggttactgttggtgatctcatcatcaacatgtacgtgaggtatttgttctcagaggatcaagaggagttggttggagtatatgcctctcagcttcaacatgacctttgcattaatttgtttgtggaaatgatggaactaaggttaaatagcagtttgcatactatgtacaagctcttcctttctgctgtggagtatcttccattctcatctgatgatgcatccaaggcttgttttgaagagatcattgagagagtgctttcaagatctcgacaaacaaaacccagtaagtatgatgaggatttctctgatgttgcacatcaacatcatctgcaatcacttcaaaaggcaatggttattcagtggctttgcttcacaccaccatcctcgattccagactttcaaatgatcactgggaagcttctgatacgggcattggtgcatagcaatacactgttcagggagttttccctgatatcaatgaggagagtccctgagctaccagcagggccacacaagttgcttgccattttagctgaaccgttaaagcaaaaagaaaatttaatttcactggaagatccggaggtatctgataacttactggagtttgaagattggcatgaatattactcccttgatgcaacttaccgcagttggcttaaaattgagatgaagaatgctgctgtttctcctgagatgctttcggcagaggaaaaggatcaagctgttgctgcagcgaaagaaacactggacttggcattcttgttactatgcagggatgaaagaccatggttgtatgctgtcgagagcagtccatttgaatcctcagaggttattttccttgagctgcatgcttctgcaatgctctgcctaccttctggagaatgtatgttaccagatgcaacatcatgcacagctttgacaagtgcactatattcaactgttagtgaagatgatgtgctgcatcgccagttgaaggtggatgtccaggtgtcttctagagatccatgctgtattgaagttgctcttcgctgcttagcggcagaaggtgatggatatgggcttcatgaagccaacaatggtggtcttcttgccgcagtcatggctgctggctttaaaggtgaactcagtcgattccaacctggagtttcaatggcaatttcacggcttgatgcttggtattctgatgggagtggctctgtggagagcactgctgcttacataattcgagggctgtgtcggagatgctgccttcctgaaacaattctaagatctatgcaggcatgtattgcactctccgcagctggcgattctctagataactgtgacaaactaattgagttagttggttcagccgagtctggaatgatgcatttgttcagccagcagcagttgcaggaatttttgattttccagagggaatgtttcatatgtacaatggagcttgaggaggatcagttaccttctgatggctaagctttttgatgttctcagttgctgagtcatcacattggctattttgtccagtttgcagggaaattattaaattcagtacatgtatacatgcaaaaggctggctataatatgtacggcacaatgctgtgtgtggtttcaggggattttaggattcagtcgccaccttttcttttgcttatgaatgcaaatcatttgcactaatccatgagtcatgaccggcatacttcaatccattatgacgtcaagactgaagaacctgctgtgactgatgtattgccacaccattttgtaacggaaacggaatgatgaaatttggtgtgtataggtgtccactgtgtaacattatatgtattgtaatgtcatatccctttactgtggttctgcacgattgtgcacgagaatggaccagctggtaacagcagccgagaattggcccgtttcagtccccttgtgtatgtgtacaagcacagatacacatgttggaaaatctatataagatgcaactcgaaatccaagattttgttcatgat

SEQ ID NO: 3614 - DNA, 827 bp, Triticum aestivum
aagaaagatcatcgagcttccaatccaggtcttcactcatcaccggtgcaatacgtgcgcgagtacaaaaccgcacagacatgtcgacggtggaggaggagctgtccgagtgcgaggtgctgtggccggagacgcgccacggcgctccggggagcgcgtgggggccatcgacggcggctcccagggcctccagggcccgccggcagtgctctgcgccggtggacattcccagggccgcgcacctgtccggcgggcgcgctggcctggacgacgacgaggaggaggaggaggacggcgccatggtgccgccgcacctgatggtgtcgcgcaggtggtcggaggggaaggcggcggcggccttctcgctgcggtccgggcccgggcgcgcgcaccgggacctcaaccacctgcgcaactccgtgctgcggatgaccggcttcatcgaagggtgacggacgaggcggacccgtcatctgtgcatatgtgcgagaaaagtcagtcaccacgcgtcttcccgacggtgttggccggtcaattttgttcggctcatcttccccgtggttgccaatcaaattaattaatttgcatccgttggttgatgcaaatcggccagtagtgagttaggatttttttttgggaatggaatagtatacatttttctgaataatctacgactgtactactccctccgtccgaaaatacttgttatcaaaatgaacaaaaaacgatgtatttaagaactaaaatacatttaagatacatcctcttttaatcaattttaaatgaaaactattcccaagacaaagggagtatgagatcctcccagg

SEQ ID NO: 3615 - DNA, 835 bp, Triticum aestivum
  misc_feature (622)..(622): n is a, c, g, or t
  misc_feature (651)..(651): n is a, c, g, or t
  misc_feature (665)..(665): n is a, c, g, or t
  misc_feature (679)..(679): n is a, c, g, or t
  misc_feature (798)..(798): n is a, c, g, or t
cagaaaagaaagatcatcgagcttccaatccaggtcttcactcatcaccggtgcaatacgtgcgcgagtacaaaaccgcacagacatgtcgacggtggaggaggagctgtccgagtgcgaggtgctgtggccggagacgcgccacggcgctccggggagcgcgtgggggccatcgacggcggctcccagggcctccagggcccgccggcagtgctctgcgccggtggacattcccagggccgcgcacctgtccggcgggcgcgctggcctggacgacgacgaggaggaggaggaggacggcgccatggtgccgccgcacctgatggtgtcgcgcaggtggtcggaggggaaggcggcggcggccttctcgctgcggtccgggcccgggcgcgcgcaccgggacctcaaccacctgcgcaactccgtgctgcggatgaccggcttcatcgaagggtgacggacgaggcggacccgtcatctgtgcatatgtgcgagaaaagtcagtcaccacgcgtcttcccgacggtgttggccggtcaattttgttcggctcatcttccccgtggttgccaatcaaattaattaatttgcatccgttggttgatgcaaatcggccagtagngagttaggatttttttttgggaatggaanagtatacatttttnctgaataatctacnactgtactactccctccgtccgaaaatacttgttatcaaaaatgaacaaaaaacgatgttatttaagaactaaaatacatttaagatacatcctcttttaatcaattttaaatgaaaantattcccaagacaaagggagtatgagatcctcccagg

SEQ ID NO: 3616 - DNA, 720 bp, Triticum aestivum
cgagcttccaatccaattcctccccagtgtaaaatacctgcgcgagcacaaaaccgcacagatatgtcgacggtggaggaggagctgtccgagtgcgaggtgctgtggccggagacgcgccacggcgctccggggagcgcgtgggggtcatcgacggcggctcccagggcctccagggaccaccggcagtgctccgcgccggtggacattcccagggccgcgcacctgcccggcgggcgcgctggcctggacgacgacgaggaggacggcgccatggtgccgccgcacctgatggtgtcgcgaaggtggtcggaggggaaggcggcggcggcgttctcgctgcggtccgggcccgggcgggcgcaccgggacctcaacaacctgcgcaactccgtgctgcggatgaccggcttcatcgaagggtgacgaggcggacccgtcatttgtgcatatgagagaaaagtcagtcaccacgcgttttctcgacggtgttggccagtcaattttgttcggctcatcttccccgtcgtcaccaatcaaattaattagtctcccttggttgatgcaaatcagccagtagtgagttaggatttattttttttcggaatgaaataagtagtgatttcacgtttgtactacgagtatgagattcttcagattaaaccgtccattttaacatccttgtccggagaagtttctgttgccgtcgcaaaaaaaaaa

SEQ ID NO: 3617 - DNA, 623 bp, Triticum aestivum
  misc_feature (593)..(593): n is a, c, g, or t
ccagaaaagaaagatcatcgagcttccaatccaagtcctcagtcctcaccagtgcaatacgtgcgcgagcacaaaaccgcacaaatatgtcgacggtggaggaggagctgtccgagtgcgaggtgctgtggccggagacgcgccacggcgctccggggagcgcgtgggggtcgtcgacggcggctcccagggcctccagggaccaccggcagtgttcagcgccggtggacataccccgtggccgtgggcgtgctggcctggacgacgacgaggaggaggaggacggcgccatggtgccgccgcacctgatggtgtcgcgcaggtggtcggaggggaaggcggcggcggcgttctcgctgcggtcggggcccgggcgggcgcaccgggacctcaacaacctgcgcaactccgtgctgcggatgaccggcttcatcgaagggtgacgtgacgaggcggacccgtcatttgtgcatatgtgagagaaaagtcagtcaccacgcgccttctccacggtgttggccagtcaattttgttcggctcgtcttctccgtgtttgccaatcaaattaattattagtatcccttggttgatgnaaatcagccagtagtgagttaggatatttt

SEQ ID NO: 3618 - DNA, 707 bp, Triticum aestivum
gaaagatcatcgagcttccaatccaagtcctcagtcctcaccagtgcaatacgtgcgcgagcacaaaaccgcacaaatatgtcgacggtggaggaggagctgtccgagtgcgaggtgctgtggccggagacgcgccacggcgctccggggagcgcgtgggggtcgtcgacggcggctcccagggcctccagggaccaccggcagtgttcagcgccggtggacataccccgtggccgtgggcgtgctggcctggacgacgacgaggaggaggaggacggcgccatggtgccgccgcacctgatggtgtcgcgcaggtggtcggaggggaaggcggcggcggcgttctcgctgcggtcggggcccgggcgggcgcaccgggacctcaacaacctgcgcaactccgtgctgcggatgaccggcttcatcgaagggtgacgtgacgaggcggacccgtcatttgtgcatatgtgagagaaaagtcagtcaccacgcgccttctccacggtgttggccagtcaattttgttcggctcgtcttctccgtgtttgccaatcaaattaattattagtatcccttggttgatgcaaatcagccagtagtgagttaggatattttatttttcttttcggaatggaataagctacgtttgtactgctatgagattcttcagattgaccgcgtccattttttccaaaaaattacaaagg

SEQ ID NO: 3619 - DNA, 1864 bp, Hordeum vulgare
cacctcgcgcggcgcctggcggaggtcggcgcgcgcgacgtcttcaccgtgccgggggacttcaacctgacgctcctcgacgagctcgaggcggagcacccgtccggcggcggggtgcggctcgtcaggtgctgcaacgagctcaacgccgcctacgccgccgacgggtacgcccgcgcgcgcgccgtgggggtcagcgcctgcgcagtcaccttcaccgtcggagggctcatcgccatcaacgccgtcgccggcgccttgagcgagaacctccccgtcatctgcatcgtaggtggccccaacagcaacgactacggcagcaaccggatcctccaccacaccattggcattcccaatttcacgcaggagctccgttgcttccagaacgtcacctgctaccaggcattggggaacaacttggaggatgcacatgaacagattgacactgccatttccactgcactgaaggagagcaagccagtttacatcagcatcagctgcaacctcccctcgatcccgcatcctacctttagccgccatcctgtccctttctttctctccccaaaactgtcaaaccagatgaacctggaagcagcagtggagactgctgcggcttttttgaacaaatcagtcaagcctgtccttgttggcggaccgaagatgagggtggccaaagcatgtgaagctttcgtagagctggctgatgcatgcggttatccggttgcagtgatgccttctgcaaaggggcttgtgccagagcaccattctagatttattggcacatattggggtgctgtgagcactccattctgtgctgagattgtggagtcagctgatgcctatttgtttgctggcccgatatttaatgactacagctcggttgggtactcacttcttctcaagaaggagaaggccatcatcgtccagcctgaccgagtagtgattgggaatgggcctgcatttgggtgtgttctgatgaaggacttcctgcatgcacttgcaacccggctgaagaagaacacagctgcctacgacaactatagtcggatttttgtgcctcagggcgaacccctttcctctgagcatggagagcctttgagagtgaatgtacttttcaagcatattcagaaaatgttgtctggcagctcagctgttatagcagagactggggactcatggtttaactgccagaagctgaaactgccggaaggctgtgggtatgaatttcagatgcaatatggatcaattggttggtcagtgggtgcaactctgggatatgcgcaggctgccaaggataagcgagtcatttccttcattggagatggcagctttcaggtgacggcgcaagaagtgtcgacgatgctccggtggggacagaacaacataatcttcctgataaacaacggtgggtacaccatcgaggtggagatccatgacggcccttataacatcatcaagaattggaactacactggcgtggtggaggcattccataatggcgagggcaagtgctatacagccaaggtccgaacagaggaggaactgaagaaggcaattgaggcatccctaggacctaacaaggacagcctgtgctttatagaggtaattgtgcacaaggatgatactagtaaggagcttcttgagtggggttctagggtttccgctgcgaatagccgcccaccaaatccccagtgaacacatcaggtctcgacaagatcctcaagttctgaatagatgttactgatctctgaataaatcatccatttgagtccactgttgttgcacgtgctcatggttactgtacatagatggtctcagttcacctgtacttgtatattacttcaataaatctgaaatcgatgtc

SEQ ID NO: 3620 - DNA, 2312 bp, Oryza sativa
caactgtccgacacgccgagaagaaaaaaaaaagaaaaaaaagcaacgaaccaacttttctcccaaggaaacttctccacttctctcctcgcttccgccgcctcctccgccgccgccgacatggacaccacgatcggctcggtgccgacggcctccgatgcggcggcgcctgcccccgcggcgaactccgcgccgagggaggccacgctggggcggcacctcgcgcggcggctggcggaggtcggggcgcgcgacgtgttcacggtgccgggggacttcaacctcacgctgctcgacgagctcgaggcggaggcgggggcggggcacggcggggtgcggctcgtcgggtgctgcaacgagctcaacgcggcgtacgccgccgacgggtacgcccgcgcgcgcggcggcggggtcggggcgtgcgccgtcacgttcaccgtcggtggcctcagcgccatcaacgccgtcgccggcgcgttcagcgagaacctccccgtggtgtgcatcgttgggggccccaacagcaacgactacgggagcaaccgcatcctgcatcacaccatcgggctgcctgatttcacgcaggagctcaggtgcttccagactgtcacttgctatcaggcggtggtgaacaacttggaggatgcacatgagcagattgatgctgccatctccactgcaataaaggagagcaagcctgtttacataagcatcagctgcaacctcccctctatcccacatcccacctttagccgccaccctgttcctttcttcctgtccccaagattatcaaaccagatgaacctggaggcagcagtggaaactgctgcagctttcctgaacaaagcagtcaagccagtcctcgttggtggaccaaaaatgagggtggccaaagcatgcaaatccttcgtagagctggctgatgcctgtggttatcctgttgcggtcatgccttctgcaaagggtcttgtgccagagcaccatcctaggtttattggcacgtactggggtgctgtgagcactccattttgtgctgagatcgtcgagtcagctgatgcatatctatttgctggcccaatatttaatgactacagctcggttggatactcactacttctcaagaaggagaaggccatcatcgtccagccagaccgggtggtgataggtcatgggcctgcgtttgggtgtgttctgatgaaggacttcctgcatgcactttcagcacggctgaagaaaaacacggctgcatatgagaactatcgtcggatttatgtgcctccgggtgaacctcctttgtctgagcctggagagccattgagagtgaatgtacttttccagcatattcagaaaatgttgtcagccaactcggctgtcattgctgagactggagactcttggtttaattgccagaagctaaagctaccagagggctgtgggtacgaatttcaaatgcaatatggatcaattggttggtcggtaggtgcaactctgggatatgcaaaggctgctaaggataagcgagtcattgcttgcatcggagatggaagctttcaggtgacggcacaagaagtgtcgacaatgcttcgttgggggcagaaaagcatcatcttcctcataaacaatggagggtacaccatcgaggtggagatccatgacggtccttacaatgtcatcaagaattggaactacaccggtgtggtggaagcgttccataatggcgaggggaagtgctacacggcaaaggtccgaactgaggaggaactgaaggaagcaattgaagaagctcagggacctaagaaggattgcttgtgcttcatagaggtgattgtacacaaggatgacacaagtaaggagcttcttgagtggggctccagagtttctgctgcaaatagccgcccaccaaatcctcagtgagtacgtcagatatccgacttgccatgttttgattaggaaaatgtgaatttcagtggtcttcgaataagttgcgcatgtaattagccgctgttgtaagtgttgtaagtggttagaaatgatttcagactctcatacctgtattattgtcaataaatctgaaatcgatttttggttgcccttccatgttccaactgactgactttgcattgtacatgggatctagttgttctggagagtcaggaacaggtttgaggcttcccttgattgtcaaccaatgagaacagcatctctcattaaaaaaacaggctaaacgaatagatcaatttctgtttgagaaaaaatggttccatgaagttcaaacttgaatgtttcaataagattaagtatttgttttttcc

SEQ ID NO: 3621 - DNA, 2259 bp, Zea mays
ccttctagcaggctcgctgagacgctgacacgcccagccccacgcagttccacccatagattttgtttctttgcgacacagctccaccgtaaaatgccacgggcacgacttccactggactccaacgctccaacccacccgacaaccatcctagtatacacgccaagtcgccagccagcatttcctcccgaaccatccttccactccctcgccgaccctccccccgcgcccgccatggacacggcgatcggctccgtcccggcagcctccgacgcggcgcgtcacccagcgccgtccgcgtccgccccgcgcgacgcgacgctgggccggcacctggcgcggcgcctggcggaggtgggcgcccgggacgtgttcacggtgccgggggacttcaacctcacgctcctcgacgagctggaggccgagccgggcggcgtccgcctcgtcggctgctgcaacgagctcaacgcggcgtacgcggccgacgggtacgcccgcgcgcgcgccggcggggtcggcgcctgcgccgtcaccttcaccgtcggcggcctcagcgccatcaacggcgtcgccggcgccttcagcgagaacctccccgtcgtgtgcatcgtcggcggacccaacagcaacgactacgggagtaacaggatcctgcaccataccatcggcttgcctgatttcacgcaggagctcaggtgcttccagaacgtcacgtgctatcaggctgtggtgaacaacttggaagatgcgcatgagcagatcgacactgccatctccacggcaatcaaggagagcaagcctgtttacattagcatcagctgcaacctcccttcgatcccacatcccaccttcagccgccatcccgtccctttcttcctctccccaaggctatcgaaccagatgaacctggaggctgcagtggaagccgccgcggctttcttgaacaaagccgtcaagccagtgcttgtaggtgggccaaagatgagggtgtccaaagcatgggaagccttggcagagctggcagatgcctgcggctatcccgttgccgtgatgccttctgcgaaggggctagtgccagtgcaccactctaggttcattggcacgtactggggtgcggtgagcactccattctgtgctgagatcgtcgagtctgccgatgcctacctatttgctggccccgtattcaacgactacagctcggttgggtactcgctgctcctcaagaaggagaaggccatcattgtccaaccagagcgggtggtggtcgggcatggacccgcgtttgggtgtgttctgatgaaggatttccttcatgcccttgcaacccgtctgaagaagaacactgtcgcgtatgagaactaccgtcgaatttatgtgcctccaggcgaaccactttcatctgaacctggcgagccgttgagagtgaacgtgctcttcaagcatattcaggcaatgctgtccggcgacatggctgtcatcgcagagactggggactcgtggtttaactgccagaagctgaagctaccggaaggatgtgggtacgaattccagatgcagtatggatcaattggctggtcagtgggcgcaactctaggatacgcacaggctgccaaggataaacgtgtcattgcctgcattggagacggcagctttcaggtgacggcacaagaagtgtcaacgatgctccggtgggggcagaacagcatcatcttcctgataaacaatggagggtacacaatcgaggtggagattcacgatggcccttataacgttatcaagaactggaactacaccggtctggtggaagcgttccacaatggcgagggcgcgtgctacacagcaaaggttcgaacagaggaggagctgacggaggcgctggaggcagctctaggacctaagaaggactgcttatgcttcatcgaggtcatcgtgcataaggatgacaccagcaaagcgcttctcgagtggggatctagggtttctgcggcgaatagccgtccacctaatcctcagtgaatacatcaggtctcccgaattgccctgtaaaccgatccgctttctggtgacgcccataacaagaagtctcggcgatgacatgctgccgatttctgaataaattgtccctgtaattcactgatgttgcaagtccttgttgtaaaactagagagccgcttggaggaatcatggacagtctaaactcgggtctgagtatatacaagctgattgagtcctagataaatacaatatggacttaaacta

SEQ ID NO: 3622 - DNA, 2048 bp, Brachypodium distachyon
ccgccgccatggacgccaaaatcggctccatcccgcccccaacggccgccgcctccaccacggccgccgcctcgccgcgggaggccacgctgggccggcacctggcgcggcgcctggccgaagtcggcgcccgcgacgtcttcaccgtgcccggcgacttcaacctcaccctgctcgacgagctagaggccgacggccccgagaacggggtgcggcttatcgggtgctgcaacgagctcaacgcggcctacgccgcggacgggtacgcccgcgcgcgcgccggggccggaggggtcggggtcggggcgtgcgctgtcaccttcaccgtgggcgggctcagcgccatcaacgccgtcgcgggcgccttcagcgagaacctccccgtggtgtgcgtcgtcgggggacccaacagcaacgactacgggagtaatcggatcctgcatcataccatcggggttcccgatttcacgcaggagctccgctgcttccaaaatgtcacctgctaccaggcagtgatcaacaacttggaggatgcacacgagcaaattgacactgccatctccaccgcagtgaaggagagcaagcctgtctacatcagcatcagctgcaacctgccctcgatcccgcatcctacctttagccgccaccctgtccctttctttctctccccaaggctgtcaaaccagatgaacctggaagcagcagtggaagccgctgcagctttcttggacaaagcagtcaagccagtccttgttggtggacctaagatgagggtggccaaagcatgcaaagcctttgtagagctggctgatgcatgcggttatcccgttgcggtgatgccttctgcaaaggggcttgtgccagagcaccacttgaggtttatcggcacatactggggtgctgtgagcactccattctgtgctgaaatcatcgagtcagctgatgcatatctgtttgctggcccaatatttaacgattacagctcagttggatactcgcttcttctcaagaaggagaaggctatctttgtccagccggaccgggtggtgattgggcatggccctgcatttgggtgtattctaatgaaggacttcctgcatgcacttgcaagcagagtgaataagaatatagctgcacatgagaactattgtcggatattcgtccctccgggcgaacctctttcatctaagcctggagagcctttgagagtgaatgtgcttttcaagcacgttcagaaaatgttgacaagcaattcaactgtgatcccagagactggtgactcatggtttaactgccagaagctgaaactaccagaaggctgtgggtacgaatttcagatgcaatatggatcaattggttggtcagtgggtgcaactctgggatatgcgcaggctgccaaggataagcgtgtccttgccttcattggagacggtagctttcaggtgacggcacaagaagtgtcgacaatgatccggtgggggcacaacaccatcatctttctcattaacaacggagggtacaccattgaggtggagatacacgacggtccttacaacatcatcaagaactggaactacaccggcgtggtggaagcattccataatggcgagggcaagtgctatacggcaaaggtccgaacggaggaggaactgaagaaggcaattgaggcatctctaggacccaaaaaggattgcctgtgcttcatagaggtaattgtacacaaggatgacactagtaaagagcttcttgagtggggctctagggtttcagccgcaaatagccgcccaccgaatcctcagtgaagcaccatcgggtctccactgggtcctcatccaccagcttgattgcatcatactggaagttctggataggagatgtcactgatctctgaataaaccgtccatgtaagttcgctgctgctgcaagggctcatggtggtcactgtacatacataacagagatgatttcagttcaggttctggtacatgtatagttgtagtattacttgcaataaatctggaagcgacttcttgttgctcagttttatt

SEQ ID NO: 3623 - DNA, 1905 bp, Pennisetum glaucum
cacggacgctccgcgggaggccacgctgggccggcacctcgcgcggcgcctggccgaggtgggcgcccgcgacgtgttcaccgtgccgggggacttcaacctcaccctcctcgacgagctggaggcggagcacgggtccacgggtgtgcggctcgtgggttgctgcaacgagctcaacgcggcgtacgcggccgacgggtacgcccgggcccgcggcggcggggtcggcgcctgcgccgtcacgttcaccgtcggcgggctcagcgccatcaacgccgtcgccggggcgttcagcgagaacctccccgtcgtgtgcatcgtcggcgggcccaacagcaacgactacgggagtaacaggatcctccaccataccattgggttgccggatttcacgcaggagctcaggtgcttccagaccgtcacgtgctatcaggctgtggtgaacaacttagaagatgcacatgaacagattgacactgccatctctacagccataaaggagagcaagcctgtttatatcagcatcagttgcaacctcccttcaatccctcatccaacctttagccgtcatcctgtccctttcttcctgtcgccaaggctatcgaaccagatgaacctggaggcagcagtagaagccgctgcggcgttcttgaacaaagctgtcaagccagtgcttgttggtggaccaaagatgagggtgtccaaagcatgcaaagcctttgtacagctggcagatgcctgcggttatcccgttgcagtgatgccttctgcaaagggtcttgtgccggagcaccactctaggtttatcggcacatactggggtgctgtgagcactccgttctgtgctgagattgttgagtctgctgatgcctatctatttgctggtcccatattcaacgactacagctcggttggatactcgctgctcctgaagaaggaaaaggccatcatggtccagccagaacgggtggtcattggacatggccctgcttttgggtgtgttctgatgaaggatttcctgcatgcactggcaacccgtctgaagaagaatactgctgcatatgagaactatcgtcgaatttatgtgcctccaggagagccaatttcttctgaacctggagaaccactgcgagtgaacatacttttcaagcatattcaagcaatgctgtctggcaactcggctatcattgcagagacaggggattcgtggtttaactgccagaagctgaagctacctgaaggctgcggatatgaatttcagatgcaatatggatcaattggctggtcagtgggtgcaactctgggatatgcccaagctgcaaaggataagcgtgtcattgcttgtattggagatggcagttttcaggtgacagcacaagaagtgtcaactatgcttcggtgggggcagaacaacattatctttctgataaacaatggaggatacaccatcgaggtggagatccatgatggcccttacaatgttatcaagaactggaactacactggtttagtggaagccttccacaatggcgagggaaagtgctacacagcaaaggttcggacagaggaggagctaaaggaggcagtgaaggcagctctgggacctaagaaggactgcttgtgcttcatagaggtaatcgtgcacaaggatgacaccagcaaagagcttctcgagtggggatcccgggtttctgcagcaaatagccgtccaccaaatcctcagtgagcacatcaggatctcctgaattgcacaggaaatggttctcattgtgtttgatgtccatatgaagaagtctcggagatgatatggaattctgttaatctctgaataaaaaatatccctgtaattcactgatgttgtaagtcctcctgtaaccttaagttctttcacagagatgatttcag

SEQ ID NO: 3624 - DNA, 2021 bp, Sorghum bicolor
tccactccctcgcctcctccgccggccccgccatggacacggcgatcggctcggtcccggcctcttccgacggcgcggcgcaggcggcgtcgggttccgccccacgcgacgcgacgctggggcggcacctggcgcggcggctggcggaggtgggcgcccgtgacgtcttcaccgtccccggggacttcaacctgacgctcctggacgagctggaggccgaggaaggggtccgcctcgtgggctgctgcaacgagctcaacgcggcgtacgcggcggacgggtacgcccgcgcgcgcggcggcggggtgggcgcctgcgccgtcaccttcaccgtcggcgggctcagcgccatcaacggcgtcgcgggcgccttcagcgagaacctccccgtcgtgtgcatcgtcggcgggcccaacagcaacgactacgggagtaacaggatcctgcatcacaccatcggattgcctgatttcacgcaggagctcaggtgcttccagaccgtcacgtgctatcaggctgtggtgaacaacttggaagatgcacatgaacagatcgacactgccatctccacggcaataaaggagagcaagcctgtttacattagcatcagctgcaacctcccttcgatcccacatcccaccttcagccgtcatcctgtccctttcttcctctccccaaggctatcgaaccatatgaacttggaggcagcagtggaagccgctgtggctttcttgaacaaagctgtcaaaccggtgcttgtaggtggaccaaagatgagggtgtccaaagcatgcaaagcctttgtagagctggcagatgcctgcggctatcctgtcgcggcgatgccttccgcaaaggggctagtgccagaacaccactctaggttcattggcacgtactggggcgctgtgagcactccattctgtgccgaaattgtcgagtctgctgatgcctacctatttgctggtcccatattcaacgactacagctcggttggatactcactgctcatcaagaaggagaaggccatcattgtccaaccagagagggtggtgatcgggcatggccctgcgtttgggtgtgttctgatgaaggatttcctgcatgccctcgcaactcgtctgaagaagaacactgctgcgtatgagaacttccgtcgcatttatgtacctcctggcgagccactcgcgtctgaacctggagagccattgagagtgaacatactcttcaagcatattcaggcaatgctgtctggcaacacggctgtcattgcagagactggggactcgtggtttaactgccagaagctgaagctaccagaaggctgtgggtacgaattccagatgcagtatggatcaattggctgggcagtgggtgcaactctaggatacgcacaggctgctaaggataaacgtgtcattgcctgcattggagatggcagcttccaggtaacggcacaagaagtgtcaacgatgctccgatgggagcagaacaccatcatatttctgataaacaatggaggatacacaatcgaggtggagattcacgatggtccttataacgttatcaagaactggaactacactggtttggtggaggcattccacaatggagagggcaagtgctacacagcaaaggttcgaactgaggaggagctgaaggaggcactgaaggcagctctgggacccaagaaggactgcttatgcttcattgaggtcatcgtgcataaggatgacaccagcagagagcttctcgagtggggatctagggtttctgcggcaaatagccgtccaccgaatcctcagtgagtgcatcaggtctcctgaattgcgctgtaaatcaatcctctttctggtgatgtccatatcaagaagactcggggatttctgatgtcatttctgaataatttctccctgtaattcactgatgttgcaagcccttatgatttcagaaactgatcttgtatagctgtattactgccaataaatctgaaatcatttttttttgttcttcgttctggc

SEQ ID NO: 3625 - DNA, 2081 bp, Saccharum officinarum
catccatcccatcctactcgccactccccacgccaaccgaagcggaaggcaaccaacttttggtcgcccgatcgcccgcacctggcactcgctcgccgccggccccgccccgccatggacacggcgatcggctcggtcccgggctcctccgatgccgcggcgtcgaccccgcgcgacgcgacgctggggcggcacctggcgcggcggctggcggaggtgggcgcgcgggacgtgttcacggtgccgggggacttcaacctcacgctcctggacgagctggaggccgaggagggggtccgcctcgtcggctgctgcaacgagctcaacgccgcctacgcggccgacgggtacgcccgcgcgcgcggcggcggggtcggcgcctgcgccgtcaccttcaccgtcggcgggctcagcgccatcaacggcgtcgcgggcgccttcagcgagaatctccctgtcgtgtgcatcgttggcgggcccaacagcaacgactacgggagtaacaggatcctgcatcataccatcggcttgtctgatttcacgcaggagctcaggtgcttccagaccgtcacgtgctatcaggctgtggtgaacaacttggaagatgcgcatgaacagatcgacactgccatctccacggcaataaaggagagcaagcctgtttacattagcatcagctgcaacctcccttcgatcccacatcccaccttcagccgtcatcctgtccctttcttcctctccccaaggctatcaaaccagatgaacctggaggtagcagtggaagccgctgtggctttcttgaacaaagctgtcaagccagtgcttgtaggtggaccaaagatgagggtgtccaaagcatgcaaagcctttgtagagctggcagatgcctgcggctatcccgtcgcggtgatgccttccgcaaaggggctagtgccagaacaccactctaggttcattggcacgtactggggcgctgtgagcactccattttgtgccgaaattgtagagtctgctgatgcctatctatttgctggtcccatattcaacgactacagctcggttggatactcattgctcatcaagaaggagaaggccgtcattgtccaaccagagagggtggtgatcgggcatggccctgcgtttgggtgtgttctgatgaaggatttcctgcacgcccttgcaacccgtctgaagaagaacactgctgcgtatgagaactttcggcgcatttatgtacctccgggcgagccactctcatctggacctgaggagccattgagagtgaacatactcttcaagcatattcaggcaatgctgtctggcaacacggctatcattgcagagactggggactcgtggtttaactgccagaagctgaagctaccagaaggctgtgggtacgaattccagatgcagtatggatcaattggctgggcagtgggtgcaactctaggatacgcacaggctgctaaggataaacgtgtcattgcctgcattggagatggcagctttcaggtgacggcacaagaagtgtcaacgatgctccgatgggggcagaacaccatcatctttctgataaacaatggagggtacacaatcgaggtggagattcatgatggtccttataacgttatcaagaactggaactacactggtttggtggaggcattccacaatggcgagggcaagtgctacacagcaaaggttcgaactgaggaggagctgaaggaggcactgaaggcagctctgggacctaagaaggattgcttatgcttcattgaggtcatcgtgcataaggatgacaccagcaaagagcttctcgagtggggatctagggtttctgcggcaaatagccgtccaccgaatcctcagtgagtgcaccagctctcctgaattccactgtaaatcggttctctttctggtgatgttcatatcaataagtctcggggaggacctgctgtcgatttctgaataaactatccctgtaattcactgatgttgcgagtccagacgatttcagaaactgatcttgtatagttgtatttctgccaataaatatgaaatcaaattttgttgttctt

SEQ ID NO: 3626 - DNA, 1835 bp, Triticum aestivum
tgcggctcgtggggtgctgcaacgagctcaacgccgcctacgccgccgacggctacgcccgcgcgcgcgacggcggggtcggcgcctgcgcggtcaccttcaccgtcggcgggctcagcgccatcaacgccgtcgccggcgccttcagcgagaacctccccgtcatctgcatcgtcgggggccccaacagcaacgactacggcagcaaccggatcctccaccacaccatcggcatccccgatttcacgcaggaactccgctgcttccagaacgtcacctgttatcaggctgtggtgaacaacttggaggatgcacatgaacagattgacactgccatttccactgcactgaaggagagcaagcctgtttacatcagcatcagctgcaacctcccatcgatcccgcatcctacctttagccgccatcctgtccctttctttctctccccaaaactgtcaaaccagatgaccttggaagcagcagtggagaccgctgcggcttttctgaacaaatcagtcaagccggttcttgttggcggaccaaagatgagggtggccaaagcatgcgaggccttcgtagagctggctgatgcatgcggttatccggttgcagtgatgccttctgcaaaggggcttgtgccagagcaccattctagatttatcggcacatactggggtgctgtgagcactccattctgcgctgagattgtggagtcagctgatgcctatttgtttgctggcccgatatttaatgactacagctcggttgggtactcgcttcttctcaagaaggagaaggccatcattgtccagccggaccgagtcgtgattgggaatgggcctgcatttgggtgtgttctgatgaaggacttcctgcatgcacttgcaacccggctgaagaagaacacagctgcctacgacaactacagtcggatttttgtgcctcagggcgaacccctttcctctgagcctggagagcctttgagagtgaatatactttttaagcatattcagaaaatgttgtctggcagctcagctgttatagcagagactggggactcatggtttaactgtcagaagctgaaactaccagaaggctgtgggtatgaatttcagatgcaatatggatcaattggttgggctgtgggtgcaactctgggatatgcgcaggctgctaagggtaagcgagtcatttccttcattggagatggcagctttcaggtgacggcacaagaagtgtcgacgatgctccggtgggaacagaacaacatcatctttctcataaacaacgggggttacaccattgaggtggagatccatgacggcccttacaacgtcatcaagaattggaactacaccggcgtggtggaagcattccataatggcgagggcaagtgctatacggccaaggtccgaacagaggaggaactgaagaaggcaattgaggcatccctaggacccaacaaggacagcctgtgctttatagaggtaattgtgcacaaggatgacactagtaaagagcttcttgagtggggttctagggtttccgccgcgaatagccgcccaccaaatccccagtgacacatcaggtctccacaagatcctcatccagcttaatgatgtcatgtggaagttctgaatagatgttactgttctctgaataaatcatccatttgagtccattgctgttgcaagtgctcatggttactgtacatagatggtcttagttcaggaacctgtgcttgtatattacttcaataaatctgaaatcgatgtcgtagccagctaaagacgctcttgattttggcatctttcttgattttgacaacagtttca

SEQ ID NO: 3627 - DNA, 2580 bp, Eucalyptus grandis
ctccaaaaagaccaacaaaattcaatcatgattactcttccgccttattcaccggtaattgccaacaccttttctctctctctctctctctccacagctaggccgcccattgtattttctccctctctctctctctctctctctctctctctctctcgttggcatatataaagactgcatttttttaaccattcttccacgcacaaacccacaaaaaactccagaagcaccccgccagcctccattgccactcctcgcttcaccttctccttctccttctccctccatctccccctcctcctcctcctccccctccgccacctccgccgccgctcctccgccgccgccatggacaccggcatcggatcgctcagctcatgcaagcccccctgcaacgacgtcgggtccccccccaacggcgccgccgcggccatccagggctcgggccccgcgcccgcggtggtcgcctcccccgactccaccatgggccgccacatcgcccaccggctcgtccagatcggcgtcaccgacgtcttcgccgtccccggcgacttcaacctcacgctcctcgaccacctcatcgccgagccggggctcaacctcgtcggctgctgcaacgagctcaacgccgggtacgccgccgacggctacgcccgcgcccgcggcgtcggggcctgcgtcgtgacgttcaccgtcggcgggctcagcgtgctcaacgccatcgccggggcctacagcgagaacctgccggtggtctgcatcgtcggcgggcccaactccaacgactacgggacgaacagggtacttcaccataccatcgggttgcctgatttcagccaagagcttcggtgttttcagactgttacttgcttccaggctgtggtgaataatttggaagatgcacatgaactgatcgataccgcgatctcgactgcccttaaagaaagcaagcccgtttacataagcataagctgcaacttgcctgccatacctcaccccactttcagtcgtgagccggttccatttgcactctctcccaaattgactaatcagatgggattggaagctgcggtagaggcagctgcagagttcttgaacaaggcagtgaagccggtaatggtgggtggcccgaaactccgggttgcaaaggcttctgaagccttcgtagaactagctgatgcatgcggctatgctgtagctgtgatgccatcggcaaaagggcaagtgcccgagcaccatccccgcttcatcgggacttactggggtgcggtgagcactgcattctgtgccgagatcgtggaatctgcagatgcctatatatttgctggccccattttcaatgactacagctccgttgggtattccctccttctcaagaaggagaaggccattattttgcagcctgagagggttgtgatcggtaatggtcctgctttcggttgtgttctgatgaaggattttcttaaagcgctctcgaagcgggtcaagcggaacacaactgcttatgagaattatcacaggatttttgttccagacggccatccattgaagtgtgaacccaaggagcccttgagggtcaatgtcctgttcaagcacatacaggacatgctctctagtgaatcagctgtgattgctgagactggagactcttggttcaactgccagaagctgaaactaccacaaggctgtgggtatgagttccaaatgcagtatggatctattggatggtccgtcggtgcaaccctcgggtatgcacaggctgtgccagagaagagagtcattgcatgcattggagatggtagcttccaggtaactgcccaagatgtgtcaactatgctgcgatgtgggcagaacaccatcatcttcctgataaacaatggcggctacaccattgaagttgagatccatgatggcccctacaatgtgatcaagaattggaactacactggcctggtggaagcaattcacaatggcgagggcaagtgctggaccacaaaagttttctatgaggaggagcttattgaagcgatccagacggcgacagggcccaagaaagatagcttgtgcttcatagaggtgatagttcacaaggacgacaccagcaaagagcttctggagtggggctcccgggtctcagccgccaatagtcgccctcctaatcctcagtagaagccttgattcttatcactttgtttgcttgaagtacttgttgtgtacattaaaacacagcatcatcttgagtattgccgatccctacgatgatttcttagttttgtgcaatgaaaacaatcacgtctcctggttttggtatttaataatatttgttgactgtccgtgtcctgtccacatcctaaacatgtggtaggagcaactgcgaacgcgtaggttaggtttgtttggcttggcgtgggggacctcaagtctatctttgtttaggccaatagaccctccaagttgtcgacttttggaacatgtgaaatgaataggactctgattgccttgatctcctgaatcatcgcagcgtgatccaccgtcttctaaccaaccttcaaagttaagctctccttgttccccgggcgt

SEQ ID NO: 3628 - DNA, 2096 bp, Eucalyptus grandis
acgcacaaacacacaaaaaaaaaactccaaaagcgccccgccagcctccattgccactcctcgcttcaccttctccctccacctcctcctccgccgccgccgccgccatggacaccagcatcggagcgctcagctcatgcaagcccccctgcaacgacgtcgggtcgccccccaacggcgccgcctcggccatccagggctcggcccccgggcccgccgcggtcggctcccccgactccaccatgggccgccacctcgcccgccggctcgtccagatcggcgtcaccgacgtcttctccgtccccggcgacttcaacctcacgctcctcgaccacctcatcgccgagccggggctcaacctcgtcggctgctgcaacgagctcaacgccgggtacgccgccgacggctacgcccgcgcccggggcgtcggggcctgcgtcgtgacgttcaccgtcggcgggctcagcgtgctcaacgccatcgccggggcctacagcgagaacctgccggtggtctgcatcgtcggcgggcccaactccaacgactacgggacgaacagggtgcttcaccataccatcgggttgcctgatttcagccaagagcttcggtgttttcagactgttacttgctttcaggccgtggtaaataacttggaagatgcacatgaactgatcgatactgcaatctcgactgctctgaaagaaagcaagccagtttacataagcataggctgcaacttgcctgccatacctcacccgactttcagtcgcgaaccggttccatttgcactctctcccaaattgactaatcagatgggattagaagctgcagtagaggcagctgcagagttcttgaacaaggcagtaaagccggtaatggtgggcggcccaaaactccgggttgcaaaggcttgtgaagccttcgtagaactagttgatgcatgtggctgtgctgtagctgtgatgccatcggcaaaggggctcgtgcccgagcaccatccccacttccttgggacttactggggtgcggtgagcactgcattctgcaccgagatcgtggaatccgcagatgcctacttatttgctgggcccatcttcaatgactacagctccgttggttattccctccttctcaagaaggagaaggccattattttgcagcctgatagggttgtgattggaaatggacccgcttttggttgtgttctgatgaaggattttcttaaagcactctcgaagcgggtcaagcggaataccactgcttatgagaattatcacaggatttttgttccggagggccatccattgaagtgtgaacccaaggagcccttgagggtgaatgtcctcttcgagcacatacaggacatgctctctagtgaatcagctgtgattgctgagactggagactcttggttcaactgccagaagctaaaattaccaagaggctgcgggtatgagttccaaatgcagtatggatccattggatggtctgttggtgcaacacttgggtatgcacaggcagtgccagagaagagaatcattgcatgcattggagatggtagcttccaggtaaccgcccaagacgtgtcaactatgctgcgatgtgggcagaacaccatcatcttcctgataaacaacggcggctacaccatcgaagtcgagatccatgatggtccctacaatgtgatcaagaactggaactacactggcctggtggaagcaattcacaatggcgagggcaagtgctggacagcaaaagttttctacgaggaggagcttatcaaagcgattaagacggcgacagggcccaagaaggattgcttgtgcttcatagaggtgatagttcacaaggacgacactagcaaagagcttctggaatggggttcccgggtttcggccgccaatagtcgccctcccaatcctcagtagaagccttgattctcataaaaacagagcatcttctcgagtattgttgatgctctgtgaaatgaaaataatctttgtgaaaggaaaactgatgatcacattattctgtaaaggtcaatttatattactttagtaatcagcaataaattaagcgctgggtttttaaagatc

SEQ ID NO: 3629 - DNA, 1909 bp, Silene vulgaris
cgtatccacatggtccaacaaccctactagccgcaccagaagccaccttaggccgccacctggcacgccgactagtccaaatcggcgtatccgacgtcttctcagtccccggcgacttcaacctaaccctcctagaccatctcttagccgaaccgggtttaaacctagtcgggtgctgtaacgaactcaacgccggttacgcagctgacgggtatgctaggtcacgtggtgttggcgcgtgcgttgttactttcactgttggtggtttgagtgtgttgaatgctattgctggtgcttatagtgagaatcttcctgttgtttgtattgttggtgggcccaattctaatgattatgggactaatagggttttgcatcatactattggcttgcctgatttttctcaggagttgcgttgctttcagaccgtcacttgttaccaggcggtggtgaataatttggaggatgcgcatgagcaaattgatacggcgatatctaccgcgttgaaggagagtaaaccggtttatattagtatcggctgtaatttaccggcgattcctcatcctacttttagccgtgagcctgttccgttttctctttctcccaagatgagtaaccagttgggcctggaggctgccattgaagcagcagctgagtttctgaacaaggccgtgaagcctgtcatggttggtgggccgaaaatgcgtgtggcaaaggcatgtgatgcttttgttgagttagccgatgcatctggatatgcaatggccgtgatgccctcagctaaagggctagtcccggagcaccattcccactttataggtacttactggggagcagtgagcactgctttctgtgctgagatagttgaatctgctgatgcctatctgtttgccggtccaatattcaatgactatagctcggtcggctactcgttgcttctcaagagagaaaaggccatcattgtccagcctgatagggtagtgatcggtaatgggcctgcttttgggtgtgttctgatgaaggatttcttgaagggattggctaagaggataaagaaaaatactacagcttttgagaactacagtagaatctttgttcctgaggggcagcctctcaagtgtaaccctacagaacctctcagagtcaatattcttttccagcatatccagaagatgttgtccggcgacactgctgtcattgctgagaccggggattcatggtttaactgtcaaaaattgaagcttccaaagggttgcgggtatgagttccagatgcagtatggatcaattggatggtctgttggggctactcttggttatgcacaagctattcctgaaaagcgagttcttgcattcattggcgatggtagttttcaggtgactgcccaagatatctcgactatgctgcgatgtggtcagaagaccatcatcttcctgatcaacaatggtggatacaccattgaagttgagattcatgatggtccatacaatgtcatcaagaattggaactacactggtcttgtcgatgccatccacaacggagagggaaaatgctggacaaccaaggtattttgtgaggaggagctgctgaatgctattgagacagcaactggaccgaagaaggattgcctctgctttatcgaggtgattgtgcacaaagatgacacaagcaaagagcttctcgaatggggttcccgagtttctgctgccaacagccgccctccgaatcctcagtaactgctttagcgtaatgcctagaaatcttttccgaaattcccagtagtcgagaagacttggattttagtattttcataaacaatgattttgctttgtagttatctttcgtcagtgaatgagtgttgaaactttggcatttgaggttgagatttgttagtgcaagtctgatgagtatt

SEQ ID NO: 3630 - DNA, 1933 bp, Artemisia annua
actccgacgccaccttgggtcgtcacttagctcgtcgtttagttcagataggagtgtctgacgtgttctcagtaccaggtgacttcaacctcacgttacttgatcacttgatagctgagcctggactgaaccttgttggttgttgtaacgaacttaacgcgggatatgcagctgatggttatgctaggtgtcgtggtgttggtgcatgtgttgttacgtttactgttggtggactaagtgtgcttaatgctattgctggtgcttatagtgagaatttgcctttgatttgtattgttggtgggcctaattctaatgattatggtactaatagaattcttcatcatactattggcttgcctgattttactcaagagcttcgttgttttcaaacggttacttgctatcaggctgttgttaacaatttggaagatgcgcatgaacttattgatactgcaatttcaactgctttgaaagaaagcaaacctgtttatatcagtatcagctgcaatttgcctgcaattcctcatcctacttttacccatgaaccggttccgttttgtctctcacccaagttgagtaatcacatgggtttggaagcagctattgaggcagcggctgagttcttgaataaggcagtgaagccagtgatggttggcggtcctaaacttcgtgttgcaaaggcatgcgaggcgtttgttgaattgtccgacgcttgtggttatgcggttgctgtgatgccatcagccaaagggctggttcccgagcaccacaatcatttcattggaacttattggggtgccgtaagcacagctttttgcgcagaaattgttgaatctgctgatgcttacatatttgctggacctatattcaatgattacagctcggtgggttattctctccttctgaaaaaagaaaaggcgataatcttgcagcctgatagagtagtgattggtaacgggccaacttttggctgtgtcttgatgaaggatttcttgcaaggtttagcaaagaagcttaagaagaatacaactgcctatgagaactatcataggatctatgtgccagaaggtcatcctgtcaagtgtgatcctaaagagccattgagggttaatgttctttttgaacacatacagaatatgttatcgggagacacggctgtcattgcagaaactggagattcctggtttaattgccagaagctgaaattgccaaaaggatgcgggtatgagtttcagatgcaatacgggtcgattgggtggtcagtgggtgctacgcttgggtacgcacaggctgcaatgggtaaacgagtgattgcttgtattggtgatggcagcttccaggtaactgcccaagatgtgtcaacaatgctacgatgtgggcagaacaccattatcttcctgataaacaatggtggttacaccattgaagttgagatccatgatggtccttacaatgtgatcaagaattggaactacacgggttttgttgatgcaatccaaaatggcgagggcaagtgctggaccagcaaggtgcattgtgaggaggagcttgttaaagcaatagagactgcaaacggagctcaaaaggatagcttgtgtttcattgaagtgattgttcacaaggatgatacaagcaaagagttgctcgagtggggttcaagagtctctgccgccaacagccgccctccaaatcctcagtaaaaagaacttttcactaccatgggagcattgacaatgttagtttaactgctgataagagcagctgtatcattgctcccaatagttatacgagaaataggtttttgttgtcaaaagtctttatgaaataaataagccactcagacactggtgttgatcctggtattcaactcttggtggaaatttgaatcctccatatcctacttaaactctgaatctatagcttttgtttcttg

SEQ ID NO: 3631 - DNA, 2910 bp, Triticum aestivum
agccgccgccgccgccgcgcctgacgcggtgaactatcgcgatgtcgcccgctgccgccgcccccgcgccatgcgatgatcgcatccgcaccttcgaggacttcgcgcgggtgcaccagttcctgctgattgcggccggcgtgccgccgtcgctgcatcggcggctgtaccacaagctcgccgccgaggtgttcgacggcggggagagattctacgtagagccctgcgaggaagggaggcagcgccgcctcgtgctcgcctcggacacggctctaaggggggagtcggacgtcttcctcgtcgaccatgcgtggtccttccgcctctccgatgcgctcaagcagctacgtgaagtaccaggattggccgagagaatggcagctctaatgtgcgtggatctggataggaaaactgaggtcgaagagtcagatgagcaaggcagtgaaaatggtgggggtttggagcatgtcttgcaggtgctggagaacgaaaaagctagaatccaggagaggggaagttattttgcagcatggctggagcttgaggagcttggaattgatgatgatatgttagtggcactggatttatctgcaaattttccgaatctggtagccctcaatctatggggaaacaagctgcaggatccagaaaaagtaatgcgagaaatcgggaagtgtggaaggttaaaggcactttggctgaatgagaaccctatccttaaccaatgcactgagaaagatgttcttgatggtcttcctgaattggaaatctacaattcacattttacaaggaaagctagagagtgggctttaggtttctgcggagatatggttggagcagaaaatccctgtttgtctgtgggaaacatatcattggataatattgtgacccttgacctttctgataggtccatccacaaactacctgaggtgttctctagtaaactgtcatctctttcaaagttgaacatccgtggcaatcctttggaccaaatgtctggtgatgatctcttgaagttatttagtgggtttacacagttacaggagctggaggtagacattcctggccctcttggagacagtgcgatttccattcttgagtctcttcccaatataaatttgctgaatggtgtcaatgcgtcaactatagtcgagaacgctaagcatgtagtggactctgcacttagaccacgtgttccagaatggtcacctgaagaatccctggctgaaagagttattggtgcaatgtggctgtatcttatgacataccggcttgccgatgaagaaaagtttgatgaaacacccatttggtatgtcatggatgagttgggctcagcgatgcgccatagtgatgatgcaaactttaggatatctccttttttgttcatgccagaaggaaaattagcttctgctataagttacacaattctgtggcctatttgtgatgttcatactggagaagaatgtacccgagatttcttgtttggtattggcgaagacaaacaacgctcagctaggcttacagcttggttccacacaccagagaagtattttattcaggaattcaggaagtaccaggagcagcttcagtcaactactatttgtcctacaaaagaggcgccctcaaccaaaagtgcacttccaagtgatggccgtccacttcgagtattcactgatataccccaagtagaggagttcttaacacgtccagagtttgttctcacaactgatccgaaggatgcagacatcatctgggcaggcatgcaaattgattctgaattaaagagttcactaggtctcacagaccaacaatacatgaatcagtttccttttgaggcttgtctggtcatgaagcaccacctagcggatactatccacagggcatggggctcacctgagtggcttcaacctacatataacctagagacccatttgtctcaactaattggtgattactctgtgaggaaacgggatggtaaggacaacttatggatcatgaagccttggaatatggcaagaacaattgataccactgtcagtggtgatctatctgctatcatcagacttatggagacgggtcccaagatatgccaaaagtatattgagtgtcctgcacttttccaaggaagaaagtttgatcttcggtacattgttttagtccgcagtatatgccctttggatatacttctttgtgatgttttttgggtcaggttagcaaacaatcagtacactttggagaaaactagcctttttgagtacgagacccatttcactgtgatgaactacaatggaaggatgaaccatatgaatactccagagttcgtcaaggcgtttgagaaggagcaccaagttaaatggctggagattcatgaaagcatacgtattatgataaggcgtgtctttgagtcagcctcagctgtccatcctgagatgcagaactcattctgccgggccatctatggtgttgatgttatgcttgatgataaattcaagccaaagattttggaggtgacatattgcccggactgcacgagggcgtgccaatatgacacacaagctctcgttggaagccaaggccccatcagaggcagtgattttttcaacacggtgtttggctgcctctttctcgatgatttgacgaatgtgtcaccactgtaatcatcttgtcaagagccgtttctccctcgaataccaagagctgttgtaacaccaatgtccttgcatcatgatatgatcaagggttcttgtacgcttatgcatcaacgaactgcatttgtgtcaggatatgatcatgtattcatgtgaatgaagcttaagatggatttgcttgtgttacttgataaatattgctgcttctgatactaatgttgcatgcatatgagattgaactatatcaagtagcaaattatta

SEQ ID NO: 3632 - DNA, 1114 bp, Triticum aestivum
tggcggcgggtcccttcgcgctccgcctagggccgcgcctcgcggcgccggccgtggcgagtgcgactaggggaggaggacggggaagtgaccgccctacggccagccgagcgctggtgtcaaagaagtcaaacaaggaccaccgtttgtggattaggaaagattcggctgggtcagggaagaaggctctttgtcttgttaatactgtttcaaaactaccgaatgaaagagaaactgtttatggtgcattggataggtggactgcttttgagtctgaatttccaattatagcagcggctaaagctttggagatgttgaaaaagcaaagaaaatggctacagattatccaggtaaccaagtggctgatgagtaaaggtcaggtgctgacatggacaacgtacgatacactgctgttggctctttctatggatggaagagtagatgaggctgagtcaatttggaatactatcttacaaacttatacacgctcagtgcccaagaagttgttctctcggatgatccagatttacaacacgcgccatcttccagacaaagttttggagatatatgctgacatggaggaattgggcgtgcgtccagacgaggatacaacaagaagaatcggacgagcatttgcaacttcaggccaggaacataagcagaagcctgtccttgaaaaacacttgaagaagtggaagtacatccatttcaatggtgagcgtgttcgtgtgcggagggcaggacctttggcctagcaaacgtcctctggataggttcggatgaacaatgagtgtcgcctcgcctggacgtatgtgattgctattgttcttccgaggtcctatgcgagcatgtcaggtagaacaaggtgtcgaaattgtaatgctctctagacaaatggataatatcatagtgcagggtgagaactggcattactaatgatgttggtatccaaacatgtgtaagttgtgatgtttcagacaggttgctgtcgtcttcggcaccatgtgcaggaacaaagttttgacgaaccaagtttgttaattaaccgctacggcgtgtgacatgacagtacagtcctgctcctgatgaagggtgcagttagccaaaaaaaaaa

SEQ ID NO: 3633 - DNA, 1087 bp, Avena sativa
catttaagtttaatcctcacctccgccggcgacgccagccagagcagcggggtagttgaggcaaatggctggtacattcgcactccacctagggtcgcgcctcccggcgccgcctccagcgagcgcgacgagcggtggaggaggtagcctccctaccagcatacgagcgatggtgtcaaagaagccaaacaaggaccaccatttgtggattaggaaggattcagctgggtcagggaagaaggctcttcgtcttgttaatactgtttcaaagctaccgaatgaaaaggaagctgtttattgtgcattggataggtggactgcttttgagcctgaatttcctattatagcagcagcaaaagctttggaaatgttgaaaaaacgaagaaaatggctacgaattatccaggtaaccaaatggttgatgagtaaaggtcaggtgctgacatggactacatacgatacactgctgttggctctttctatggatggaagagtagatgaggctgagtcaatttggaacactatcttacaaacttatacacgctcagtgcccaaaaagttgttctctcggatgatccaaatttacaacatgcgccatcttccagacaaagttttggagatatatgctgacatggaagaattaggggtgcgtccagatgaggatacaacccgaagaatcggacgagcatttgcgtcctccggccaggaagaaaagcaaaagcctgtccttgagaaatacttgaagaagtggaagtacatccatttcaacggtgagcgcgttcgggtgcgcagggcaggacctttggcctagtaaaaccgttgtgttaatagctttggccaaacggtataaacatcgcttcgtctggacatatatgtgattatgtgaatgctatcttctgtaagcatgccagatggagcgaagtgggggaaaattgacaaattgtaatgctttctaggcaaatagatagtacaggtaaccgctgccaacatgctactaacgattttggtatccaaacatgcagtataagttgagtaggaacatatgcccttacatttggtcccgctcctgataaattgtgtgcttaga

SEQ ID NO: 3634 - DNA, 1267 bp, Triticum aestivum
cggtatacggcgacccacgcgtccggccaaacacacgaaggctcgaacgtatagaaaacatgtcgaggcctctgcttgcaatggccgcggcggcgatcgtcgtcgcctgctgtttcgcggcgtgtccggtgggcgcgggcgcgagcgctggtggcttctacgacaacttcgtggtgaagtggggcacggacccagaccctgaccggcgggtcgagatcgtcgacggcggccggctcgtgacgatcaccctcaacaacgtctccggcgccgggttccagtcccgggacgccttcctcttcggcgagttcaccatggagatgaagctcgtgcccggcgactccgccggcacggtcaccaccttctacctgacatcgaaggacccgacggcggtgggggacgggcacgacgagatcgacttcgagttcctgggcaacgtcagcggggagccgtacctgatgcagaccaacgtgttcgcgcagggcgtcgggggcagggagcagcggtcctacctctggttcgacccgacagaggacttccacaactacacaatcctgtggaaccctctgaacatcatcttctctgtggacggtgtgccagtgcgcgtgttccggaaccacgacgcgaatggcgtgccgtacctgaccaggcaggcgatgaaggtgcacgcgaccatctgggacggcgatacctgggccacgcgcggcggccgggtcaagatcgactgggcgcacgcgcccttcgtcgcctcctacgggacctacgccgccagcgcctgcgtctccgcggccggcaacggcgatcaggacggagcgccgtcggccttctgctgcccgggcgacgccccgtcgtggatggcccggcggctggggccggacggcgagcgcgcggtggcgtgggcgcgcgacaagtacatggtgatggactactgcgacgacccctggaacctcggccgccccgccgagtgcgacatggacagcctcgcctcagccgtgtgatagtttggttccgtcggccatactcaccacatacgtgtcgtcgtgtgccagacagacaggcgtacggtgtttgtgttggtgcttctagcgtagcctgctacgtcgtctcactcagatgtgacgtgtagggctgtaggcgtagcgtatataatacaggagataactactatgagttttctctagcggatcatagcaaggatgattcctgcagaaacctgcccctgctgtaacctgtagccgtgtaattcatgcatatccagacgctgagataa

SEQ ID NO: 3635 - DNA, 1269 bp, Pseudoroegneria spicata
  misc_feature (632)..(632): n is a, c, g, or t
  misc_feature (881)..(881): n is a, c, g, or t
  misc_feature (926)..(926): n is a, c, g, or t
  misc_feature (1020)..(1020): n is a, c, g, or t
  misc_feature (1083)..(1083): n is a, c, g, or t
aacatacaaacccaagcactcgaacacgtataggaaacatgtcgagtcctctgtttgttgtaatggccgcggcggcgatcgtcgtcgcctgctgtttcgcagcatgtccggtcggcgcgggcgcgagcgccggtggcttctacgagaatttcgaggtgaagtggggcacggacccagaccctaaccggcgggtcgagatcgtcgacggcgggcggctcgtgacgctcaccctcaacaacgtctccggcgccgggttccagtcccgggacgccttcctcttcggcgagttcaccatggagatgaagctcgtgcccggcgactcggccggcacggtcaccaccttctacctgacctccaaggacccgacggcggcgggggacgggcacgacgagatcgacttcgagttcctgggcaacgtcagcggggagccgtacctgatgcaaaccaacgtgttcgcgcagggggtcgggggcagggagcagcggtcctacctgtggttcgacccgacagaggacttccacaactacaccatcctctggaaccctctaaacatcatcttctcggtggacggcgtgccggtgcgcgtgttccggaaccaggaggcgaacggcgtgccgtacctgagcaggcangcgatgaaggtgcacgcgaccatctgggacggcgacacctgggccacgcgcggcggccgggtcaagatcgactgggcgcacgcgcccttcgtcgcctcctacgggacctacgccgccagcgcctgcgtctccgcggccggcaacggtgatcaggacgtcgcgtcggccttctgctgcccgggcgacgccgcgtcgtggatggcccggcggctggggcccgacggcgagcgcgcggtggcgtgggcgcgngacaagtacatggtgatggactactgcgacgacccctggaacctnggccgccccgcagagtgcgacatggacagcctcgcctcggccgtctgattgttttgttccgtcggccatactactaccacatacgtgtcgtcgngtgccagacagacagacgtacggtgtttgtgctggtgcttctagcgtagcctagcctgctagntcgtgtcactcagatgtgacgtgtacgcgtagcgtattgcccggagataattaggagtttcttagcggatcataacaaggatgattcctgcagaaacctgcccctgctgtaacctgtagccgtgtaattcatgcatatacagacgccgagataataccatcataggtaagattaactcatttctca

SEQ ID NO: 3636 - DNA, 1233 bp, Leymus cinereus x Leymus triticoides
accgtcgtagcttgctgtttcgcggcgtgtccggtcggcgcgggcgcgagcgctggtggcttctacgagaacttcgaggtgaagtggggcaccgacccagaccctgaccggcgggtcgagatcgtcgacggcgggcggctggtgacgctcaccctcaacaacgtctccggctccgggttccagtcccgggacgccttcctcttcggcgagttcaccatggagatgaagctcgtgcccggcgactcggccggcacggtcaccaccttctacctgacctccaaggacccgacggcggtgggagacgggcacgacgagatcgacttcgagttcctgggcaacgtgagcggggagccgtacctgatgcagaccaacgtgttcgcgcagggggtcgggggcagggagcagcggtcctacctgtggttcgacccgacagaggatttccacaattacaccatcctctggaaccctctaaacatcatcttctcggtggacggcgtgccggtgcgcgtgttccagaaccaggaggcgaacggcgtgccgtacctgaccaggcaggcgatgaaggtgcacgcgaccatctgggacggcgacacctgggccacgcgcggcggccgggtcaagatcgactgggcgcacgcgcccttcgtcgcctcctacggaacctacgcctccagcgcctgcgtctcggcggccgacgacggcaacggcgatagcgaaggccaagtcgggtcggccttctgttgcccgggggacgcctcgtcgtggatggcgcggcggctgggaccggacggcgagcgcgcggtggcgtgggcgcgggacaagtacatggtgatggactactgcgacgacccctggaatctgggccgccccgccgagtgcgacatggaccgcctcgcctcagccgtctgattgtttggtcggttccgtcggctatatactaccacatacgtgtcgtcgtttatcagacagacagacgtatgtgttggtgcttctagcctaagcctgctaggtcgtgtcactcagatgtgacgtgtaggcgtagcgttgtaatactagtactagtatatatataggtgtacgcccggccaggagataattaggagtttctctagcggatcataacaaggatggttcctgcagaaacctgcccctgctgtaacctgtagctgtgtaagtcacgcatatagatatgctcagataataccatcattggtaagattaactcatttctga

SEQ ID NO: 3637 - DNA, 1239 bp, Triticum aestivum
ctcgaacacgtatagaaaacatgtcgagtcctctgcttgttgcaatggccgcggcggcgatcgtcgtcgtgtgctgtttcgcggcgtgtccggtgagcgcgggcgcgagcgctggtggcttctacgacaacttcgtggtgaagtggggcaccgacccggaccctgaccggcgggtcgagatcgtcgacggcggccggctggtgacgctcaccctcaacaacgtctccggcgccgggttccagtcccgggacgccttcctcttcggcgagttcaccatggagatgaagctcgtgcccggcgactcggccggcacggtcaccaccttctacctgacatccaaggacccgacggcggcgggggacgggcacgacgagatcgacttcgagttcctgggcaacgtcagcggggagccgtacctgatgcagaccaacgtgttcacgcagggggtcgggggcagggagcagcggtcctacctctggttcgacccgacagaggacttccacaactacaccatcctctggaaccctctaaacatcatcttctctgtggacggcgtgccggtgcgcgtgttccggaaccacgacgcgaacggcgtgccgtacctgagcaggcaggcgatgaaggtgcatgccaccatctgggacggcgacacctgggccacgcgcggcggccgggtcaagatcgactgggcgcacgcgcccttcgtcgcctcctacgggacctacgccgccagcgcctgcgtctccgcggccggcaacgatgatcaggaaggagcgccgtcggcattctgctgcccgggcgacgcctcgtcgtggatggcccggcggctggggcccgacggcgagcgcccggtggcgtgggcgcgcgacaattacatggtgatggactactgcgacgacccctggaacctgggccgccccgccgagtgcgacatggaccagctccagctcgcctcggtcgtctgattgtttggttccgtcggccatactactaccgcacacgtgtcgtcgtgttatcagacagacagacgtgcggtgttttgtgttcgtgcttctagcgtagcctgctaggtcgtctcactcagatgtgacgtgtaggcgtagcgtatataatacagtagataactactgtaggagtttctctagcggatcatagcaagaatgattcctgcggaaacctgcccctgctgtaacctgtagccgagtaattcatgcatatacagacgctgagataattaag

SEQ ID NO: 3638 - DNA, 1225 bp, Triticum aestivum
actcgaacacgtatagaaaacatgtcgagtcctctgcttgttgcaatggccgcggcggcgatcgtcgtcgtgtgctgtttcgcggcgtgtccggtgagcgcgggcgcgagcgctggtggcttctacgacaacttcgtggtgaagtggggcaccgacccggaccctgaccggcgggtcgagatcgtcgacggcggccggctggtgacgctcaccctcaacaacgtctccggcgccgggttccagtcccgggacgccttcctcttcggcgagttcaccatggagatgaagctcgtgcccggcgactcggccggcacggtcaccaccttctacctgacatccaaggacccgacggcggcgggggacgggcacgacgagatcgacttcgagttcctgggcaacgtcagcggggagccgtacctgatgcagaccaacgtgttcacgcagggggtcgggggcagggagcagcggtcctacctctggttcgacccgacagaggacttccacaactacaccatcctctggaaccctctaaacatcatcttctctgtggacggcgtgccggtgcgcgtgttccggaaccacgacgcgaacggcgtgccgtacctgagcaggcaggcgatgaaggtgcatgccaccatctgggacggcgacacctgggccacgcgcggcggccgggtcaagatcgactgggcgcacgcgcccttcgtcgcctcctacgggacctacgccgccagcgcctgcgtctccgcggccggcaacgatgatcaggaaggagcgccgtcggcattctgctgcccgggcgacgcctcgtcgtggatggcccggcggctggggcccgacggcgagcgcgcggtggcgtgggcgcgcgacacgtacatggtgatggactactgcgacgacccctggaacctgggccgccccgccgagtgcgacatggaccagctcgcctctgccgtctgattgttcggttccgtcggccatactaccgcacacgtgtcgtcgtgttatcagacagacagacgtacggtgtttgtgttcgtgcttctagcgtagcctgctaggtcgtctcactcagatgtgacgtgtaggcgtagcgtatataatacagtagataactactgtaggagtttctctagcggatcatagcaagaatgattcctgcggaaacctgcccctgctgtaacctgtagccgagtaattcatgcatatacagacgctgagataa

SEQ ID NO: 3639 - DNA, 1031 bp, Hordeum vulgare
aactcgatcgtgctataacatagcactcgaacgtgtagaaaacatgtcgaggcctctacttgttgtaatggccgcggcggcgatcgtcgtcgtggcctgctgtttcgcggcgtgtccggtcggcgccggcgcgagcgctggtggcttctacgagaacttcgaggtgaagtggggcacggacccggaccctgaccggcgggtggagatcgtcgacggcgggcggctggtgacgctcaccctcaacaacgtctccggctccgggttccagtcccgggacgccttcctcttcggcgagttcaccatggagatgaagctcgtgccgggcgactccgccggcacggtcaccaccttctacttgacatccaaggacccgacggcggtcggggacgggcacgacgagatcgacttcgagttcctgggcaacgtgagcggggagccgtacctgatgcagaccaacgtgttcgcgcagggggtcgggggcagggagcagcggtcctacctgtggttcgacccgacagaggacttccacaactacaccatcctctggaaccctctaaacatcatcttctcggtggacggcgtgccggtgcgcgtgttccggaaccaggaggcgaacggcgtgccgtacctgaccaggcgggcgatgaaggtgcacgccaccatctgggacggcgacacctgggccacgcgcggcggccgggtcaagatcgactgggcgcacgcgcccttcgtcggctgctacgggacctacgccttcagcgcctgcgtctcgggggccggcgacggcgacggcgattaggacgttccgttggccttttgttgcccggcgacgccgcgtcttggatgggcccgcgggtggggcccgaccggtaacccccggttgcgtgggcccgggacaatacctggtggtggactattgggaccacccctggaacctggggcgccccccaatggcgaaaggggccgggtttgcttggccgttttaatgtttgtttcctggagcattaccctttcaaacactgtttctctgg

SEQ ID NO: 3640 - DNA, 1621 bp, Triticum aestivum
gaagcaggaagatcccacattttctcccacaaaacgcgaaatttctcgaggcgacgacatggccacgaccgagaagaagctgcacgccgtgctcgtgccgttcccggcgcaggggcacgtcacgccgatgatgaagctggccaaggtcctgcactgcaagggcttccacgttaccttcgtcaacaccgagtacaaccaacgccgcctcgttcgctcccgtggccccgacgccgtcgccagcctcccgggcttccgcttcgccaccatcccagacggcatacccacctccgacgccgatgccgacgcagactccacgcaggacccgccgtccctgtgctactacaccatgaccacctgcctcccccacttgaagaacctgctccgcgacctcaacggcgtggttggggcaccgccggtgagctgcgtcgtgggcgatggcgtcatgagcttctgcgtggacgcggccgcagagctcggcgtgccgtgcgcgctgttctggactgccagcgcctgcggcttcatgggctaccgcaacttccggttcctcctaaatgagggccttacccctctcgaagacgaggagcaagtgaagaacgggtacttggacacgccggtgacgcaggcacacgggatgagcgagcacatgcgcctccgagacttctcctccttcgtccgcacgacggaccgcagcgacgtcctgttcaacttcctgctgcacgaggtcgagcagtcggaccgcgcgactgccatcatcctcaacaccattgacgagctcgaacagacggcgctcgacgccatgcgcgccatcctccccctgcccgtctacaccatcggcccgcttaacttcctcaccgagcagctggtctcagaaggtgatggcagcggcacgctcgccgcgatacgctccagcctctggagagaagaccagtcctgccttgagtggctccagggccgggagccgcaatctgtggtgtatgtcaactacgggagcgtgaccaccatgtccaagcaggagctggtggagttcgcgtgggggctggccaactgcggctacgacttcttgtggatcgtgaggaacgacctggtaaagggcgatgccgccgtactgcctcccgagttcctcgaggccaccaaggataggtgcctcctagcgagctggtgcgagcaggaggcggtgatacgccacgaggcggtgggcgccttcctgacgcactgtgggtggaactcgatgatggaggggctcggagccggggtgccgatgctttgctggcccttcttcgccgagcagcagaccaacagccgctacgcgtgcatggagtggggcgtcggaatggaggttggtgacgatgtgcgccgggaggtggttgatgcgagaataagggaggtgatgggaggagaagaagtagggagggaaatgaggaggaaggcggcgaagtggaaggaggtcgcttctcgctcaaccgcgcaacatggtggcaggtcgttggccaaccttgagagtctgctcaaggatgtactgaagtgaccgccaataacaaataattaagctagttatatagtcactccttgcaaaattatactagtgcatataagtttttccaaagtcaaactttgtaaactt

SEQ ID NO: 3641 - DNA, 1635 bp, Triticum aestivum
aaacgcgaaatttctcgaggcgacgacatggccacgaccgagaagaagctgcacgccgtgctcgtgccgttcccggcgcaggggcacgtcacgccgatgatgaagctggccaaggtcctgcactgcaagggcttccacgttaccttcgtcaacaccgagtacaaccaacgccgcctcgttcgctcccgtggccccgacgccgtcgccagcctcccgggcttccgcttcgccaccatcccagacggcatacccacctccgacgccgatgccgacgcagactccacgcaggacccgccgtccctgtgctactacaccatgaccacctgcctcccccacttgaagaacctgctccgcgacctcaacggcgtggttggggcaccgccggtgagctgcgtcgtgggcgatggcgtcatgagcttctgcgtggacgcggccgcagagctcggcgtgccgtgcgcgctgttctggactgccagcgcctgcggcttcatgggctaccgcaacttccggttcctcctaaatgagggccttacccctctcgaagacgaggagcaagtgaagaacgggtacttggacacgccggtgacgcaggcacacgggatgagcgagcacatgcgcctccgagacttctcctccttcgtccgcacgacggaccgcagcgacgtcctgttcaacttcctgctgcacgaggtcgagcagtcggaccgcgcgactgccatcatcctcaacaccattgacgagctcgaacagacggcgctcgacgccatgcgcgccatcctccccctgcccgtctacaccatcggcccgcttaacttcctcaccgagcagctggtctcagaaggtgatggcagcggcacgctcgccgcgatacgctccagcctctggagagaagaccagtcctgccttgagtggctccagggccgggagccgcaatctgtggtgtatgtcaactacgggagcgtgaccaccatgtccaagcaggagctggtggagttcgcgtgggggctggccaactgcggctacgacttcttgtggatcgtgaggaacgacctggtaaagggcgatgccgccgtactgcctcccgagttcctcgaggccaccaaggataggtgcctcctagcgagctggtgcgagcaggaggcggtgatacgccacgaggcggtgggcgccttcctgacgcactgtgggtggaactcgatgatggaggggctcggagccggggtgccgatgctttgctggcccttcttcgccgagcagcagaccaacagccgctacgcgtgcatggagtggggcgtcggaatggaggttggtgacgatgtgcgccgggaggtggttgatgcgagaataagggaggtgatgggaggagaagaagtagggagggaaatgaggaggaaggcggcgaagtggaaggaggtcgcttctcgctcaaccgcgcaacatggtggcaggtcgttggccaaccttgagagtctgctcaaggatgtactgaagtgaccgccaataacaaataattaagctagttatatagtcactccttgcaaaattatactagtgcatataagtttttccaaagtcaaactttgtaaactttgatcaagtttatagaaaatgtatccacattttagccttctacca

SEQ ID NO: 3642 - DNA, 3990 bp, Triticum aestivum
ggtgttttctcacttgcatgagcttgatcttcgttatcatctaagccggcaaactggagctctaaatcgcataattgacagagggagcaacgcaataaatttcattcttacggtgacagtgttcaatattgttcccacaatactagagattggtatggtgtcaagtatacttgcctacaagttcggctccacttttgcttggattacttcagtttcagttgctacttatattgttttcactttggctttgacacagtggcggacgaagttcaggacagccatgaataaagctgataatgcttctggtgcagtggcagttgactcccttctgaattacgagactgtcaaatacttcaacaatgagcaatttgaagttcagaagtatgacaaatatttaaagagatacgaggattctgcactgaaagcccaaagtagccttgcctacttgaactttgggcaaaatgttatatttagtgtgtcattatccacagcaatggttttgagctcatatggtgtaatgagtggtgctctgactgtcggtgatttggtaatggttaatggacttctattccagctctcagtgcctctgaacttccttggcagtgtatatcgagaatctagacaaagccttattgacatgaagtccatgtttcaattgcttgaggaaaaacctggaataaaggatgagcttcatgcacaacctttgcaattcaagggaggatgcattgaattcgagaatgtccatttcgggtatgccccagaaaggacgattcttaatggggccactttcactgtaccggcaggaaaaagtgtggcaattgttggaactagtggcagcggaaagtcaaccatacttaaacttctctttagattttttgattcaacttcaggatctatacgaatagacggacaagatatccggggagtcacactggacagtcttcggaagtcgcttggtgttgtgccacaggatacggtacttttcaatgacacaattaagcataatatacaatatgggcggttatcagcaaatgatgaagaggtttacgatgctgctcgacgtgcctctatccatgatacaattatgaactttcctgacaagtatgacacggttgtgggagagcgtggattgaagttaagtggtggtgagaaacaacgagtctcaattgctcgtgtattcttgaaggagccttccattctgttatgtgatgaagctacaagcgcactggatagcactactgaatcgtcgattttgaattctctaatgtctttatccgtcgatcgaacctcggtatttattgctcatcgactcacaactgcaatgctatgtgacgagatcatcgtcttggagaatggaacagtagtggaacaagggccacatgatcttcttctgtcgaagcacgggcgttatgccgaactttggtcccagcagaataccactgaaggcagttgatgcttctgcttttggtacataagtttgatacacccaatacgttttccctttgcatgggaaaacaatacatagccatatttcaactgaagcaggtttttatttgtctgccttgtaaatgcacttcttgagatttcagatacaggggggaattctccattttagagagccgagagaggctaaattttcctgtacagatatctaacaataccggcgtatgtccatatgttgatgtaataatccttttactacatggaataagtaaataattcgtgtgcagcttaatgtagtaacatactaactttcaattatttcgagttacatacgtacctgtctgatctactgtgtgcctcatcttagttttttactgtcacattttgtgtcatcctgactgcctgtgtgtctctcgggccagacatcagggactgaagaaagtgatgttgatcgaatgatctgcaccgtcccacaagcgtcgtccttcgtcaatcgccggtatggcaataggtaaatgcaagcaatctatgcatccctgttttcctaaatgatctgatgttgtgtcttaagctgcatgaatattggtgctgtgtgcagccagccaccagatatctctcaacactgaaaccacaccacacaatagtctgaacactgaatcacctgttgatcttcaggttgtgtgcattgcattcatagtgcatggacataaacagaagaattagtatataatcttgtccgctttctctagattccaccaatacatatatttgttggcttttctagccaagaaatccatatagactaccatattgcctgcacccgccgcacacaaatttctgcttttatcgacctatatttgttagcttttcaatacgtatatttgttaacttgaaagacagcttccaaagtttagcgggtaaatggtagaaggctaattggtaaatgtagttaagttttcaataaactagtcaaagtttacaatgtttgactttgtaaaaaattatatccactatagttttgcaaggagtgactatatacccaccttaattatttgttattggcggtcacttcagtacatccttgagcagactctcaaggttggccaacgacctgccaccaggttgcgcggttgagcgagaagcgacctccttccactctgccgccctcctcctcatctccctccctacttctcctcccatcacctcccttatcctcgcctcgaccgcctcccggcggacgtcgtcgccgacctccaccccgacgccccactccatgcacgcgtatcggcagttggtctgctgctcggcgaagaaaggccaacatagcatgggcaccccggcgctgagcccctccatcatcgagttccacccacagtgcgtcaggaaggcgcccaccgcctcgtggtgcatcaccgcctcctgctcgcaccagctcgctaggaggcacctgcccttggtggcctcgaggaactcgggaggcagcaccgcggcatcgcccttcaccaggtcgttcctcacgatccacaggaagtcgtagccacagttggcaagcccccaagcgaactccaccagctcctgcttggacatggtggttacgctcccgtagttgacatacaccacggagcggggctccctgccctggagccacttgagacatgactggtcttctctccagaggctggagcgtatcccggcgagatcgccttcctgtgagaccagctgctcggtgagtgagttaagcgggccgatggtgtagacgggcagggggaggatggcgcgcatggcgtcgagggccgtctgctcgagctcgtcaatggtgttaaggacgatggcggtcgcgcggtccgactgctcgacctcgtgcagcaggaagttgaacaggatgtcgctgcggtccgtcgtgcggacgaaggatgagaagtctcggagacgcatgtgcttgctcatcccgtgtgcctgtgccaccggcgtgtccaagtacccgttcttcacttggtcctcatctttgagaggggtgaggccctcgtctaggaggaaccggaagttgcggtagcccatgaagccgcaggcgctggcagtccagaacagcgcgcacggcacgccgaggtccgcggcggcatccatgcagaagctcatgacgccatcgcccacgacgcagctcacccgcggcgccccaaccgcgccgttgaggtcgcggagcaggttcttcaagtgggggaggcaggtggtcatcgtgtagtaacagagggacaccgggtcctgcggggcatcggcgtcggcgtcgacatcagacgtgggtatgccgtctgggatggtggcgaagcggaagcccgggaggccggccacggcgccggggacgcgggagcggacgaggcggcgctggttgtactcggtgttgacgaaggtgatgtggaagcccttgcggtgcaggaccttggccagcttcatcatcggcgtgacgtgcccctgcgccgggaacggcacgagcacggcgtggggctgcttcttgttcgtggccatgtcgtcgcctagagaaattttgcgttt

SEQ ID NO: 3643 - DNA, 1871 bp, Triticum aestivum
  misc_feature (1644)..(1644): n is a, c, g, or t
  misc_feature (1709)..(1709): n is a, c, g, or t
gaattcggcacgagctcccactaaacgcaaaatttctctaggcgacgacatggccacgaacaagaagcagccccacgccgtgctcgtgccgttcccggcgcaggggcacgtcacgccgatgatgaagctggccaaggtcctgcaccgcaagggcttccacatcaccttcgtcaacaccgagtacaaccagcgccgcctcgtccgctcccgcgtccccggcgccgtggccggcctcccgggcttccgcttcgccaccatcccagacggcatacccacgtctgatgtcgacgccgacgccgatgccccgcaggacccggtgtccctctgttactacacgatgaccacctgcctcccccacttgaagaacctgctccgcgacctcaacggcgcggttggggcgccgcgggtgagctgcgtcgtgggcgatggcgtcatgagcttctgcatggatgccgccgcggacctcggcgtgccgtgcgcgctgttctggactgccagcgcctgcggcttcatgggctaccgcaacttccggttcctcctagacgagggcctcacccctctcaaagatgaggaccaagtgaagaacgggtacttggacacgccggtggcacaggcacacgggatgagcaagcacatgcgtctccgagacttctcatccttcgtccgcacgacggaccgcagcgacatcctgttcaacttcctgctgcacgaggtcgagcagtcggaccgcgcgaccgccatcgtccttaacaccattgacgagctcgagcagacggccctcgacgccatgcgcgccatcctccccctgcccgtctacaccatcggcccgcttaactcactcaccgagcagctggtctcacaggaaggcgatctcgccgggatacgctccagcctctggagagaagaccagtcatgtctcaagtggctccagggcagggagccccgctccgtggtgtatgtcaactacgggagcgtaaccaccatgtccaagcaggagctggtggagttcgcttgggggcttgccaactgtggctacgacttcctgtggatcgtgaggaacgacctggtgaagggcgatgccgcggtgctgcctcccgagttcctcgaggccaccaagggcaggtgcctcctagcgagctggtgcgagcaggaggcggtgatgcaccacgaggcggtgggcgccttcctgacgcactgtgggtggaactcgatgatggaggggctcagcgccggggtgcccatgctatgttggcctttcttcgccgagcagcagaccaactgccgatacgcgtgcatggagtggggcgtcggggtggaggtcggcgacgacgtccgccgggaggcggtcgaggcgaggataagggaggtgatgggaggagaagtagggagggagatgaggaggagggcggcagagtggaaggaggtcgcttctcgctcaaccgcgcaacctggtggcaggtcgttggccaaccttgagagtctgctcaaggatgtactgaagtgaccgccaataacaaataattaaggtgggtatatagtcactccttgcaaaactatagtggatataattttttacaaagtcaaacattgtaaactttgactagtttattgaaaacttaactacatttaccaattagccttctnccatttacccgctaaactttggaagctgtctttcaagttaacaaatatacgtattgaaaagctancaaatataggtcgataaaagcagaaatttgtgtgcggcgggtgcaggcaatatggtagtctatatggatttcttggctagaaaagccaacaaatatatgtattggtggaatctagagaaagcggacaagattatatactaattacctgcccgggcggccgct

SEQ ID NO: 3644 - DNA, 1756 bp, Brachypodium distachyon
ggaaatgagcaccgagacgacgagcaagcgggatcacgaggcgtccctgcgggagctcctggccggcggagacaaggagctgatgaccgtggcacgctcggcgcggcggcgccgcctggaactccggcgtctggggcgtacggcgtcggcggcggcggaggacgagggcgcgaagagggttcgccccgcggggccgctggacagctgctcgtcggactcgtctgactcggcgaaggtgacgccggagcctcagccggtgtgcgtgtcgcacggcgcggtctcggtgatcgggcggcggcgggagatggaggacgcggtggccgtggccgcgccgttctcggcggtggttgagggggacgggaaagaggaggggttcttcgcggtgtacgacgggcacggcgggtcccgcgtggcggaggcgtgcagggagcggatgcacgtggtgctcgcggaggaggtgcagcggcttcgtggcatccagcagcagcgggggagcgggagcggccgcgacgaggaggaggacgtcatcgcagggtggaaggaggccatggcggcctgcttcgcccgggtggacggcgaggtcggcgtcgaggacgaggccgagaccggcgagcagacggtcggctccacggccgtcgtggccgtcgtggggccccgccgcatcgtcgtcgccaactgcggcgactcccgcgccgtgctctcccgcgccggcgtccccgtgccgctctccgacgaccacaagccagacagacctgatgagatggaaagagtggaagcagctggtggcagagttatcaactggaatggataccgtattctaggagtgcttgcgacttctaggtcaataggagactattacctgaaaccatatgtgatagcggaaccagaggtgaccgtcatggaccggacagacaaagacgagttcctcatattagcaagcgacggcttgtgggacgttgtgtccaacgaagtggcctgcaagatcgcaaggaattgcctaagcgggcgggcggcttccaagtaccccgagtccgtctccgggagcacagcggccgatgccgcggcgttgctggtggagctcgccatgtcgcgcggcagcaaggacaacatcagcgttgtcgtcgttgagctgcggcgactgaggagtaggacagcggcggtgatcaaagagaaccgcaggtagtaatgatgtaggattgaccggacggctggggagatgccctcaacattcgaccatggcgaaggagaaagagtgtagttagagggatcagggatgttgtgtgactgctgctcagctgttgagttgagtgcgctatttgtagccgttccgttgtattgcgttggttcattagttcttctatgatgacgttgaggccaaagcggcaggaagcataagctgctttcgtctgttccgttcattggttttgccatgcggttggattccgatttacgtcttaaatatggtcggatactggcttagcgataaatcctgaacttggggggtgatccatccgatgacttcatgtcaagcagttcatggttgatgcagagtgccagtaccggtgcaagtagataatgaacttctgagccctggacgaacatgaccatacttggctgcagaaatgcacgagcagcaatggtttgcagttgacaggccaacagcagttccgacagagacagaccagcagagatgataaagagttgaagacaacttactgtctgctacaagtttgcatggcaactaagcagacacaca

SEQ ID NO: 3645 - DNA, 1557 bp, Oryza sativa
gtttcgcgttgccacgctctcactctcttttgctctctctggtgagggaaatgagcagtgacacaagcaggcgggatcatgccgccatggccgtgcgggaggtcctcgccggcgacaggaaggtgggcaccgtgtccaggtcggcgaggaggaggaggcttgagctccggaggctcgggcggacggcgtcggcggtggcggaggatgacgccgcgaagagggtgcggccggcgtcggacagctcctccgactcgtcggagtcggctaaggtagcgcccgagcccaccgcggaggtggcgagatggccggcgtgcgtgtcgcacggggcggtgtcggtgatcgggcgccggagggagatggaagacgccatcttcgtcgcggcgccgttcttggccgcctcgaaggaggcggcggtggaggggagcggcgtcgcggaagaggaaggcaaggaggaggatgaggggttcttcgcggtgtacgacgggcacggcgggtcccgcgtggcggaggcgtgccgggagcggatgcacgtggtgctcgcggaggaggtgcgggtgcggaggctgctgcagggcgggggcggcggcgccgacgtcgaggacgaggaccgcgcccgttggaaggaggccatggcggcctgcttcacccgcgtggacggcgaggtcggcggcgccgaggaggccgacacgggcgagcagacggtgggctccaccgccgtcgtcgccgtcgtgggtccccgccgcatcgtcgtcgccaactgcggcgactcccgcgccgtcctctcccgcggcggcgtggccgtgccgctctcctccgaccacaagccagacagacctgacgagatggagagagtagaagcagcaggtggcagggttatcaattggaatggataccgtatcctcggtgtccttgctacttctaggtcaattggagactattacctcaagccatatgtaatagctgagcctgaggtcacagtcatggacaggacggacaaggacgagttcctcatattggcgagcgacgggctgtgggatgtggtatccaacgatgtggcctgcaagattgcgagaaattgcttaagcgggcgggcagcttccaagtacccagaatccgtctccgggagcaccgcagccgatgctgccgccctgctggtcgagctcgccatctcccgtggcagcaaggacaacatcagcgtcgtcgtggtcgagttgagacggctgaggagtagaacgacggcgagcaaagagaacggtaggtagcgtgtagaagttggagcggctgtcacagcatttgagcatggcgagagaggaagaagctagaggatttgcagctgagtttgctgggatgtttgtaaagagaaggctcaggatattattccgtccatagagctgctccgatgtcgtgaccgatgagcgtgtgctatttgtagctgagatgctgtattgcgttgagttgggttctttagttcttaagctgacatttcggccgaggcagcatgaagcatgtgctgatttcgtctgttctgatcattggttatctctgtctctcgtgtca

SEQ ID NO: 3646 - DNA, 3367 bp, Brachypodium distachyon
tgccctggtgatggttgtatgctagtgtccagatgagttcaaagaaagtcccattcaaccgccataaggagaatgaggaagcgaggaagaagagggaagaagatgaagcggcacgcgtgtatgctgagtttgttgaatcattcaagggtgaaagcacgtctgggtcaaagtttgtccggggaggtgtgattgatcctaatgccaagatgagaactgattctgaaggtggaaagtccaaagatggggggtctgttccaaagaagggcagtaggtacgttccgtcctttttgccgccatcatttgggagagagccagagaaaaagaaggaagatgagcggccaaaggaaaaggaaaaaggaaagccgcgagcaatagataagttcatggaggaactcaagcttgagcaagagcttcgagaaagacgtaatcaagaacgtgacggtcgacacggtgacacttccgcgccctctagccgttttgatgaactaccagatgaatttgatcctggtagattaccaggatcatttgatgacggggatccgcagaccacaaacttatatgttggcaatctctctccgaaggtggatgagaattttcttttgaggacatttggtcggtttggacctattgctagcgtcaagattatgtggccccgaacagaagaagaacggagaaggcaaaggaactgtggttttgtcgcattcatgaatagagcagaaggacaggcagctaaggatgaaatgcaaggtgttgttgtgtacgactatgagctcaagatagggtggggtaaatctgttgcacttccatcccaagcactgcctgctcctcctccaggacatatggccatcagaaataaggagggtggcactgtcatcatatctggtcctggaggtccacctgttgcatctgttacaccacaaacctcagagctggtccttactccaaacgttcctgatatagtcgttgctcccccagatgattcacatcttaggcatgtgattgacacaatggctctgcatgtgcttgatggtggatgtgcttttgaacaagctattatggagagaggacgaggaaatgctttgtttaccttcttgtttgatcttaaatcaaaagagcacacatactatgtttggaggttgtactcctttgctcagggcgatactttacaacgatggagaacagaaccatttatcatgattacaggaagtggaagatgggttccacctgctttgccatccagcagaagcccagatcatgaaaaagaatccacctttgcagctggtagaagcaggcgtgttgaagtggagcgtacattgactgattcacagcgtgatgaatttgaggacatgctacgtgcattgacattagagcggagtcagataaaggaggctatgggatttgcgctggataatgctgatgctgctggagagattgtcgaagttcttgcagaatcattgacactcaaggagacacccatcccaaccaaggttgcaagacttatgctagtatcagacatccttcacaatagtagtgctcctgtgaagaatgcttctgcatttcgaaccaagttcgaggctgctataccagatgtcatggaaagtttcaatgacttgtaccgcagtatcacaggaaggattactgctgaagctctgaaggagagggttttgaaagttctacaagtatgggcagactggttcttgttttctgatgcatatctgaatgggctaaaagctacctttcttagatcaggcaactctggggtcacccagttccactctttatgtggtgatgcacctgaaattgaaaagaaaactagctctgaggatggtaataatggatttaggcttgatgaagatggcgccctggccacaggaaaggcagcagcaacgaaggagctgttagggcttccgcttgctgaacttgaacgccgttgtagacataatggcctgtcactatgcggtggtaaagagacgatggttgccaggttgctcagcttggaggaggctgagaaggagcgagtatatcagaaagatgttgacgtaaaatatggacaaggcgaacctcataggactggaagagatgatattggtttgaacactcgtagtgcttcaagatttggagaaggtactgttgctgatgaattggatatgccggggctctctcgttatacaagtcaaagacactctggggagcctgcatctgctgaacctgaacaagttccaagcaagaagcagaaagctgatcccatcttgccagattctaaatggaatcgagatgatgatgtcagtgatgatgaaaataggaaaggcggtcaaggattgggattaagttattcatctggaagtgatattgctggcgaacctgggaaaggtgacacatcagaaattagatctgatcacacaagtcaccatcaagacacaattgttgatgaagagcataggcagaagctgaggcagattgagattgctgttatgcagtatcgtgaatctctcgaggagaatggtttgcgcaacacggaggagattgagaggaagattgccagccaccgtaggcatcttcagtctgaatatggtttgacttctcaaatggatggtgcaaacaacatccgatcttctgaaagaacaccattggagcggaaagaaaggtacggtaatgtgcatgattcttccaggaagcggcctcgcagtccgaataggagtcgtagtccttcaaggaagtcatcatcactagatagagatcgagagcacagtcgcagcagagacaagttgcatggtaatgatgttggaagagatagggttcgcgagaaaagtgcaaaccgagggaaggatgatcactatgataggagccgagacagggaaaaggacaggagaaagggaaggtgattggtacttgaaaatcttctattgtgagcttaccttgccttaacaggggtcttggagcaaggttaaattttagcttgtttgcatcagttgatacatgcctcatctcaatgtgtatgcatgtcctgctccatgccttgaagaacctgttcgtagtggccagtgctgagaatggagttggttctcctcatagaggacccattttgtagtttcaaagaagaagtagcgttgtggcaaaatcaaatatttagtaagcacattttttaagtagcaacactgaatgaaatgctgcctgcccattctggtcatggactgctgctaatgaacttggatggcaggctgcagtatggatttctctgttatgattccttaatgctgtaggattcagattagaactagcactgatcattttgagctcgcaatagaatttgttgcctcaattggactcaacagtttttaatcttgatgtggaggttaaagttgctttg

SEQ ID NO: 3647 - DNA, 3949 bp, Brachypodium distachyon
atggcggggaaagctcggggcctcatcaggcgagcagaggcgcgaagaaagcagcagcgcgaggcacggcggccgtcggggcgcccgtcgggcggtggtgtcggcgcgtcgcggccatcggcggcggtagggcgcgcgggcgtccgcggcggcaacgagctgtggtcggtgcggtggggagcgcgcacgatgaggacgacgggtgcaagggtaatgctagaggaggaagaagaggccattgagttgctgacaatgaagctccacatgtcagagtgtgttgtagcaaatggctacaaaatcataatgatgagttcgaagaaggttccattcaaccggcataaggagaacgaggaggcaaggaagaagagggaggaagatgaagcggcgcgtgtttacgctgagtttgtccagtcattcgagggtgaaagcacatctgggtcaaagtttgtccgagggggtgtgatcgatccaaatgccaagctgagagctgaatctgaaggtggaaagtccaacgatagagggtctgctccaaagaagggcagtaggtatgttccatcttttttgccgccaccatttgtgagggagccagagaaaaagagggaagatgagcggccaaaggaaaaggaaaaaggaaagccacgggcaatagatacggtcatggaagaactcatttttgagcaacagcaacgagaaaggcgtaatcaagaacgtgacagtcgacgtggtgacacctccgtgccctctagccgctttgatgaactaccagatgaatttgatcccactgggagattaccgggatcatttgatgacggggatccacaaactacaaacttatatgttggcaatctctctcccaaggtggatgagaattttcttttgaggacatttggtcggtttggacctgttgcgagtgtcaagattatgtggcctcggacagatgaagaacgcagaaggcaaaggcattgtgggtttgttgcattcatgaatagagcagaagcacaggcagccaaggatgaaatgcaaggtgttgttgtgtacgactatgagctgaagattgggtggggcaaatctgttgctcttccatcacaagcactgcctgctcctcctccaggacatatggcaatcagaaacaaggagggtagcactgtcgtcatatctggacctggaggtctacctgttgcatctgttacaccacaaacctcagagctggtacttactccaaatgttcctgatatagtagttgctccaccagatgattcacatcttcggcatgtgattgacacaatggctttgcgtgtacttgatggtggatgtgcttttgaacaagctataatggagagaggacgaggaaatcctttatttagcttcttatttgatcttaaatcaaaagaacatgcatactatgtttggaggttatactcctttgctcaggtatccactgttttaatgttgctacattttcaatgcaatctcctctatgatctaacaggtgatactttgcaacgatggcgaacagaaccatttatcatgattacaggaagcggaagatgggttccaccttctttgccatctagcatgagcgttgaccgtgaaaaagaatatacctttgcaactggtagaagcaggcgtgttgaagtggagcgtacattgactgattcacaacgtgatgaatttgaggacatgttacgtgcattgacattagagaggagtcagataaaggaggctatgggatttgcattggataatgctgatgctgctggagagattgttgaggttcttgcagaatctttgacactcaaggagacatctatcccaaccaaagttgcgcggcttatgctagtgtccgacatccttcataacagtagtgctcctgtgaagaatgcttctgcatttcgaaccaaatttgaggctgctatacctgatgtcatggagagcttcaatgacttgtatcgcagtatcacaggaaggattactgctgaagctctgaaggagagggttttgaaagttctacaagtatgggcagactggttcttgttttctgatgcatatctgaatgggctgaaagctacctttcttagatcaggcaactctggggtcaccctgttccactctctatgtggtgatgcacctgaaattgaaaagaaaactagctgcgaggatgacaataatggatttatgcttgatgaagatggtgccctggcgacaggaaaggcagcagcgacgaaggagctgttagggcttccacttgctgaacttgaacgccgctgtagacataatggcctctcactatgtggtggtaaagagatgatggttgccaggttacttagcttggaggaggctgagaaggagcgattatatcagaaagatgttgacatgaaatatggacacggtgaatctcatagaactggaagagaggatagcggttttgacgctcatggtgcttctagatttggaaaaggtactggtgaatcggatatgctggggctctctcgtcacagtatggaaacagatgaaagacgctctgaagagtctgcattggctgaatgcgaacaagttccaagcaagaagcagaaaactgagcccattttgccagcttctaaatggaaccgagaggaggatggcagtgatgatgaagagaggaatggcgaacaaggattgggattaagctattcatctggaagcgatattgctggtgataatggaaaaggtgatgcagcagaaagcagtggcaatcatgcgattcatcacccagatacaattgttgatggagagcataggcagaagctgaggcagattgagattgctgtcatgcagtatcgtgaatctcttgaggagaagggtctgcggaacatggaggagattgagagaaaggttgccagccaccgtaggcatcttcagtctgaatatggtttgtcttcttcaatagacggtgcaaagaacaggcaatcttctgatagaatatcaaaggagcggaaagaaaggtatgatgatgcacgtgattcttccaggaagcggcctcgcagcccttcaaggaagtcgtcgctagatagagatcaagagcacaatcgcaacagagataggttgcatggtaacgacgtggggagagacagggcacatgaaaaaagcacacgccgagggaaggatgattactactctgggagcagagacagggaaaaggacaggagtaagggaaggtaatactatttgagctgctgggctgggctgcttgagttgatacacctgttgactgttgtcccttaatggggaatgcatggcgagctccatgcctacaaatacctgcatgtaatgggtggcttttgaggattgagaggtgcttctcaatctatattgtagcttcaagaacagaaatagcatcgtgaaccatcgaatgagtaaccacatttcttcagaaccatcgaatgagggccttttcggcttcttggactggcttatccgagaagctgctctttcctagcttccttcctggaccggcttctttgagaagctgctctttcctaactttctggagaagctgctacttaaatttgattaggctaccaaactagtttgccctaaacaactttggaaacctaactaaatatgagttgtggcttttccaggaagttagtggtggcagtttctaagagaaactggtcctagaagccgaatagaacgcagcctaaatgacaaccattccgatagtggagtccggctaatgacaagttgcagttagctgactaccctgtttatctgaaattactggttgcttgattggtggtgcattcttctgccactgtaagcgcgcctccaatagtttatatattagtttgtgtgtaaatttgtccaataacaaaaacttcctttcggccaagttaccagctatgtgggatcaaaccaacaagaacatgatcaaatgaagaaatgactaaaaaatgaaaagggcttaagg

SEQ ID NO: 3648 - DNA, 3688 bp, Oryza sativa
tcgggtttagagaggcaacaaaaatcagtaggtcgtcccagggcagggccttgctccgatccccaatccgtccctcgagcgagcagaggcgccgccgtcgctcatcctgctgcttccgccgccaccgccgccgccgcctgcgccgatccccatccatcccgcaagcgagcatcctggattaggatgagttcgaagaaggttccattccaccgacataaggagaacgaagaggcgaggaagaagagagagcaagatgaagcggcacgtgtgtacgaggaatttgtggagtcattcaagggtgatagcacatctgggtcgaagtttgtccgaggaggtgtgattgatcccaatgccaagctgaggattgattccgaaggtggaaagtccaaagatggggggtctgttccaaagaagggcagtaggtatgttccatcttttttgccgccgtcatttgggaaagagccggacaaaaagaaagaagaggagcgtccaaaggaaaaggaaagacgaaagccacgggtaatagacgagttcatggaggagctcaagtttgagaaagagcttcgacaaaagcgtaatcaggaacgcgagcaatggcgtgagggtcgacacactgacacatctgcttcctctagccgttttgatgaactaccagatgaattagatcccattgggaaacttccaggatcatttgatgatggggatccacaaaccacgaacttatatgttgggaatctttctcctaaggtggacgagaattttcttatgaggacatttggtcgttttggacctattgctagtgtcaagattatgtggcctcgaacagaagaggaacgcagaaggcaaagaaattgtggttttgttgccttcatgaatagggctgatggacaagcagccaaggatgaaatggaaggtgttgttgtgtacgactatgaactgaaactagggtggggcaaatctgttgctcttccttcacaagcactgcctgctcctccaccagggcacatggcaatccggaataaggagggtggtactgtcatcttatctggtcctggtggtccacctcttgcatctgttaaaccacagacctcagagctggtcctcacaccaaatgttcctgatatagtggttgctccgccagatgatgcacatgttcggcatgtgattgacacaatggctctgcatgtacttgacgggggatgtgcttttgaacaagctgttatggagagaggccgaggaaattctttatttagtttcttgtttgatcttaaatcaaaggagcacacatactatgtttggaggctatactcatttgctcagggaagtggtgatagtattttgttggaagtgaactgtgatagtaaagagggtgatactttgcagcggtggagaacagaaccatttatcatgattacaggaagtggaagatgggttccacctgctttgccatccagcagaagtcctgagcgtgaaaaagaatctacttttgcggctggtagaagcaggcgtgtcgaagtggagcgcacattgactgattcacagcgtgatgaatttgaggacatgctacgtgcattgacattggagagaagtcagataaaggaggctatgggatttgcattggataatgctgatgcagctggagagattgttgaagttcttacagaatctttgacactcaaggagacacccatcccaaccaaggttgctcggcttatgctagtgtctgatattcttcataacagcagcgctccagtgaagaatgcttctgcattccggacaaagtttgaggctgctctacctgatgttatagaaagcttcaatgatttataccgcagtatcactggaaggattactgctgaagctctgaaggagagagttttgaaagttctacaagtatgggcggactggttcttattttccgatgcatatctgaatggactaagagctacctttcttagatcaagccacttaggggtcatcccttttcactctctatgtggtgatacaccagaaattgaaaagaaagctagctctgaggacggcagtgatggatttaggctcaacgaagatggtgccttggccacaggaaaggcagcggcaacaagggagctgttagggcttccgctagctgaacttgaacgccgttgcagacataatggcctctcgctatgtggtggtaaagagatgatggttgccaggttgcttagcttggaagaggctgagaaggaacgagtatatgagaaggacgcgggcattaaatatggacaaggagaatcgcatagaactggaagagatgacattgctgtgaatgctcgtaatgcttctagacctggagaaggtactgatagtggtgaatcagacatgttgggtctctctcattatgctatggaagcagggtacaaacgctctaatgaatccacacccgctgaacctgttccaagcaagaagccaaaagttgaccctgttttgcccgcttcaaaatggagtcgagaggatgatgtcagcgatgatgaagatagaaaaggtggcagaggcttaggattaagctattcatctggtagcgatattgctggtgattctgggaaagctgatgcaacagaagttagtactgatcactcgaatcatcaccaggatacgattcttgatgaagagcatagaaagaagttaaggcagattgaaattgctgttatgcagtatcgtgaatctcttgaggagaagggtttgcgaaacacagaagagattgagaagaaggttgccagccaccgtaggcgtcttcagtctgaatatggtttatcattttcaaatgatggtgcaaacagcaggcgctcttctgagaggacatcgtcggagcggagagataggcatgatgattcttcaagaaagcgtcatcgaagcctgagcaggagccgtagtcctccaaggagatcactggaaagagatcgagagcacaatcgcaacagagacacagacagatctcatggtaatgatgctggacgagagagagacagggtacgtgaaaaaagcgcaagccgagggagggatgatcactatgatagaagcagagacagggagaaggacaggagaaagggaaggtgattgatgcctgcaaaatctcttgcattcatccccttgcctgaataaggtgcagtgtgatatcctgtgccaggttgcatcagttaaaatctgttgcatatatgaagagtatctggcctgccacctgccgcatggcttgaagaacctgtgtattgagtgccctactcatgtagcttgaaaaacagggacagcgtgtgaaaaatagaatattatcaagtggaactgcggaagtagtgcattgaaactctccgccttgtggtggacgaccgcagctaggaactttgctttggtgacaaatgaagtcaagagagttgctttggcgacattgtccatttttattcattgatgaaatcaacgagtgtagttgactaagtaatccttttttttttttacaatttctgctatgctctagtttagttgctatggtagaggtagtatagtgatagtaggggtcaaactgggtatgttttgtcagattgaaggtgcattattctcatcctttgcgtttgtataattgtatcttaccagtctggtcaggttagctatgctgctatttttacctcccttcgaatccagtatacacaaactgaacaaa

SEQ ID NO: 3649 - DNA, 3291 bp, Zea mays
cgtgcggccgtgcggcctctctctttctttcccagcgccaccgccgacctagccaggtgaccaggtcttcgtcaggcccatagccagcgacgaacacctaagtacccaacagatgagttcgaagaaggttccgtaccacaagcatagggaggctgaggaggcgaggaagaagagggaggaagatgaagcagcacgtgtatatgcggaatttgttgagtccttcaaaggtgatagctcatctggggctaagtttatccgaggtggtgtgatcgaccccaatgcaaagctgaagactgactcggaaggtggaaaatccaaagatggggggtctgttccaaagaagggcagtaggtatgttccatccttcttgccaccatcatttgcaaaagagcctgagaaaaagaaggaaggggagaggccaaaggaaaaggaaaagggaaagccacgagtaatagatagattcttggaggaaatcaagcttgaacaagagcagcgagagaagcgccatcaagatcgagatcaccgccgtgaaggtcgccatggcgatagctccatgtcctcgagccggtttgatgaactaccagatgaatttgatccgactgggagatttccaggatcatttgatgatggtgatcctcaaaccaccaacttatatgttggcaatctatctcccaaggtcgatgagaattttcttttgaggacatttggtcggtttggacctattgctagtgtcaagattatgtggcctagaacagaagaggaacgcagaaggcaaagaaattgtggttttgttgccttcatgaatagaacagatggacaagcagcaaaggatgaaatgcaaggtgttattgtgtatgactatgaactcaagattgggtggggtaaatctgttgctcttccgtcacaggctttgcctgctcctcctccaggacacatggcaatcagaaataaggagggtggtacagctacagtcatactttctggtcctggtggccctgctgttgcatctattaaaccacaaacctcagagctggtccttacaccaaatgttcctgatattgtggttgctccacctgatgatgggcatcttcggcatgtgattgacacaatggctctgcacgtacttgatggtggatgtgcttttgaacaagctgtaatggagagagggcgaggaaatcctttatttgatttcttgttcaatcttaaatctaaagagcacacatattatgtttggaggctatactcatttgcccagggtgatactctacaacgatggagaacagaaccctacatcatgatcaccggaagtggaagatgggtcccacctcccttgtcgtccaacagaagccctgaacgtgaaaaggaatctacatttgctgctggtagaagcaggcgtgttgaagtggagcgtacattgactgactcacagcgtgatgaatttgaggacatgctgcgagctttgacattagagaggagccaaataaaagacgccatgggatttgccttggataatgctgatgcagctggcgagattgttgaggttcttacagaatccttgacactcaaggagacgtctattccaacaaaggttgctcggcttatgctagtgtctgacatccttcataacagtagcgctcctgtgaagaacgcatctgcattccgaacgaagtttgaagcttctttgccagatgttatggagagctttaatgacttgtatcgcagtatcactggaaggattactgctgaagccctgaaggagagggttatgaaagttctacaagtttgggcagactggttcctgttttctgatgcatttcttaatgggctgagggctacttttcttagatcaggcaactctggtgttgttccgtttcactcgttatgcggtgatgcacccgaaattgaaaagaaaggtagctctgaggatggaaatgatggatttaagcttaatgaagacggtgccttggctactggaaaggcagcagcgacaaaggagctattagggctcccactagctgaacttgaacgccgctgtagacataatggcctctctctgtgtggtggtaaagaaatgatggtcgccaggctgcttaacttggaagaggctgagaaggaacgaatatacgagaaagatgttgacatgaaatatgtgcagggtgaacagcatgtggttggaagagaggacagtggtgtgaatgctcatagtacttcaaggtttggtgaaggttctaatggtgatgaattagatgtctctcggaacagtacgagagctggtaaaggacgttctggtggatctgcttctgccgaacttgaatcatttccaagcaagaagccgaaatacgatcctgttttgccagcttctaaatggagtcgagaggatgacatcagtgacgatgaagataggaaaggtggccgaggcttgggattaagctattcatccggaagcgatattgctgatggtctcggaaaggtcgatacaacagaagctagtactgaccacacaagtcgtcatcatgatacgattgttgatgaagagcacaggcagaagttgaggcagattgaaatttctgtcatgcagtaccgtgaatctcttgaggaacagggtctgcgtgacttggatgagattgagaggaaggttgccagccatcgaagacgtctccagtcagaatatggtttatccactccagctgatggtgctaacagcaggcgatcttctgaaagaacatcatcgtcgtcggagcggaaagagaggcatcgcgatgcacatgatcatcctaggaaacggggccggagccagagtagaagcttgagccctccaaggaagtcacaggagagggatcgagagcacaatcgcggtagggaccggtctcatggcaacgacgtggggagggatagggtacgcgggaaaagtgcaagccaagggcgagacgaccaccacgacagaagccgagatagagagaaggacaggagaaaagggaggtgaccgacccgaaaaccctcgtcaccatgcaccatttgccctaagcgaagggcccaggagcattatttgagctgggctacacgcccaccagcatctccaacggtaaacatatcttcgcaccaggcaggttaccctggtctgctccatgcttcgtctgtaataggagtttttgaggattaagttgaggttttttagagaagacttgttcgtaactttttttcttctttttttgcggattattcagatgtacccgatgtgtagtttatgctcaaaaccaatgtcgaatacagccagacccagaattgtcagta

SEQ ID NO: 3650 - DNA, 3280 bp, Zea mays
gcgtgcggccgtgcgtcctctctttctttctcggcgcctctgtttctggcggccgcgactggcccagcgccaccgccgacctagccaggtgaccaggtcttcgtcaggaccatagccagcgaagaacacccaagtacccaacagatgagttcgaagaaggttccgtaccacaagcatagggaggctgaggaggcgaggaagaagagggaggaagatgaagcagcacgtgtatatgcggaatttgttgagtccttcaaaggtgatagttcatctggggctaagtttatccgaggtggtgtgattgaccccaatgcaaagctgaagactgactcggaaggtggaaaatccaaagatggggggtctgttccaaagaagggcagtaggtatgttccatccttcttgccaccatcatttgcaaaagagcctgagaaaaagaaggaaggggagaggccaaaggaaaaggaaaaggaaaagggaaagccacgagtaatagatagattcttggaggaaatcaagcttgaacaagagcagcgagagaagcgccatcaggatcgagatcaccgccgtgaaggtcgccatggcgatagctccatgtcctcgagccggtttgatgaactaccagatgaatttgatccgactgggagatttccaggatcatttgatgatggtgatcctcaaaccaccaacttatatgttggcaatctatctcccaaggtcgatgagaattttcttttgaggacatttggtcggtttggacctattgctagtgtcaagattatgtggcctagaacagaagaggaacgcagaaggcaaagaaattgtggttttgttgccttcatgaatagaacagatggacaagcagcaaaggatgaaatgcaaggtgttattgtgtatgactatgaactgaagattgggtggggtaaatctgttgctcttccgtcacaggctttgcctgctcctcctccaggacacatggcaatcagaaataaggagggtggtacagctacagtcatactttctggtcctggcggccctgctgttgcatctattaaaccacaaacctcagagctggtccttacaccaaatgttcctgatattgtggttgctccacctgatgatgggcatcttcggcatgtgattgacacaatggctctgcacgtacttgatggtggatgtgcttttgaacaagctgtaatggagagagggcgaggaaatcctttatttgatttcttgttcaatcttaaatctaaagagcacacatattatgtttggaggctatactcatttgcccagggtgatactctacaacgatggagaacagaaccctacatcatgatcacaggaagtggaagatgggtcccacctcccttgtcgtccaacagaagccctgaacgtgaaaaggaatctacatttgctgctggtagaagcaggcgtgttgaagtggagcgtacattgactgactcacagcgtgatgaatttgaggacatgctgcgagctttgacattagagaggagccaaataaaagacgccatgggatttgccttggataatgctgatgcagctggcgagattgttgaggttcttacagaatccttgacactcaaggagacgtctattccaacaaaggttgctcggcttatgctagtgtctgacatccttcataacagtagcgctcctgtgaagaacgcatctgcattccgaacgaagtttgaagcttctttgccagatgttatggagagctttaatgacttgtatcgcagtatcactggaaggattactgctgaagctctgaaggagagggttatgaaagttctacaagtttgggcagactggttcctgttttctgatgcatttcttaatgggctgagggctacttttcttagatcaggcaactctggtgttgttccgtttcactcgttatgtggtgatgcacccgaaattgaaaagaaaggtagctctgaggacggaaatgatggatttaagcttaatgaagacggtgccttggctactggaaaggcagcagcgacaaaggagctattagggctcccgctagctgaacttgagcgccgctgtagacataatggcctctctctgtgcggtggtaaagaaatgatggtcgccaggctgcttaacttggaagaggctgagaaggaacgaatttacgagaaggatgttgacgtgaaatatgtgcagggtgaacagcatgtggttggaagagaggacagtggtgtgaatgctcatagtacttcaaggtttggtgaaggttctaatggtgatgaattagatgtctctcggaacagtatgagagctggtaaaggacgttctggaggatctgcttctgccgaacttgaatcatttccaagcaagaagccgaaatacgatcctgttttgccagcttctaaatggagtcgagaggatgacatcagtgacgatgaagataggaaaggtggccgaggcttgggattaagctattcgtccggaagcgatattgctgatggtctcggaaaggtcgatacaacagaagctagtactgaccacacaagtcatcatcatgatacgattgttgatgaagagcacaggcagaagttgaggcagattgaaatttctgtcatgcagtaccgtgaatctcttgaggagcagggtctgcgtgacttggatgagattgagaggaaggttgccagccatcgaagacgtctccagtcagaatatggtttatccactccaactgatggtgctaacagcaggcgatcttctgaaagaacatcatcgtcgtcggagcggaaagagaggcatggcgatgcacatgatcatcctaggaaacgtcgccggagccagagtagaagctgcagtcctccaaggaagtctcaggagagggatcgagagcacaatcgcagtagggaccgagatagggtacgcgagaaaagtgcaagccgagggcgagacgaccaccacgacagaagccgagatagagaggacaggagaaaggggaggtgaccgacccgaaaaacctcgtcactatgcaccatttgccctaaccgaagggcccaggagcatcatttgagctgggctacacgcccaccagcatctccatcggtaaacatatattccgcaccaggcaggttaccctggtctgctccatgcttcgtctgcaataggagtttttgaggattaagttgaggttttgtaaagaagacttgttcgttactttttttgtggattattaagatatatcctatgtgtagtttatgcttaaaatttaaaaccaatgttgaatacagcc

SEQ ID NO: 3651 - DNA, 2663 bp, Triticum aestivum
ggcggtctcgccgaaaccctaggagaaccccggggaggccgggatgctgcacgagctcctcctcgcccttctcggcttcaccggtgacttcgtgctcgacaactcctccgcccgccgccgccccgagccggccgaagccggtggcgccggagacggcgacgtgggccccgccttccgcctggcgcccgacctcaccttcctccagccgtccgagaggagtgctattgaaaggctcatatctctgggattttattacagagaactgaatcgttttgcgacggagtctcgtgatctgagttggattcagtcttctgttgaggtttcatcacctaatgctgatattactctgaacggcaaagtgagaaaggggagtgcataccggagggcaattgccaatggtattgctgagattttatcagtttataggtcagctgttctgcaggttgagcaaaacctgttgtcagatccattgcgtatcctggcgacagtaacccatgggctaaataagtttgaggttcttctgcctccactttatgagcttgttatggaaatcgagcagaaagacatcaagggaggacagcttcttaacctgttacataaaagatgccattgtggggttccagaattgcaaagctgcattcagaggctgctttggcatggacaccaggtcatgtttaaccagctgacttcttggatggtttatggtattcttcaagatcagtaccatgaatttttcatcagaagacaggttgacagggatgaggagaatgaatcggctcagtctgatgttgctgacaaatttgcgcagaaattagctaaagacacatcccttactagttggcactcaggatttcatgtatcattggacatgttgccggagtatatccacatgcgagttgcagaatcaattctattcgctggcaaagcaataagggttcttagaaatcctagtcctggtgctacattgctggaacgaactaaccaaagtcagacattgaaaggatctcatagaatgcaaagtttcacggggggccccggtgctctgaaagagctgccaaacttctctaacattagtgcagaagaattattgccacaggctgaagcagataaagttgatgccatgcttaagcagctaaagcatgcttccgagtttcataaaaggttgtttgagtctgctgttagctcaatacgtacaattgcagctaatcatctttggcagttagtggttgtacgcgctgatctcaatggccacttgaaggcacttaaagattattttcttttggcgaaaggtgattttttccagtgttttcttgaggaaagccgtcaattgatgcgcctaccacctcgtcaatctacagctgaagcagatctcattgtcccatttcagttggctgcactgaaaactataggcgatgaagacaaatacttcaccagggtatctctaaggatgccactgtttggtatgaaatctagtacatcacagaaagatcttcagaagtccaacacatcagatctttccttgcaaggaaaggctagctcagagttggcacttgatggttggcatagtattgccctggaatattccgtcgattggccactacaactcttctttactcctgacattctttctaagtatcgcaaagtttttcagtatctcattcggttgaagaggacacaaatggaattggagaaatcctggacagctgtaatgcatcaagatcatgttgatttttctgattattgcaaggatcggaagaattcctctgcaacacaactgcgtcggttacgcacgaagcctttttggcgagtaagggagcatatggctttcttgatcagaaacctacagttctacatccaggttgatgtaattgagtcacagtggaatgtcttacaaactcacgttcaagactcgcatgattttacagaactagtgacctttcatcaagactatttgtcggcattgatatcacagtccttcttggatataggatcagtttctagaatactggacagtataatgaagctctgcttgcagttctgctggagtatcgagcaatacgaaacaggcgcaaacatgtttgagattgatcacataactgaggagttcaacaagaaatcaaattcgttgtacactatcctaaggagtagtcgacttgcgggaagtcagagagcacctttcctgaggcagtttctgatgagactgaactttaactctttctttgagacaactgcgaggggcgtgatgaattcgggcaggctgcggccaggcacagcgagtacccagctgtaagcctagcaacgcagcggctgttctcgccgtgatttgcacgacaatgctgctacgtatcgacatggcgcaaacccatcacacaagaagacgaggaggaatctgtaggatctgtaaattagctgtagcatgtgagttgttttgccctgggaagtaaacacttggtgatgtttgtttggctagtgttgtgatgtgtacgtctttgcttgcttgcctaccttttccatgttattggtatctctattgggaacatggtgtgtggccttggatgaaatggtagcagaatagcagacctgttcagtacttcagcaacactgcaaggtttacattgcaactgttctggaaggatgaatgcaacattgaaatgaatgccaaa

SEQ ID NO: 3652 - DNA, 2700 bp, Brachypodium distachyon
cgatccgccgaaaccctaggaaaaccccagggaggccgggatgctgcacgagctcctcctcgccctcctcggcttcaccggcgacttcgtcctcgactcctcctcctccgcccgccgccgctcctcgtccgccgatgccgtgggcgccggcgacggcgatgtgggccccgccttccgcctggcccccgacctcacattcctccagccgtcggagaggagtgctattgaaaggctcatttctctgggcttctattacagagaactgaaccgttttgcgacagagtctcgtgatctgagctggattcagccttctgtagatgtttcttcacctcatgctgatgtaactctgaagggcaaagtgagaaaagggagttcataccgaagggcaattgccaatggtattgctgagattttgtcagtttatagatcagctgtcctgcaggttgagcaaaacctgttgtcagatccattgcctatcctggcaacagtaacccatgggctaaataagtttgaggttcttctacctccactttatgagcttgttatggagatcgagcagaaggacatcaagggaggacagcttcttaacctattgcataaacgatgccattgtggggttccagaactgcaaagttgtattcagaggctcctttggcatggacaccaggtcatgtttaaccaactgacttcttggatggtttatggtattcttcaagatcagtatcacgaatttttcattagaagacaggttgacagggatgtggagaatgaatcatctcagacagatgttgctgataaggttgcacagaaattagcaaaagatacatccctgactagttggcactctggatttcatttatcgttggacatgctgcctgagtatatccacatgcgagttgcagaatcaattctctttgctggcaaagcaataagggttcttagaaatcctagtcctggtgctacattgcaggaccccagtgtcttgaaaggatctcatagaacccaaagttctacagggggttctggtgctccgaaagagctgccaaacttctctaccattagtgcagaagaattgttgccacaggctgaagcagataaagttgatgccatgctcaagaacctaaagcattcttctgagttccataaaaggttgtttgagtctgctgttagctcaatacgcacaattgcagcaaatcatctttggcagctagtggttgtacgtgctgatctcaacggtcacttgagggcacttaaagattattttcttttagcaaaaggtgattttttccagtgtttccttgaggaaagccgccaattaatgcgcttaccacctcgtcagtctacagcggaagctgatctcattgttccatttcagctggctgcgctgaagacaataggcgatgaagacaaatacttccacagggtctccctaaggatgccgctgtttggcatgaaatccagtacctcacagaaagatcttcagaagcccaatacttcagagctttcctctcaaggaaaggctagctcagaattggcacttgacgggtggcatagtattactctggaatattctgtcgattggccactacagctcttctttactcctgatgttctttctaagtatcgcaaagtttttcagtatcttatccgattgaagaggacgcaaatggagctggagaaatcctggacagctgtaatgcatcaagatcatgttgatttttctgattattgcaaggatcggaaaaattcctctgcaacacaactgcgtcgtctacgcactaaacctttctggcgagtacgggagcatatggcattcttgatcagaaacctgcagttctacatacaggttgatgtaattgagtcacagtggaatgttttacaagctcacgtgcaagattcacatgattttactgaactggtgacctttcatcaagactatttgtcagcattgatttcacaatccttcttggatataggatcagtgtctagaatactggacagcataatgaagctctgcttgcagttctgctggagtatcgagcaatatgaaacaggctcaaacatgtttgagattgatcacataactgaggagttcaacaagaaatcaaattcgctgtacactatcctaaggagtagtcgccttgcaggaagtcagagagcacctttcctgaggcagtttctgatgaggctgaacttcaactcttttttcgagaccacagcgaggggagtaatgaattcaggcaggctgcggccaagcactgcgagtacccagttgtaaagcctctaaccatctgttctcgccatttgagaattacacgaagatgatgatgctaccaactgcaatgggcgacgccgccacacagagaagggaaggaagagtctgtagcaccctgtaaattatccgtagcgtgtgaattgtttaccctggtaagtaaacaccaggcgatgttggctcctgctgatgttcattgctggttttttgttttgttttgcgatcatgatcgctccttggtgtggctaacggaaggagtgtgattggctaactgctttgggcatattatgcagaaactcattttgatgtgtattgcgtgtttgttcaatcgcacttgttgccatgtcatgtttgttttggggtgctgctgagcgacattgtaatgccaaggtttcatcgggaagcatgaatagaacacccaaaacaat

SEQ ID NO: 3653 - DNA, 2718 bp, Sorghum bicolor
cttctcttctcccactatcccccatcactctctcctcgcgatctcgcggagcggaaaccctagtgaaacccccgccgcggggggcaccgagccgccgcgatgctgcacgagctcctcctcgcgctgctcggattcaccggcgacttcgtcctcgacgcctccccgccgcgccgccgcgccgcgtcccaggaagccggcggggatggagacggcgacggagacggcgaggtgggccccgccttccgcctcgcgccggacctcaccttcctccagccgtcagagaggactgctattgagaggctcatatctctgggattttactacagagaactgaaccgctttgcaactgagtctcgtgacctgagctggattcagtcttccgtagatgtttcatcacctcattctgataaaactcagaaggggaaagtgagaaaagggagtgtgtacaggagggcaattgccaatggtattacagagattctgtctgtgtacagatcagctgttctacaggttgagcaaaatctgttgtcagatccgttgcctatcctcgcgacagtaactcatgggttaaataagtttgaggtccttctgcctccactgtatgagcttgttatggaaattgagcagaaagacataaagggtggacaacttcttaatcttttacacaaacggtgccattgtggggttccagaactgcaaagctgcattcagaggttactttggcatggacaccaggtcatgttcaaccagctgacatcttggatggtttatgggattcttcaagatcagtacagtgaatttttcattagaaggcaagacgacagggatggggagaatgaatcatctcagcgtgatgtttctgataagtttaagcagaaattagctaaagacacatccctggctagttggcatacaggatttcatgtatcattggacatgttgcctgagtatatccacatgcgagttgcagagtccattctcttcgctggcaaagcaataagggtgcttcgaaatccaagtcctggtgctacattgcaggaacctgttaaccaaagccagaactctaaaggatctcatggaatgcaaagctttgtaggaggttctggtgctccaaaagaattgccaagcttctctaacatcagcgcagaagaactactgccacaaactgaagccgataaaattgatgttatgctcaaggagctaaagcattcttcggaatttcataaacggccttttgagtctgctgtcggctcaatacgcacaattgcagctaatcatctctggcagctagtggtggtacgtgctgatctcaacggtcatttgaaggcattgaaagattattttcttttagcaaaaggtgactttttccagtgttttcttgaggaaagccgacaattaatgcgtttaccacctcgtcaatctacagccgaagcagatctcatgattccatttcagctggctgcactgaagactattggtgaggaagacaagtactttaccagagtctcattaaggatgctatcatatggtatgaaaagtagtacatctcagaaagatctccaaaaacccaatgcttcagagctttcttcacaaggaaaagctacatcagaaatagcacttgatgggtgggatagtattgctctggaatattcagtcgactggcctctgcagctcttcttcactcctgatgttctgtccaagtatcgcaaggttttccagtatctcatccgattgaagaggacacaaatggaacttgagaaatcctgggcagctgtaatgcataaagaccatgctgatttttctgagtactgcaaggatcggaaaaataactctgcaacacaactgcgtcgacaacgctctaagcctttgtggcgagtaagggagcatatggcattcttgatcagaaacctgcaattttacatccaggttgatgtaattgagtcgcagtggaatgttttacaatctcatgtgcaagattcacatgattttacagagctagtgagctttcatcaagaatatttgtcagcactgatttcacaatccttcctggatattggatcagtttcaaggatactagacagcataatgaagctttgcttgcagttctgctggagcattgagcaatacgaaacccgcccaaatatttctgagattgatcacataactgaggagttcaacaagaagtcaaattcgctgtatactatcttgaggagcagtcgccttgcgggtagtcaaagagcacctttcctgaggcaatttctgatgaggctaaatttcaactctttctttgagaccaccgcaagaggagtgatgaattcaggaaggctgcgcccaagcactgcaggtgctcagctgtaacaggccgttgatgtgcgaattcatctctcgatttttacacgggagtggcggtatggtggtggttcctgcaagagacaagggaggaggttttgtagtttatgtaaattattatgatcgggtagtggttgtcattgcggatgattcatgcttgcgccgttgttgtgtttttctgtgcttccgtttgtcaatgctatccagttcgtgtggcatcaattgtacgtccgcaaactgtacgctcattcatcgtgggaatctggggacagcacagtgaaatgtaagtacatgttctttcgaatgagctgctggcacttctgagctgctgtgtgttataatatgatacctgtcgtaacaggttatgac

SEQ ID NO: 3654 - DNA, 2868 bp, Oryza sativa
gtgcgtgcgcgcgcgttcatagtggtgagtatgcgcgtgttatagacgtatgcgtttgcgtaaaaaaaaaagattggaatgctagaaaatgttcaaatagaaaaaagcccatctaaattccgccgtccccgccattttccctttttcctcactcccccatctctctctctccgtcgctcgtcgcgatctcgccgaaaccctagccaaaacccccgtgggggaggggatcggagagatgctgcacgagctcctcctcgcgctgctcggcttcaccggcgacttcgtcctcgacgccgcctcctccccgtcggccacccgccgccgccgccctgttcccccggaggccgccgccggcggcgacgtgggccccgcctccttccgcctcgcccccgacctcaccttcctgcagccgtccgagaggagtgctattgaaaggctcatatccttgggcttttactacagagaactaaatcgctttgcaactgagtctcgtgacctgagttggatcaattctcctatagatgtttcaccaactcatggtgagaaaactgtgaaggctaaagtgagaaaagggagtgcatacaggagagcgattgccaatggtattgctgagattttgtcagtttatagatcagctgttctgcaggttgagcaaaacctgttgtcagatcctttgcctatcctggcaacggtaactcatgggctaaataagtttgaagttctcctgcctccgctccatgaacttgttatggaaattgagcagaaagacatcaaaggaggacaacttcttaaccttttgcataaacgatgccattgtggtgttccagaactgcaaagctgtattcaaagacttctttggcatggacaccaagtcatgtttaaccagctgacatcttggatggtttacgggatccttcaagatcaatacaatgaatttttcattagaagacaggaagacagggacaaggagaatgattcatctcaggtggacgttgctgataagtttacgcagaaatcagctaaagagacatccctgactagttggcacacaggatttcatgtatctttggatatgctacctgagtatatccacatgcgagttgcagaatcgatcctctttgctggcaaagcaataagggttcttcgaaatcctagtcctggtgctaccttgcaggaatccatgaaccaaagtcagaatgtgaaaggatcttatagaatgcaaagtctcataggaggttcaggtgctctaaaagagctaccaaacttccctaacataagtgcagaagaattgttgccacaggctgaagcagataaaattgatgccatgctcaaggagctaaagcattcttcagaatttcataaaaggctgtttgagtctgctgtcggctcaatacgaacaatggcagctaataatctctggcagctagtggttgtacgtgctgatcttaatggtcacttgaaggcattgaaagattattttcttttagcgaaaggtgattttttccagtgttttcttgaggaaagccgtcaattaatgcgcctaccacctcgccaatctacagctgaagcagatctcatggtcccatttcaattggctgcactgaagactataggtgatgaggacaaatattttgctagagtctcattaagaatgtcatcgtttggtataaaagctagtacctcacagaaagatctacaaaagtccagtactcctgagatttcctcgcaaggaaaggctacctcagaattggcacttgatgggtgggatagtattgctctggaatattctgttgattggcccctgcagcttttctttactcctgatgttgtgtccaagtatcgcaaggttttccagtatctcatccgattgaagaggacacaaatggaacttgagaaatcctgggcagctgtaatgcatcaagaccatgctgatttttctgattattgcaaggatcggaaaaatggcgatgcaacacaactgcgccggcaacgctctaagccattttggcgggtaagggagcacatggctttcctgatcagaaacctacagttttatattcaggttgatgtaattgagtcacagtggaatgttttacaagctcacgtgcaagattcacatgatttcacagaactagtgacctttcatcaagagtatttgtcagcactaatttcgcaatccttcttggatattggatcggtgtctagaatactagacagcataatgaagctctgtttgcagttctgctggagtatcgaacaatacgagaacaggagaaacatgcttgagattgatcacataactgaggagttcaacaagaagtcgaattcgctgtacactatcttaaggagcagtcggcttgcagggagtcagagagcgcctttcctgaggcagtttctgatgaggctaaattacaactctttcttcgagaccactgctaggggggtgatgaattctgcaggcggtaggttacggccaagcactgcaggtacccagctgtaaccatcatcgttctaagaagcgccttttctttctggtttgtgattttacacgaagggggagaatttgtagctgatgtaaatcatgacactagcatcttaatggaagtttgccctgtaaagtgtgagtgctagattatggttgttttgtgctgatggtgtgtgattgtgctagcttgtctacatttctcgctttgtcgtctgctaatgccagccttttcaacctttgagcgttggattaagccattggacgccatcagatcgtgtccttgggtaaattatgggtgttaacctgggttaactacaattaaccagatgtagatcagcttgtcaacgaagtagagcacaattaaggcccttgtttcattttca

SEQ ID NO: 3655 - DNA, 2802 bp, Zea mays
cccttttccttctcttctcccactctcactatacccatttctcgagatctcggcgaaaccctagtgaaacccccgccgtgggggcaccaagacgccgcaatgctgcacgagctcctcctcgcgctgctcggcttcaccggcgacttcgtcctcgacgtctctctgccgcggcgccgcgccgcctcccaggacgccggcgaggatggaaacggagacggtgaggtgggcccctccttccgcctcgcgccggacctcaccttcctccagccatcagagaggactgctattgagaggctcatatctctgggattttactacagagaactgaatcgctttgcaaccgagtcccgcgacctgagctggattcagtcttctatagatgtttcatcacctcattctgataatacccagaaggggaaagtgagaaaagggagtgtgtacaggagggcaattgccaatggtatcactgagattctgtcagtatacagatcagctgttctgcaggttgagcaaaaccttttatcagatccgttgcctatcctcgcgacagtaactcacgggttgaacaagtttgaagtccttctgcctccactgtatgagcttgttatggaaatccagcataaagacatcaagggtggccagcttcttaatcttttgcacaaacggtgccattgtggggttccagaactgcaaagctgcattcagaggctactttggcatggacaccaggtcatgttcaaccagctgacatcttggatggtttatgggattcttcaagatcagtacagcgagtttttcattagaaggcaagatgacagggatgtggagaatgaatcatctcagcgtgatgtttctgataagttaaagcagaaattagctaaagacacatccctggctagttggcatacgggatttcatgtatcattggacatgttgcctgagtatatccacatgcgaattgcagagtccattctcttcgctggcaaagcaataagggtgcttcgaaatccaagtcctagtgctacattgcaggatcctgtaatcagaactgtaggatctcatggaatgcaaagctctgtaggaggttctggtgtaccaaaagaactggcaaacttctctaacatcagagcagaagaactactgccacaagcagaagctgataaaattgattctatgctcaaggagctaaagcattcttctgaatttcacaaacgaccttttgagtctgctgtcggctcaatacgtacaattgcagctaatcatctctggcagctagtggtggtacgtgctgatctcaacggtcatttgaaggcattgaaagattattttcttttagcaaaaggtgactttttccagtgttttcttgaggaaagccgccaattaatgcggttaccacctcgtcaatctacagccgaagcagatctcatgattccatttcagctggctgcactgaagactatcggtgaggaagacaagtactttaccagagtctcattaaggatgctatcatatggtatgaaaagtagcacgtctcagaaagatctccaaaagcctaatgcttcagagcttccttcacaaggaaaagctgcatcagaattgacacttgatgggtgggatagtattgctctggaatattctattgactggcctctgcagctcttcttcactcctgatgttctgtccaagtatcgcaaggtttttcagtatctcatccgattgaagaggacacaaatggaacttgagaaatcctgggcagctgtaatgcataaagaccatgctgatttttctgattattgcaaggatcggaaaaataactctgcaacacaactgcgtcgacaacggtctaagcctttgtggcgagtaagggagcatatggcattcttgatcagaaacctacaattttacatccaggttgatgtaattgagtcacagtggaatgttttacaatctcacgtgcaagattcacatgattttacagagctagtgagctttcatcaagaatatttgtcagcgctggtttcccaatccttcttggacatcggatcagtctctaggatactggatagcataatgaagctttgcttgcagttctgctggagcatagagcaatatgaaactcggccaaatatttctgagattgatcacataactgaggagttcaacaagaagtccaattcgctgtacactatcttgaggagtagtcgcctcgcgggtagtcagagagcacctttcctgaggcaatttctgatgaggctaaattttaactctttctttgagaccaccgcaaggggagtgatgaattcaggaaggctgcgaccaatcactgcaggtgctcagctgtaacggtgatggtatgtttgggggtagtgctgcagcaagagacaagggaggagtttctgtagtttatgtaaattatgatcggatggtggttgtctgtcatggaaaaatcgattgcaggtgattcatgcttgtgccgttggtattgtgtttttctgtgcttccgtttgttaatgctatccagttcctgtggcctgaactgtaccttcgcaaattatacgctcgttcaccgtggggatctggctgacagatagtgaactgctgccactctttttttttttactaaggccgctgccacttctgagctgtgagatgccatgtctatcaataataacggtaaggagtattctaaaagattttgagctgtgggcagatgaatgtttaggacatatggattggaggggattgaagattaaatcctctcctatttaattttaactagtaaaggattttatccatttaaaa

SEQ ID NO: 3656 - DNA, 2472 bp, Triticum aestivum
tggccgacgcgacggcatggcctaccaccacctcctcgtcgtctcgccgccggcgcagccgccgccgccgccgcggcgcctctcactactctcccgctcgccgcggggggccgtcacagccgctgcctcgcccgacgccgcccgctcctcgtcggtggtggcatcgtcggcggccacgcgaaggagggccgtgctcctggtcgggatctccgtgctcccgctcctgcgcctccgtgacgcggcgacctccgcagcgcagccctcagcggtcgatctcgtcactgataaaatggacattcagatgtctgaggaaatgcagcctgaagaaactagggctggaccacctcagcctgaggtgaaaaggccatctccagggaatccacttgctagtcttctgaatacaattgcagttattgcttctgggcttctggctgggcttcttggtactactcaacgtgaaaagaaggccttgcagtcagccatctcatctatggagatcaaattggctgaagatgaggcagcgatgtctttgcttagagagaactatgagaaaaggctattggacgaacaagtggcacagaagaaacaagctaggatgttccaggacgaggaagcttctcttcttgatcgattggcctcaactaagagaactgtaaaaaatttaaatgaggaagttatgaaggagaaggagctagttgaacagcttaaacatgaaatacatgatcttgagattagcattgcacaagcagaggaagacaaacatgcgtttgaagaaaatttgagggacaagttggaaacacttgatattttacatggcaaggtaaatctgcttagccaagatgtaaatgacaaggaggaaaacattacagaactcagttcatcactttcaaccaaggaaggagactaccagagcctgcacttgatgtttaatcagactaaagagagcctggaacatgcaaattctagaatggagcaactggagaagtatgtttatgcagctaaaaatgatataaaatcaaagatatcctcaattgattcattgaatgaggatgtccaaacattgtgcagtgcaaagagtgatgccgaggaaaaaataagcgagttaatgaaacagtacacggaattggaaactgcttctaagatgagggcctctcgcgattctgaactattgtccaataaagatggtcagctcaatcaactcgaagaacgactttctactgcattaagtgactctagtgaagacagaagtataattgccgagttaaacagtgaattggaagctaacagaacaatgctactcaatgaagttgagacccggaaaaaaatgtcggatcttgttcagtccactgaagatgcacttaaagaatccagaaatgagttgttcaaactgtccgaagagcttaatgcagtaaatatatcaaaccatgacttgacaacccagatttcagaattcacaaatgagtctaatgaagtgaaacaggctctgactaagaaagtagaagaagcggaatcagtttctaaagctctttcagatgaattggcctcagtgaaggagatacatcaaaagacacaagaagatcttgaagtcacctctaatcaattggtgtctattacagaagtgcatgatgaacttagtaaagaattgctggatacatataaaaagttagagtccacaacagatgagcttgttagagaacgaaggattaatgctactttaaagagggagcttgaggcattggtgaaacaatcacaggtggaatctgaagctagaagagctcttcaagcagacttggatgaggccactctttcactaaatgaggtgaatgagagtacattatttctgtctaataagcttgatagcactgtttccaggatttctgctattaaagaagagaaagaggttctttcagcggctctttcggagcaaaagaaaagtacagccgaagctcagaaaaatatggtggatgctcagcatcttattaaaaggcttgggatggagagagagaatagtgaaatcaggagtacaaagcttgaagaggaattggccacagcaaaaggtgagatgttatatctgaggaggcagattactgcaagtgggtcacagaatacagatgttttggaagcaagcccaacaccaaatttcaaccaatctccggaagatcgtgttccaaataccagtagtactgatgctgtacctcctcgttctgctaagaagatttataggagaagaaaagacagaccatcaacatgagcattaccagaacatgtgatctaggaccatctatctttcatttgctctcattttagcactttatgagaaatgttcttatttaacttccaacatttgaaagctagcatgttagactaccctatagtagctccaactctttttgttgaagctctaaaagaagacccttctggtttccatgatccatatgctagattgtgagggaattgcaaatgtatgttaat

SEQ ID NO: 3657 - DNA, 1076 bp, Triticum aestivum
aggaccgtaaaaatggcagcatccctgccgtcgctcccgcccccgccgacgccgtcgccggcggccaccaccctggccagcaacctcctctccttcccggcgccgcggccgcgcctcgccgccacgcaccgccgcgcggtcgtggccgccgcctcgtccaggccccctccccctccccctccgccgccgtccccggagggaggcgacgaggaggtggagagggccatggggatggacggcggcatccccgggacatccggcgagctgctgcgccgcgtctcctcccgcgcctacggcatgcgccgccacctcatggagtcgctcgactccctcgcctacgacgtgttggagacaaacccatggagagaacaacacccgaaaccagtctatgtgctggctagaagagacaatcaactatggacaatgaaaacccgtaggaaccgcagcgaagtcgaaagggaacttggaatgcttttctcaaagggaggaggttcaggagttgggactaaatcaaagtactctggctccaagtttagtatggttgttgaagatctcacagagggagtactggtgtttgaagacgaggacgatgctgcaaagtactgtgaccttctacagggtggtggtcaaggatgtgaaggaattgcagagttagaggcttcatcagttttcaacatgtgccgtcaaatgaaagctctcgccgtccttttccggcgtggaaggactcctccaacgcctcaaagcctcgagcgtgacttgagggcgagaaaccggtcactggaagactagtatctttgggatacatacacggtgtagatatgttaattgcattcttctagctgttgaagcacaggccctatgccttgtatactaaatggtacatagatgattcaagccacaaaaaaaaaagggtaaaaaataactggtatatagattcaatgatagccaagatggagtggaagtcaagtctgactgagtacatatttagcttgagattagcaatctctgtaaaactgaatattcttgtaattatttacattctatttacagtgaataaatgagattttaagttacta

SEQ ID NO: 3658 - DNA, 1089 bp, Pseudoroegneria spicata
ctccaactcccctcgccttcctctgctgcggtagaccgtaaaaatggcagcatccctgccgtccctcccgcctccgccaccgtcgccggcggccaccaccctggccagcaacctcctctccttccccgcgccgcggccccgcctcgccgccacgcaccgccgcgcggtcgtggccgcggcctcgtccaggccccctccacctccgccgccgtccccggagggaggggacgaggaggtggagagggccatggggatggacggcggcatccccgggacctccggcgagctgctgcgccgcgtctcctcccgcgcctacggcatgcgccgccacctcatggagtcgctcgactccctcgcctatgacgtgttggagacaaacccatggagagaacaacacccgaagccagtctatgtgctggcaagaagagacaatcaactatggacaatgaaaacccgcaggaaccgcagtgaagtcgaaagggaacttggaatgcttttctcaaagggaggggcttcaggagttgggactaaatccaagtactctggctccaagtttagtatggttgttgaagatctcacagagggagtactggtgtttgaagacgaggatgatgctgtaaaatactgtgaccttctacagggtggtggtcaaggatgcgagggaattgcagagctagaggcttcatcagttttcaacatctgccgtcaaatgaaagccctcgccgtccttttccggcgtggaaggactcctccaacgccgcaatgccttgagcgcgacttgagggcgagaaaccggtcactggaagactaggatcgttggatacacggtgtatatatgttaattctattcttctagctgttgaagcacaggccctaggccttctatactacctggtacatagatgattcaagccacacacaaaaaaacatgaaaaatagctggtacatagattcaatgatagcaaggagtggaagtcaagcctgacagtgagtacatatttagcttgagattagcattctctgtaaaactgaatattcttgtaattattgacattctatttacagtgaataaataagattctaaagtta

SEQ ID NO: 3659 - DNA, 1056 bp, Triticum aestivum
gcacgagctctgctccgctaggaccgtaaaaatggcagcatccctgccgtcgctcccgcccccgccgacgccgtcgccggcggccaccaccctggccagcaacctcctctccttcccggcgccgcggccgcgcctcgccgccacgcaccgccgcgcggtcgtggccgccgcctcgtccaggccccctccccctccccctccgccgccgtccccggagggaggcgacgaggaggtggagagggccatggggatggacggcggcatccccgggacatccggcgagctgctgcgccgcgtctcctcccgcgcctacggcatgcgccgccacctcatggagtcgctcgactccctcgcctacgacgtgttggagacaaacccatggagagaacaacacccaaaaccagtctatgtgctggctagaagagacaatcaactatggacaatgaaaacccgtaggaaccgcagtgaagtcgaaagggaacttggaatgcttttctcaaggggaggaggttcaggggttgggactaaatcaaagtactctggctccaagtttagtatggttgttgaagatctcacagagggagtactggtgtttgaagacgaggacgatgctgcaaagtactgtgaccttctacagggcggtggtcaaggatgcgagggaattgcagagctagaggcttcatcagttttcaacatgtgccgtcaaatgaaagctcttgctgtccttttccggcgtggaaggattcctccaacgcctcaaagccttgagcgtgacttgagggcaagaaaccggtcactggaagactaggtggatctttggagacacacggtgtagatatgtcaattgtattcttctagctgttgaagcacaggccctatgccttgtatactaaatggtacatagatgattcaagccacacgaaaaaagggtgaaaaataactggtatatagattcaatgatagccaagatggagtgaaagtcaagtctgactgagtacatatttagcttgagattagcaatctctgtaaaactgaatattcttgtaattatttaca

SEQ ID NO: 3660 - DNA, 1087 bp, Brachypodium distachyon
gccgtgccgtgtccacgtttcactcccaagtcccaactcctcccaccttccactgttccactagaccgtaaaaatggcagcttcctttccgtccctcccgccgccgccgtccccggcggccaccgcgctagccagcaacctcctctccttccctgcgccgcgggcccgcctcgccgccgcgccccgccgagcggtcgtcgcggcggcctcgtccaggcccccacctccgccgtccccggaagggggcggcgaggaggaggaggaggtggagagggccttgggcatggacggcagcatccctgggacttccggcgagctgctgcgccgcgtctcatcacgcgcctacggcatgcggcgccacctcatggagtcgctcgactccctcgcctacgacgttctggagacaaatccatggagagagcaacccaagccagtctatgttctggctagaagagataatcaactatggacaatgaaaacccgcaggaaccgcagtgaagttgaaagggaactcggaatgcttttctcaaagggagggggttcaggagttgggactaaatcgaagtatggctccaagtttagtatgcttgttgaagatatcacagagggagtactggtgtttgaagacaaggatgatgctgtaaaatactgtgaccttctacaggggggtggtcaaggatgtgagggaattgcagagctagaagcatcatcagttttcaacatttgccataaaatgaaagctcttgctgtccttttccgccgtggaaggactcctccaatgcctcaaagcctccagcgtgacttgagggcaagaaaccgttcattagaagactaggatgtttggtttacagtgtatagatctgttaattgcctctagctgttgaagcaaaggcctacatggtacatagattcaagttgaaaaagagatacaaaaaaaaattggtacatagattcaatgattatggaagtcaagtctgacagtaaacacataaattagcttcagattagcaggctgtgaagctgaatattcttgtatttgtgtacattgtttacagtgaataaatgagattttaagttactgagtact

SEQ ID NO: 3661 - DNA, 1115 bp, Sorghum bicolor
caactgtccacgtttcactcctcgcacttgtccgcctcgtcgcctcgcttttttttgtggaacgtagaatggcagcttcctcgccgcccctcccgccgccgccgccggcagcgtcctccaccacgctggccggaaacctcacggcctcctcgctcctgtccatcccgcgcccgcgcccgcgcctcgccgcggcgcaccgccgggcggtcgtggccgcgtccgtgtcgccacggccccggcccccgcagccgtcgccggagggggacggcgacgagaaggaggtggagagggcgatggggatggacggcggcatacccgggacctcggacgagttcctgcgccgcgtctcctcccgcgcttacggcatgcggcgccacctcatggagtccctcgactccctcgcctacgacgtattggagacaaacccatggagagaagattccaaaccagtctatgtgctggccagaagcgataaccacctatggacaatgaaaactcgcaggagccgcaacgaagttgaaagggaacttggaaagcttttctcaaagggagggggttctggagttggaactaaatcaaagtactctggctccaagtttaacatggttgttgaagatatcagagagggagtactgatatttgaggatgaggacgatgctgtaaaatactgcgaccttctgcagggcggcggtcaaggatgcgagggaattgcagagatagaagcatcatcagttttcaacatgtgccgtaacatgaaagcccttgctgttcttttccgccgcggaaggactcctccattgcctcagagcctggagcgtgacttaagggcgagaaagcggtcaccactggaagactagagctgtctgtttacactgtatagaatcgttaattgtattcatctagctgttggaagcatgggccctaggccttgtatacaacatagtagtacatagtagtccctagctgaaatggaaccagacgagtctgacagcaaacacagacgaaattgctcgataccagaagtttctttgaaattggattggatggatactcttgtaattatgagcaacattgttacagtgaataaaatgtgatacatcaagttatttattatc

SEQ ID NO: 3662 - DNA, 2136 bp, Setaria italica
cacttctccgctttctcgcctcgctttgttgcttttggaacgtaagaatggcaacttcatcgccgtccctcccgccgccgccgccggccgcggcctcgaccacgctggccgggaacctcacggcctcctccctcctgtccatcccgccgccgcgcccgcgcctcgccgcggcgcaccgccgggcggtcgtggccgcggccgcgtcgccccgccccccgcccccgccgtcgcaggagggggacggcggcgacgagcaggaggtggagagggcgatggggatggatggaggcatccccgggacctccggcgagttcctgcgccgcgtctcctcccgcgcctacggcatgcggcgccacctcatggagtcactcgactccctcgcctacgatgtattggagacaaacccatggagagaagattccaagccagtctatgttctggccagaagtgataaccatctatggacaatgaaaactcgcaggagtcgcaatgaagtcgaaagggaacttggaatgcttttctcaaagggagggggatcaggagttgggactaaatcaaagtactctggctccaagtttaatatggttgttgaagatatcagagagggagttctggtatttgaggatgaggatgatgctgtaaaatattgtgaccttctgcagggtggcggtcaaggttgtgagggaattgcagagatagaagcgtcatcagttttcagcatgtgccagaaaatgaaagcccttgctgttcttttccgccgtgggaggactcctccgttgcctcaaagcctcgagcgtgatttaagggcgagaaagcggtcaatggaagattaagattgattaagatcgttggttacactgtatagaactgttacttgtattcatctagctgttgaaaccatagaggccctagaccttgtatactgggtcgtacatagatctccctatctgaaatgaagaggctactctgacagtaaatacagacgatagctcaacaccagatctctctttgaaattgaatgttcttgtaattatgtacattccaaagctccattttacaataaacaaatgcgatccatcaagtcattcttagtctggtgtcatcaaacttgtgaatggtacaaggggttggcaaccctgttgatgacacggccaatccaaagaatccgtagtcataggctcatgcctgctgctttgcctagagttaccggagctgtgaaatgtgactgtgagtgcctcaaaattcagggcgaagtgcgcctctcagtcagcttctccctcctgtacttcttgaaatctgccgccagccctgtatcgaagtcttgcttcatctgctccgccataccgtctcgccgacgcctcggatgatgctctccgggaccatggcgagcaccggcgggaggttgaagccgacggtcatctcgacgtggcccctgaggctcttcctcccctcccgctgcgggtacatcaagccccggacggtgagggcgaggtgcgacggcatggcgttgctgtccagaccgttcagcttgtaatcagtcacttccatgaggaggaggctggtggcgtggacggggacgttgggcgggtactccttcccgccggattttctggcgaagcgcatcacgatcaccggcgacgccgagaggaagaggaactggatgggcagaagctggacgctccattcttcatcattgagctttcttctcttgcgctgatccggaaacacagctccaacgatcctgggactgttctgcaggtactcatcgatggaagccccttgtgtttcactcatagggatgtcggtgttgaacctgtaggagaaggtgaacaggtctctgggattgatcttctccctcgacctgccgccatacgaaggcgtcttcagagcgcatgtcgtgaacgaccgcggcgatggacagttctgaaaagggccctttcttgatcttgagcttgatctctgatctcccaccgatctgagtgttgtgctcgctcctgatccagcacccctatacactggatgagctgcaagatggcatgaagggaggtgtagcattgtcatctctagcttgtaatggcaatctttctcgctcttctcctcctaatagctgctcgagtttatggggcttccctgatc

SEQ ID NO: 3663 - DNA, 1223 bp, Oryza sativa
acgttccactcttctcttctcccgattttactcccaactttttttttcctctctctctctctctcgattttctcatctccactgctccacgcttccagggaagaacgtagaaatggcagcttgcttgccatccctctcaccgccgccgcatcaggcgccggtgccggcggcgacgaccgcgctggcggggaacctgacctcgtccctcctctccctgcccccgccgctgccccgcctcgccgtctcgcaccgcagggcggtggtcgccgcggcctcgtcccggcccccgcccccgccatcgcgggaggggggtgatggtggtggtgaggaggaggaggaggtggagagggcgatggggatggacggcggcatccctggcacctccggcgagttcctgcgccgcgtctcctcccgcgcgtacggcatgcggcgccacctcatggaatcgctcgactccctcgcctacgatgtgttggagacaaacccatggagagaagactccaaaccagtctatgtactggctagaagagataaccatctatggacaatgaaaacccgtaggagtcgcagtgaagttgaaagggaacttggaatgctcttaaagggagggggttcaggagttgggactaaatcaaaatactctggttccaagtttaacatgcttgttgaagatatcagagagggaatactggtatttgaagacgaggacgatgctgcaaaatactgtgacattctacagggtggcggccaaggttgtgaggggattgcagagatagaggcatcatcggttttcaacatctgccataaaatgaaagctcttgccgtccttttccgtcgtggtaggacccctccattgcctcaaagccttgagcgcgacttaagggcaagaaagagatcattggaagactagagtctttctgatacatagtatagaacttctaattgtatattcgtctagctgttgaagcaaaggccctaggccctgtatactacgtggtatgtagatccacaatagcacgtggtacatacatccacaatagcctaagaggaaaggaagtcaaatctgacagaaaacatgtccaatagctcgagatattaacaatctcagtaaattgattattcttgccattatgtacattctaaatgcttcagtttacaatgaataaatgagatctgttaagttattctctccatcttttcttgaggcttgatgaacaatacaa

SEQ ID NO: 3664 - DNA, 1625 bp, Brachypodium distachyon
atcccactccacctccgccgccccaccatgtacggcgtcggcggcggcggaggcggcttcaacgcttcctccacggcctccggccggcggcgaaaccaggaagaagacgaggaggacgacgaggaggagaccggcgacggccgcgtcctcgaggcctgggagcgcgcgtacgcggacgaccggtcgtgggaggcgctgcaggaggacgagtcgggcctactccgccccatcgacaccaagaacctcgtccactcgcagtaccgccgccgcctcctcctccgctccgcggccgccgcagtccgcatccagaagggcctcatccgctacctctacatcgtcatcgacctctcccgggcagcttcagagatggattatcgtcctagtcgaatggccgttgttgcaaaatgcgccgaggcattcattagggaattctttgaccagaatcccttgagccatgttgggctagtgacaatcaaagatggcatttctcatcgactcacggacattggtggcagtccagagtcacagattaaagcattgatggggaagcttgagtgttctggtgattcatctctgcaaaatgctctagaacttatccatggttatttgaaccaaattccttcatatggtcacaaggaagtattaattttgtactccgcactgaatacatgtgatcctggtgatgtcatggagacagtagaaaaatgcaagaaatccaaaattagatgctccgttattgggcttgctgcagaaattttcatttgcaagcatctttgtgaggagactggtggatcctacacagttgcactggatgagtctcacttcaaggaattgctgctcgaacatgctcctccaccacctgcgattgcagagtatgctgcagctaatttgattaagatgggttttccacagaggggagcagaggatcttatctccatctgctcatgtcacaagaaaatcaagtccggggctgaaggttacatatgccccagatgcaaggttaatgtatgtgagctcccaacagagtgtcgaacttgtggactaacactagttagttctccacacctggcaaggtcctatcatcatctcttcccagtagcaccgtttgatgaggtgacgttcaagctaggtcaaaagggaggacagaactgttatggctgccagcagagcctgattaactctgatagccaatctaatctccatgtccgatgtccaaaatgcaaccagcacttctgctttgattgcgatatttacatccatgagagcttgcataattgccctggttgcgagagtcagcgcagtttctcttcatagaggtgccattgtgtgcattattcaggtgttcatctttttctgagtcagagcttaggcattgttgtaagctttctcgtacactgacattgatgatggtattgttcgataatcaaacagtgtacagatatcaggcatttgtcacacctccttttagattgggttagctagttaagctacaattagaggtcgaggagctgaaagtatagcattatgctgtgaagaggcgttagaaatgtacaacgggactgaaacttggtagttcttgctgtttttctgaagcaagatcaatatatgttatttttcttcagtac

SEQ ID NO: 3665 - DNA, 1619 bp, Sorghum bicolor
cacccctacccctacaccatgtacggcgtcggcggcggtgggggcggcttcaacgcgccctccaccactgccggtcggcgccgcaacccgggcgacgaggaggaggacgaggaggaggagggcggtgagggccgcgtcctggaggcgtgggagcgcgcgtacgcggacgaacggtcgtgggagtcactgcaggaggatgagtcgggcctcctccatcccatcgacaccaaggccctcgtacactcgcagtaccgccgtcgcctcctactccgctccgccgcggcagccgctgcccgcatccaaaaggggctcatccgctacctctacatcgtcatagacctctcccgggcggcttcagagatggattatcgtcctagtcgaatggcagttgttgcaaaacatgctgaggctttcataagagaattctttgaccagaatccgttgagccatgttggcctagtgacaattaaagatggtattgcccatcgacttacagaaattggagggagcccagagtcacagattaaggctttgatggggaagcttgagtgttccggtgattcatccctgcagaatgctctagaacttgttcatggttatttagatcaagtaccatcatatggtcacaaggaagttctgattttatactctgccctgaatacatttgatcctggtgatatcatggagacaataacaaaatgtaagaagtcaaaaattagatgctctgtcattggtcttgctgcagagatcttcatttgcaaacatctatgtgaagagactggtggatcctacacagttgcgctggatgagtctcatttcaaagagttgttactggaacatgctcccccacctccagcaatagcagaatatgctgcagctaatttgattaagatgggctttccacaaaggggtgctgaggatcttatatctatttgctcttgtcacaagaagataaagtctggggctgaaggttacatatgtcctagatgcaaagttaatgtgtgtgagcttccaactgaatgtcgaacttgtggtcttacactagttagttctccacacttggcaaggtcatatcatcatctcttccctgtagcaccgttcgatgaggtcacccctgttccaaatagaatccaaaggggaggacagatctgtttcagctgccagcagagcctttttaacccagatggccaatctaacctccatgttcgctgcccaaaatgcaaccagcacttctgccttgattgtgatatttacatccacgagagcttgcacaactgccctggctgtgagagccaacgcaacatcactttatagagacattgtgtgcattattcaggtcatacgttaagctttctcctacactgtaaccggcagcaaagttgtttcatgatcagacaatgtacagataatataatgcccggcatccttttattgacagttcctgttagattgagtagctagttgagctattgatacctcgtcagaggccaatgagtcgatagttttaacattgtgccgagaagagatgctgaaagtgtataaacatgacagacttgattcttgctgtttttttttcctgaagcaagacgatatttttattcagtttcatgacttctttt

SEQ ID NO: 3666 - DNA, 1844 bp, Panicum virgatum
ccaaaacaaagcccaggagccccaaaccagaagcacccacactggcccatctcctcctggtcccgacctcgccaccaggctccagttccgctcctgctcctcgacgccgccgccgccgccgtcgctccaccacccccacaccatgtacggcgtcggcggcgggggcggcttcaacgcgccctccactacctccggcggccggcgtcgcaacccgggcgacgaagaggatgacgaggaggaggagggcggcgagggccgcgtcctcgaggcgtgggagcgcgcgtacgcggacgaccgctcgtgggagacgctgcaggaggacgagtcggggcttctccaccccatcgacaccaagaccctcgtccacgctcagtaccggcgccgcctcctgctccgctctgccgccgccgccgcggcccgcatccagaaggggctcatccgctacctctacatcgtcatcgacctctcccgggcagcttcggagatggattatcgtcccagtcgaatggctgttgttgcaaaacatgctgaggcttttataagagaattcttcgaccagaatcccttgagccatgttggcctagtgacaattaaagacggtatttctcatcgactgacagacattggagggagtccagaatcacagattaaggctctgatggggaaacttgagtgttctggtgattcatctctgcagaatgctttagaacttgtccacggttatttagatcaagtaccatcatatggtcacaaggaagtcttaattttgtattctgccctaaatacatgtgatcctggtgatatcatggagaccatagaaaaatgtaagaaatccaaaatcagatgttcagttattggtcttgctgcagagatcttcatttgcaaacatctctgtgatgagactggtggatcctacacggttgcactagacgagtctcatttcaaagaattgttgctggaacatgcccctccacctcctgcaatagtagaatatgccgcagctaatttgattaagatgggctttccgcagaggggtgctgaggatcttatctctatctgctcttgtcacaagaagataaagtctggggctgaaggttacatatgtcctagatgcaaagttaatgtgtgcgagcttccaacagagtgtcgaacttgtggcctaacactagttagttctccacacttggcaaggtcatatcatcatctcttcccggtagcaccatttgatgacgtttcctctgtcccaaatagaatccaaaggggagcacaaaactgtttcggctgtcagcagaacctttttaaccctgatggccaggctagcctccatgttcgctgcccaaaatgcaaccagcacttctgcctcgattgtgatatttacattcatgagagcttgcacaattgccctggttgtgagagtcaacgtggtttctcatcatagttagatgccgtcacattcattattcaggtgttgtaccttattttgagtcatcatgttggactaaatctttctcagtgcattgagatcggtggcagagttgtttgatgataagactgtacagatataatgcccggcatccttttgttctgttagatggagtagctagttgagctatatcgatactgagcagaggctgaagagttgatagtttagcattatgcctagctagcagagatgctaaaattgtataacgtgactggaacgtatgactcttgctgtttttctgaagcaagactattgttattcagtaccgtgactcgggtttttacatgctgaaactaagttgatgtgtaagaatagagagatactacttcggagggacctgggtacatgtttcagttggtat

SEQ ID NO: 3667 - DNA, 2012 bp, Zea mays
tccccgaatcccgacctcgcctccagttccactcttccggcggcgtcggcggccgccccttccccacgcccacaccatgtacggcgtcggcggcggcttcaacgcgccctccaccgctgcctctcggcgccgcaacccaggcgacgaagaggaggacgaggaggatgagggcggtgagggccgcgtcctggaggcgtgggagcgcgcgtacgcggacgaacggtcgtgggagtcactgcaggaggatgagtcgggcctcctccgtcccgtcgacaccaagaccctcgtccacgcgcagtaccgccggcgcctcctactccggtctgccgccgccgccgctgcccgcatccaaaaggggctcatccgctacctctacatcgtcatagacctctcccgggcggcttcagagatggattatcgtcctagtcgaatggctgttgttgcaaaacatgctgaggctttcataagagaattctttgaccagaatccattgagccatgttggcctagtgacaattaaagatggtattgcccatcgacttacagaaatcggagggagcccagagtcacagattaaggctttgatggggaagcttgagtgttctggtgattcatccctgcagaatgctctagacctcgtacatggttatttagatcaagtaccatcatatggtcacaaggaagttctgattttatactctgccctgaatacatttgatcctggtgatatcacggagacaatagcaaagtgtaagaagtcaaaaattagatgctctgttattggtcttgctgcagagatcttcatttgcaaacatctatgtgaagagactggtggatcttacacagttgcactggatgagtctcatttcaaagagttgttactggaacatgctcccccacctcctgcaatagcagaatatgctgcagctaatttgattaagatgggctttccacagaggggtgctgaggagcttatctctatttgctcttgtcacaagaagataaaatctggggctgaaggttacatatgtcctagatgcaaagttaatgtctgtgagcttccaacagaatgtcgaacttgtggtcttacgctagttagttctccacacttggcaaggtcgtatcatcatctcttcccagtaccaccgtttgatgaggtcacccctgtcccaaatagaattcaaaggggagggcagatctgtttcagctgccagcagagcctttataacccagacggccaatctaacctccatgtgcgctgcccaaaatgcaaccaacacttctgccttgattgtgatatttacatccatgagagcctgcacaattgccctggttgtgagagccaacgcagcatcgcttcatagagaccgtgttactgcgtgcattattcaggttgtaccttaagctttctcctacactgtaacagccagcaaagttgtttcatgatcagcttttttctggctagcttttctgagaatctagctgtagagagaatctggctgtgagaagaatctgtgtatcgtgggaattacgtgcggaggaagatgaagtggtccaaatagttcaggatctagaaagcgatggatttctaccatcgcgatgattcaaccgattctgtgtttatgttgattttggatggtttctaccaaaacgattcttataaaagcgggttgaaaagctggatgtttgacagtccgcagcagcttttggtggccagaagctaaaaaaaagcccaaacaaacagggtcattccggcatccttttattgatagttcctgttagattgagtacctactagctagtgttgagctattgctacccatcagaggccaatgggttgatagttttaatttgtgccgagaagagaagctgaaagtgtataacatgaccgagacttgactcttgctgtttttttttcttccctgaagcgtgacagtatatttatttgttttcatttgtttatgctaaaactttgtcataaattgagttgtggattgggtcgggggtttcatc

SEQ ID NO: 3668 - DNA, 1419 bp, Triticum aestivum
cgcctacgccgacgaccgctcgtgggaggcgctgcaggaggacgagtcgggcctgctccgccccatcgacaccaagaacctcgtccactcgcagtaccgccgccgcctcctgctccgctccgccgccgccgcggcccgcatccagaagggcctcatccgctacctctacatcgtcatcgacctctccagggcagcttcagaaatggattatcgccctagtcgaatggctgttgttgctaagtgtgctgaggcattcataagggaattcttcgatcagaatcccttgagccatgttgggctagtgacaattaaagatggcatttctcatcgacttacggagattggagggagtccagagtcacagattaacgcattgatgggcaagcttgaatgttctggtgattcatctctgcagaatgctctggaacttgtcaatggttacttgaaccagattccttcctatggtcacaaggaagtattatttttgtactccgcactgaatacatgtgatcctggtgatgtcatggagacaatagaaaaatgcaagaaatccaaagttagatgttcggttattgggcttgctgcagaaattttcatttgcaagcatctctgtgaagagactggtggatcatatacggttgcactagacgagtcccacttcaaggaattgctgcttgaacatgctcctccaccacctgccattgcagagtatgctgcagccaatttgattaagatgggttttccacagaggggagcagaggatcttatctccatctgctcttgccacaagaaaattaagtctggtgctgaaggttacatatgtcccagatgcaaagttaatgtgtgtgagcttccaacggagtgccgaacatgtggtctaacacttgttagttccccacatctggcacgatcctatcaccatctcttccctgtaacgccgtttgatgaggtgacgttcaaattaggtcaaaagggaggacaaaattgttttggctgccagcagagtctcattaacaccggtggccaatctaatatccatgtccgctgtccaaaatgcaagcaccacttctgcttcgactgtgatatttacatccatgagagcttgcataactgccccggttgcgagagtcagcgcagttcatctaggtagagacgccgccatcatgtgcattgttcaggtgttgatccttttttgagtcggagctacgcattgttgtaagctttctggtgcactgacattgatgacagtattgctggataatcaaacagtgtacggataacacctgtcatccttttgttggcgcctcttgttagattgggctagctagttaatatctattgatgcaattagaggtcgaggtgctatgagaagagacgtgagaaatgtacaacgtgaatggaaacctgctgcttcttgct

SEQ ID NO: 3669 - DNA, 1440 bp, Triticum aestivum
  misc_feature (1)..(1): n is a, c, g, or t
  misc_feature (1027)..(1027): n is a, c, g, or t
  misc_feature (1043)..(1043): n is a, c, g, or t
ngcctacgccgacgaccgctcgtgggaggcgctgcaggaggacgagtcgggcctgctccgccccatcgacaccaagaacctcgtccactcgcagtaccgccgccgcctcctgctccgctccgccgccgccgcggcccgcatccagaagggcctcatccgctacctctacatcgtcatcgacctctccagggcagcttcagaaatggattatcgccctagtcgaatggctgttgttgctaagtgtgctgaggcattcataagggaattcttcgatcagaatcccttgagccatgttgggctagtgacaattaaagatggcatttctcatcgacttacggagattggagggagtccagagtcacagattaacgcattgatgggcaagcttgaatgttctggtgattcatctctgcagaatgctctggaacttgtcaatggttacttgaaccagattccttcctatggtcacaaggaagtattatttttgtactccgcactgaatacatgtgatcctggtgatgtcatggagacaatagaaaaatgcaagaaatccaaagttagatgttcggttattgggcttgctgcagaaattttcatttgcaagcatctctgtgaagagactggtggatcatatacggttgcactagacgagtcccacttcaaggaattgctgcttgaacatgctcctccaccacctgccattgcagagtatgctgcagccaatttgattaagatgggttttccacagaggggagcagaggatcttatctccatctgctcttgccacaagaaaattaagtctggtgctgaaggttacatatgtcccagatgcaaagttaatgtgtgtgagcttccaacggagtgccgaacatgtggtctaacacttgttagttccccacatctggcacgatcctatcaccatctcttccctgtaacgccgtttgatgaggtgacgttcaaattaggtcaaaagggaggacaaaattgttttggctgccagcagagtctcattaacaccggtggccantctaatatccatgtcngctgtccaaaatgcaagcaccacttctgcttcgactgtgatatttacatccatgagagcttgcataactgccccggttgcgagagtcagtgcagttcatctcggtagagacgccgccatcatgtgcattgttcaggtgttgatccttttttttgagtcggagctacgcattgttgtaagctttctggtgccctgacgttgatgacagtattgctggacaatcgaacggtgtacagataacacctggcatccttttgttggcacctcttgttagattgtgctagctagttaagctattgatgcagttagaggtggaggtgctgagagtagagcgttgcgttgagaagagacttgaggaatgtacgacgtgaagaatggaaacctggtagctcttgctg

SEQ ID NO: 3670 - DNA, 1865 bp, Oryza sativa
atctccccggtccccgacctcgcctctccttcctcctctgctcccactccgcctcgccgccgcctccaccatgtacggcgtcggcggcggcggcggggggttcaacgcgccctacacggcatcggcccggcggcgcaaccacgaggacgacgacgacgaggaggaggaggagtccggcgaggggcgcgtcctcgaggcctgggagcgcgcgtacgcggacgaccggtcatgggaggcgctgcaggaggacgagtcgggcctcctccgcccgatcgacaccaagaccctcgtccacgcgcagtaccgccgccgccttctcctccgctctgccgcctccgccgccgcccgcatccagaagggcctcatccgctacctctacatcgtcatcgatctctcccgggtagtaaataagatcctctttggcacagctccagatcttagatccatggcagcttcagagatggattatcgacctagtcgaatggctgttgttgcaaaatatgctgaggtattcataagggaattttttgaccagaatcccttgagtcatgtggggatagtgacaatgaaagatgggatttcccatcgacttacagagattggaggtagtcctgaatcacagattaaagcattgatggggaagcttgagtgttctggtgaaccatctctgcagaatgctctagagcttgtccatggttatttagaccaggttccttcatatggtcacaaggaagtattatttttgtactcggccctgaatacctgtgatcctggagatatcatggagacaatagcaaaatgcaagaaatccaaaatacgatgttcggttattgggcttgctgcagagatttttatctgcaaatatctgtgtgaagagactggcggatcctacacagttgcactggatgagtcccatttcaaggaattgcttctggaacatgctcctccaccacctgcaattgctgagtatgctgcagctaatttgattaagatgggttttccgcagagaggagcagaggatcttatctccatctgctcttgtcacaagaaaataaagtcgggggctgaaggttacatatgtcctagatgcaaagtcaatgtatgtgagcttccaacagaatgtcgaacttgcgggctgacactagttagctctccacatctggcaaggtcctatcatcatctcttccctgtacaaccatttgatgaggtgtcctccgtgcacccaaatagactaggtcaaaagggaggacaaaagtgttacggctgccagcaaagctttattaaccctgatagtcaatctagcctccatgttcgctgtccaaaatgcaaccaacacttctgccttgattgcgatatttacatccatgagagcttgcacaattgcccaggttgcgagagtcagcgtagttcttcatagggatgccattgtggtgttaatctttgtctttttaactcaagaagctacccgttgctgtaagctttctcgtacactgacattgctttccggtgacgagcagtggcgatcatcatgcataattacatatacgcagcatatccctggttccctacactctgatgaaagtgtgcttcctgtggctatcatgtcgactttgctaaagcgaatggatgacaggcagcggtgccagtgctccttttcaccagttgcacggccaagttgtgggcacgacgaactgcaggctgctgcaccgtcctgtgcgttttcaactgtagatcactcgagtccacttgaaagaaacacagacggcattagactgaacatctattttctaaaaaataagactgaacatgtcttcgcgctcaacagaagaagcttcagggtgggtgaaccagtgcttgttaagtag

SEQ ID NO: 3671 - DNA, 1493 bp, Triticum aestivum
gcacgagcctcccctctcctcccggccacctctccccacgcccattccccgcacggccaagggaaaatggcgccgtccacctcgtcggcctccgccctcctccacctcccgggtctgcctccccggggaccccatagaggcgggtgccggaaccacccgcggcggccgcgccatgcggccgtgcggtgctccttcgcgttcgcgcccgtggagacggcgaggataaaggtcgtgggcgtaggtggcggcggcaacaacgccgtcaaccgcatgatcggcagcggcctccagggaatcgagttttatgctataaacacagactcccaggctcttgtgaattcccaggcgcaacatccgctacaaattggagaacaattgactcgtgggctgggtactggtggaaatcctaatttgggagaacaagctgccgaggaatcaaaggaagtgatagctaatgccctccgagattctgaccttgtcttcataacagctgggatgggaggtggtactggctccggtgctgctccagttgttgcccagatagcaaaggaggccggttatcttactgtcggtgttgtcacctacccattcagcttcgaaggacgcaagcgctctctacaggcactcgaagcattggagaagctggaaagaagtgttgacactctgattgtgatcccaaatgatcggttgttagatattgctgatgagaatatgcccttgcaagacgcgtttctccttgcagatgatgtccttcgacagggtgtccaaggaatatcagacattatcacgatacctgggctcgtgaatgttgattttgctgatgtgaaagctgtgatgaaaaattctggaactgccatgctcggagttggtgtttcttccagcaaaaaccgtgcccaagaagctgctgagcaggcaactcttgcccctttgatagggtcatccattgaggcagctactggtgtcgtgtacaatatcactggcgggaaggacatcactttgcaagaagtgaacaaggtgtctcagatcgtgacaagcttggctgatccctcggccaacataattttcggagctgtggtcgacgaccgttataacggcgagatccacgtgaccatcatcgcaacaggatttccgcagtccttccagaagtcccttctggctgatccgaagggagcacggatactggaggcgaaagaaaaagcggctagcctcgcaacggctgctgcggcgcaacaaccggcggcggccgtcccgacatggtcccggaggctcttctcctgaacactgttcagcaggcaaacaaccttgcgattgtgaggctgtggttctcactttctcgaggcagtagagagttttagccggtgttattctttttggctgtgtaaacactctgaaaactagtttcgcgtagtgattaggttctcgcctagtgtatgtattgttcagacacttgactcggttgttttagaaagtgttctgttcgttgacagctttgg

SEQ ID NO: 3672 - DNA, 1546 bp, Avena sativa
ctccgcatccccatttccccacaagggcaaatggcgccgtccacctcgtcggccgccacgctcctccacctccctggcctgcctccccgcgggccccagcagcatggcgggtgccggagccagccgcggcggcggccccgccacgcggccgtgcggtgcagttcattcgcgttcgcgccggtggagacagcgaggataaaggtcgtgggcgtcgggggcggcggcaacaacgccgtcaaccgcatgatcggcagcggcctccagggtatcgagttttatgctataaatacagattcccaggctctcgtaaattcgcaggcgcaacatccactacaaattggagaacagctgactcgtgggctgggcactggtgggaatcctaatttgggagaacaagctgctgaggaatcaaaggaagtgatagcaaatgccctgagagattcggatcttgtcttcataacagctgggatgggaggtggtactggatcaggtgctgctccagttgttgcccagatagcaaaggaagccggttatcttactgttggtgttgtcacttacccattcagttttgaaggacgcaagcgctctctacaggcactcgaagcattggagaagctggaaaggagtgttgacacactaattgtgatcccaaatgatcgactgttggatgttgctgatgaaaatatgcccttgcaagatgcttttctccttgcagatgatgtccttcgtcagggtgtccaaggaatatctgacattatcacgatactgggcttgtgaatgttgattttgctgatgtgaaagctgtgatgaaaaattctggaactgccatgctcggcgttggcgtttcttctagcaaaaaccgggcccaagaagctgctgagcaggcaactcttgcccctttgatagggtcatccatcgaggcagccactggtgtcgtgtacaatatcactggcgggaaggacatcactttgcaagaagtgaacaaggtctctcagatcgtgacaagcttggctgacccctcggcaaacataatattcggcgccgtcgtcgacgaccgttatacgggcgagatccacgtgaccatcatcgcgacaggattcccgcagtcattccagaagtccgttttggccgatccaaagggagctcggatactggaggccaaagagaaagctgctagcctcgtaacggcctctgcgcaacaaccggctcccgtcccaacatggtcccggaggctcttctcctgaacacggccctgacagcttagagagctggccgttgtgattcttctggctgtgcaatgagaactagtttcacgtagtgattagctttcagacctagtgtatgtattgtttagatattgtctccggttgtttcggcacagtaagcgacagctctaagaatgcacgttgtttgctgacagattggcaaccccagggatgtgctgttgatttttgtgggtgtgtactatggaggatggccctcttcgactgagttgaatccatgtactagtactccctgcagcccatattaattgactcaaatttcc

SEQ ID NO: 3673 - DNA, 1529 bp, Brachypodium distachyon
actccaacctcaccctgccggccacaatggcgccctccacctcgtccgcctccacgctcctccacctcccgcctggcctccaccctccgcgcgggccccagcgaggcgggtggctggaccacccgcggcggcggcggccgcgccacgcggccgtgcggtgctccttcgcgttcgcgccggtggagacggcgaggataaaggtcgtgggcgtcgggggcggcggcaacaacgccgtcaaccgcatgatcggcagcggcctccagggtattgagttttatgctataaacacagattcccaggcactcgtgaattcgcaggcgcaacatccgctacaaattggagaacagttgactcgtgggctgggtactggtggaaatcctaatttgggagaacaagctgccgaggaatcaaaggaagtgatagccaatgccctgagagattcggatctcgtgttcataacagctgggatgggtggcggtactggatctggtgctgctccagttgttgcccagatagcaaaggaagctggttatcttactgttggtgttgtcacctacccattcagctttgaaggacgcaaacgctctctgcaggcactcgaagcattagagaagctggaaaggagtgttgacacactaattgtgattccaaatgatcgtttgttagacgttgctgacgaaaatatgcccttgcaagatgcttttctcctggcagatgacgttcttcgtcagggcgtccaaggaatatcagacattataacaatacctgggctagtgaatgttgattttgctgatgtgaaagctgtcatgaaaaattctggaactgccatgcttggcgttggtgtttcttccagcaaaaaccgggcccaagaagctgctgaacaggctacacttgctcctttaatagggtcatccattgaggcagctactggtgtcgtgtataatatcactggcgggaaagacatcactttgcaagaagtgaacaaggtatctcagattgtgacaagcttagctgatccttcggcgaatataattttcggagccgtcgtcgatgatcgttacaccggtgagattcatgtgaccatcatcgcaacaggattcccgcaatccttccagaagtctcttttggctgatccaaagggagctcggatacttgaagcgaaagaaaaggcggcgagccttgcatcagttggcgcccaacaacaggcacccgcccccacatggtcccggaggctattctcctgaacactgttcaggcagtgacaggcaagctaccctatgaagctgtgattctcaaagcattagaagagttgtcgcaacccggcgttattctttgtggctgtgtaaaaacacttgtgtgccgggtacaaccacctcgctaatcatccaaagattattgagtttcacgcagttattagttattagttattaggttcactgctagtgtatgtactatttcggttgtggctcacttgttcagcacattcagcgacagctttaagaatacatgcagatcgttggtagcttggt

SEQ ID NO: 3674 - DNA, 1735 bp, Oryza sativa
agccaagaagataaaacccgtctaaaaaccccccgaatcctcaaaaccctaggaggagagcacggtagatcccccatttccctcctcatctccgacgcgcatttcccccaaaagaggggagcaaatggcgtcggcggcgtgctcctcgtcggcttccgccctcgtccgcctcaccggcccgatccatctgtgcagcgccccgccccgtgggtccgcgcggcggcgccacgcttccgtgcggtgctcgttcgcgccggtggagacggcgaggataaaggtcgtgggcgtcggcggcggcgggaacaacgctgtcaaccgcatgatcggcagcggcctccagggcatcgaattttatgccataaacacagattcccaggcgcttttgaattcgcaagcgcaatacccgctacaaattggagagcagttaactcgtggactaggtactggtggaaatcctaatttgggagagcaagctgctgaggaatcaaaagaagccatagccaatgccctgaaggattctgaccttgtcttcataacggctggaatgggagggggtactggatctggtgctgctccagttgttgctcagatatcaaaggaagccggttatctcaccgttggagttgttacctatccattcagttttgaaggacgcaagcgctctcttcaggcaagtgcgttggaagcattagagaagctggaaaggagtgtagacacacttattgttattccaaatgatcgattattagatgttgttgatgaaaacacgcccttgcaagatgcgtttcttcttgcagatgatgttcttcgtcaaggtgtccaaggaatatcagatattattacaatacctggacttgtcaatgttgattttgctgatgtgaaagctgttatgaaaaactctggaactgcaatgcttggtgttggtgtttcttccagcaaaaatcgggcccaagaagctgcagagcaggcaacacttgctcctttaatcgggtcgtctattgaggcggctactggtgttgtgtacaatatcactggtggaaaggacataaccttgcaagaagtaaacaaagtctctcagattgtgacaagcttggccgatccttctgcaaatataattttcggggctgttgttgatgaccggtacactggtgagattcatgtgacgatcattgccacagggtttccacaatcctttcagaagtcccttttggccgatcccaagggtgcaagaataatggaggccaaagaaaaggcagcgaacctcacctataaagcagtggcagcggcgacggtacaaccagcgcccgccgccacttggtctcggaggctcttttcctgaacacggttcaataggaaaactagtagtttgtgtaccttagattctcatggaattactgagttggcgctccaatcaggcttctatgtgttattctttttggatatgtaaacacttaacagttacacatagtgattagcttcacttttattgtatgtatcatctagatgaggttgaggtcttcaggagttcagcagccgtcacgaatttttattgtatgttcaagacgacacttggtagttgttcgttgtaggcgcgacttgctggccaaatctattgagttgtagatgtggatgaatttgcacttgattgatcttgcatttttactcatacggagacgccacgtgactacatgatcgctctggtgtcttgagaaatccatttattcattcttgttgg

SEQ ID NO: 3675 - DNA, 1666 bp, Sorghum bicolor
cccagatccccctcctctcacctctcacgccaccccgcctcgtccccgcatttcgccaacgagaggagagagtggccatggcgtcatccgctgccgcctcctcctcggcttccgcgctcgtccgcctcccggggccgggccacctgcgcgcactgccacgaagcgggtggcgagaccacaggcggccccgtcgcgcgatagtgcggtgctcgttcgcgccggtggagacggcgcggataaaggtggtgggcgtcggcggcggcggcaacaacgccgtcaaccgcatgatcggcagcggcctgcagggtattgaattttatgctataaacaccgattcccaagcccttattaattcacaagcgcaatatcctctgcaaattggagagcagttgactcgtggactaggtactggtggaaatccaaatttgggagagcaggctgctgaggaatcaagagaagccatagccactgccctgagggattcagatcttgtcttcataacagctgggatgggagggggtactggatctggtgctgctccagttgttgcccagatatcaaaggaagctggttatcttactgttggtgttgtcacctatccattcagtttcgagggccgtaagcgctctctacaggcattggaagcattagagaagctggaaaagagtgtagacacacttattgtgattccaaacgataaattgttagatgttgctgatgaaaacatgcccttgcaagatgcatttctccttgcagatgacgtcctacgtcagggtgttcaaggaatatcagacattatcacaatacctggactcgtcaatgttgattttgctgatgtaaaagctgtcatgaaaaactctggaactgccatgcttggtgttggtgtttcttccagcaaaaatcgggcccaagaagctgctgaacaggcaacacttgctcctttgataggatcatccattgaggcagctactggtgttgtgtacaatattactggtgggaaggacatcactttgcaagaagtgaacaaggtgtcccagattgtgacaagcctggctgatccttctgcaaacataatttttggtgccgttgttgatgatcgttacactggtgagatacatgtgacaatcattgcgacaggatttccacaatccttccagaaatcccttttggctgatccaaagggagcacgaatagtggaatccaaagagaaagcagcaaccctcgcccataaagcagcagttgctgcggttcaaccggtccctgcttctgcttggtcccgaagactcttctcctgagcagtacgtttggtgaactgtgacccgtaggccattagtcttatcgtgttgagggcagtcctgaaggcgatttccagctatctggagatttatagcttcgactagcgttgatagtggtagattcagatttcagtgtatgtatcttttgctttgtgtttttgaggttccgcactgcactagttttgcagaagatctttgattacttttactgcaacaagccaacaaccttgtgttggattcttgaaccgaatgtggattcctccaagtgtttcttttttcctcgattacttgtcagggaattggtcgtgctgcaatagaaaatccgccacacctcggaatagataatcttggtttattggcctattggcttc

SEQ ID NO: 3676 - DNA, 1645 bp, Zea mays
aaactatcaaaagccctagaccacatcagatcccttctcctcaccgtgtcgctgtctcaccaatcaccacgcacctcccgtcccacatttcgccaacgacgggagagagtggccatggcgtcatccgccgccgccgcctcctcggcttccgcgctcttccgcctcccggggtcgggccacctgcgtgcaccgccacgaagcgggtggcgagaccacaggcggtcccgtcgcgcgaccgtgcggtgctcgttcgcgccggtggagacggcccggataaaggtggtgggcgttggcggaggcggcaacaacgccgtcaaccgcatgatcggcagcggcctccagggcatcgaattttatgctataaacaccgattcccaagcccttattaattcacaagcgcaatatcctctgcaaattggagagcagttgacccgcggcttaggtgccggtggaaatccgaatttgggagagcaggctgctgaggaatcaagagaaaccatagccactgccctgagggattcagatcttgtcttcataacagctgggatgggagggggtactggatctggtgctgctccagttgttgcccagatatcaaaggaagctggttatcttactgttggtgttgtcacctatccattcagtttcgagggccgtaagcgctctgtacaggcattggaagcactagagaagctggaaaagagtgtagacacacttattgtgattccaaatgataagttattagatgttgcggatgaaaacatgcccttgcaagatgcatttctccttgcagatgatgtccttcgtcagggtgttcaaggaatatcagacatcatcacaataccgggacttgtcaatgttgattttgctgatgtaaaagctgtcatgaaaaactctggaactgccatgctcggtgttggtgtttcttccagcaaaaatcgggcccaagaagctgctgaacaggcaacacttgctcctttgattggatcatccatcgaggcagctactggcgttgtgtataatattactggtgggaaggacatcactttgcaagaagtgaacaaggtgtcccagattgtgacaagcctagctgacccatctgcgaacataattttcggtgccgttgttgatgaccgttacactggtgagatacatgtgacaatcattgcgacaggatttccacagtccttccagaaatcccttttggcggatccaaagggagcacggatagtggaatccaaagagaaagcagcaaccctcgcccataaagcagcagctgctgcagttcaaccggtccctgcttctgcttggtctcgaagactcttctcctgagaagctcatttggtgaaccgtgactcgtagtgcattagatttggcatttagcgtgttgagggcagtccctaaggtgatcttcggatatctggagatttatagcttgggctagtgttcggtagtggtagaataagtttcagtgtatgtatcgttgctttgctttatgtttttgaggatcaggcggtgaggctgagagaagtgctcagcaactcaacattgaactgttgtagaagatctttgattgcttttattgctgcaacatgccaacaaccctctgttggattcgacagaatgtgggtgcctatttctccaa

SEQ ID NO: 3677 - DNA, 1529 bp, Panicum virgatum
ctccgaggctcggacctccccgccccagcatttcgccaccaacgaaggggagcgctctgtggccatggcctcgtcggctgctggatcctctgcttccgcgctcctccgccttcagggcccggcccacctgcgcgcaccgccacgaagcgggtggcgggaccacaggcggccccgccgcacgaccgcccggtgctcgttcgcgccggtggagacggcgaggataaaggtggtgggcgtcggaggcggcggcaacaacgccgtcaaccgcatgatcggcagcggcctccagggtattgaattttacgctataaacacggattcccaggcccttattacttcacaagcgcaatatcctctgcaaattggagagcagttgactcgtggactaggtactggtggaaatccaaatttgggagagcaagctgctgaggaatcaagagaagccatagccactgccctgaaggattcggatcttgtctttataacagctggaatgggtgggggtactggatctggtgctgctccagttgttgcccagatatcaaaggaagctggttatcttacggtcggtgttgtcacctatccattcagctttgaaggccgtaaacgctctctacaggcactggaagcactagagaagctagaaaagagtgtagacacacttattgtgattccaaacgataagttgttagatgttgctgacgaaaatatgcccttgcaagatgcgttccttcttgcagatgatgtccttcgtcaggtgttcaaggaatatcggacatcatcacgatacctggactagtaaatgttgattttgctgatgtgaaagctgtcatgaaaaactctggaactgccatgcttggcgttggtgtttcttccagtaaaaatcgggcccaagaagctgctgagcaggcaacacttgctcccttgattggatcatccattgaggcagctactggcgtcgtgtacaatatcactggtggaaaggacatcactttgcaagaagtgaacaaagtatcccagattgttacaagccttgccgatccttcagcaaacataatttttggtgctgttgttgatgaccgctacactggtgagatacacgtgacaatcatcgcaacagggtttccacaatccttccagaaatcccttctggctgatcccaagggagcacggatggtggaagccaaagagaaggcatcaagcatcgcccataaagcagcagcagctgcggttcaaccagtgcctgcctcggcttggtcccgaagactcttctcctgaactcagttcgttaggcaaacttccttgtggagcttgtgatttgtggggcattagagggttggcatctggcttgtcatggcagccccaaaggcgttctttagctatctggagatttatagattggttagtgttggatagtggtaggcagggtttacaaaaccggtccggtccggttcggttccggtttgggccggtaccaaaccggcccaaattcaaaattcaaatttgaattaaaaaaatgaaaaattccc

SEQ ID NO: 3678 - DNA, 1451 bp, Setaria italica
gcgtgcgccggtggagacggcgaggataaaggtggtgggcgtcggcggcggcggcaacaacgccgtcaaccgcatgatcggcagcggcctgcagggtattgaattttatgctataaacacagattcccaggcccttattacttcacaagcgcaatatcctctgcaaattggagagcaattgactcgtggactaggtactggtggaaatccaaatttgggagaacaggctgctgaggaatcaagagaagccatagccactgcactgagggactcagatcttgtctttataacagcaggcatgggtgggggtactggctccggtgctgctccagttgttgcccagatatcaaaggaagctggttatctcactgttggtgttgtcacctatccattcagctttgaaggccgtaagcgctctctacaggcactggaagcattagagaagctggaaaaaagtgtagatacacttattgtgattccaaacgataagttgttagatgttgccgatgaaaacatgcccttgcaagatgcgttccttcttgcagatgatgtccttcgtcagggtgtgcaaggaatctcagacatcatcacgatacctggactagtcaatgttgattttgctgatgtgaaagctgtcatgaaaaactctggaactgccatgcttggcgttggtgtttcttccagcaaaaatcgggcgcaagaagctgctgagcaggctacacttgctcctttgattggatcatctatcgaggcagctactggcgttgtgtacaatatcactggcgggaaggacatcactttgcaagaagtgaacaaagtgtcccagattgtgacaagccttgctgatccttcagcaaacataatttttggggccgttgttgacgatcgttacactggtgagatacatgtgacgatcatcgcgacaggatttccacaatccttccagaaatcccttctggctgatccaaagggggcacggattgcggaagccaaggagaaagcagcaaccttcgcccataataaagcagcagcagctgtggttcaaccagcacctgcctcagcttggtcccgaagactcttctcctgagcacagttcgttaggcaaacttccttgtggagctgtgacccgtaaccgtagggaactagagagttggcacggcctgccaatggcagtcccgaaggcgttctttagctacctggagatttatagcttggtttagcgttggatagtattaggttcaatttcagtgtatgtatcgtttgttttgtttgtttttgaggttcagcacagtgtggtggagtgaagtgctcagcattgaactagttctgcagaagatcttgagtacttttactgcaacaaagccaacaaccttgttagattcttgaaccgcatgcggctggctattgctcccaccgtgttggattttatcgattgcttatcaggagtcttc

SEQ ID NO: 3679 - DNA, 1402 bp, Gossypium hirsutum
gcactccacacacactatataaaagtctaaaaccctccccctaaaaagattcagcgttttgttctttacttgcagcgttgaaaagattgaaaatggctgctaccttctttaggagactctccaaagccaccccagctaccttcaacaatgcatttcgaggtcaacccaagtctggttttgctggatttcgcttcactaccatcgccgccgttgccggtggaatctctacttactactgcttctccgactcaaatttggttcatctagatcaagtcaatgaagagactggtccaaaagttgctttgaaatctgataagtggcttgaatttaagttgcaagatactgcaagagttagtcacaacactcacttgttcaggttttcatttgatccctctgctaagttgggattggatgtcgcttcatgcatccttactagggctccattaggacaagatgctgaaggaaaaaccaaatatgttataagaccgtatactcctatatcagatccagatgctcagggatactttgacttattaatcaaggtgtatccagaaggaaaaatgagtcagcattttgctagcttgaaaccaggcgatgtagttgaggtgaaagggcccattgaaaagctcagatactcacccaatatgaagaaacacattggcatgattgcaggtgggacaggcataactccaatgcttcaggttattgaggctatactaaagaaccctgatgacaagactcaggtgtcactgctttatgccaatgtctcccctgatgatatattgctcaagcagaagcttgatatacttgctgctagtcatccgaatcttaaggtactctacactgtagacaatccaactaaaacttggaaaggaggtgctggattcatttcaaaggatatggtcacaaaatgcttacctggtcctgctgaagatactcttatccttgtatgcggtccacctggtatgatggaacacatatcaggtggtaaggctaaagactattcacaaggagagctaaccggcatactcaaagaactcggatacactgagcaaatggtttacaaattttgagtatagaggaattcaaggatttgaagagacactctcatagggtttcaacataaattttgtgtaataaagcttcctgaaagaacaatgaattgggcagaatttaaatcccagggtatcgaataatatttgtagtgaaacatacaatgtaaattactacattttcacaggcttgtactagagaaatcgtgacacagagctttttatgaaaccctgcaatcaggtgttgggtgggtataatgtccgaatcagattggttacaatttgagcagttggtcattttaagcaatgattgaatagaccagactggctggtcgtagaccagttgaacg

SEQ ID NO: 3680 - DNA, 1472 bp, Theobroma cacao
aacgtggctcaccagataacgagtgaacaccttaaaaccaactccggcaagcacctcaccattcctccttcctcctggaaattggaaatctgtcaaagcactcttatacactcttaaacccttggcaaaaagaatcagctttttgttctttgcttgccccattgagagaaaagaaaatggctactaccttctttaggaggctcgccaaagctaccccaccttccttcaccgatgcatttggaggtcaacccaaggccggttttgctggatttcgcttctcagcaatcgcagccgttgctggtggaatctcctcttactactacttctccgagtcgaatttggttcatcttgatcaaatcaatgaagagacaggtccaaaagttgctctgaagtcggataagtggattggatttaagctgcaagatactgcaagggttagtcacaatactcagttattcaggttttcatttgatcccacttctaagctgggtttagatgttgcttcatgcatccttacgagagctccattaggacaagatgctgaaggaaaaacaaaatatgtcataagaccgtatactcctatatcagacccagatgctaagggatactttgacttgttaataaaggtgtatccagaaggaaaaatgagtcagcattttgctagcttaaaaccaggcgatgtagttgaagtgaaagggcccattgaaaagctcagatactctcccaatatgaagaaacacattggcatgattgcaggtgggacaggcataactccaatgcttcaggtaattgaggctatactgaagaagcctgatgacaacactcaggtgtcactgctttatgccaatgtctccccggatgatatactgctaaagcagaagcttgatatacttgctgctagccacccaaatcttaaggttttctacactgtggacaatccatcaaaaaattggaaaggtggtgctggttacatttcaaaggatatggtcacaaaaggcttacctggtcctggtgaagatactctaatccttgtatgcggtccacctgggatgatgaaacacatatctggtgataaggctaaagactattcacaaggagagctaaccggcatactcaaagaacttggatacacagagcaaatggtttacaaattttgaaattcaaggatttgaagggatgactctcgtggtttgaacataatttttgtgtaataaatgtttcctgaacgaacactaattgggcagagtttaaagccccggttatgaaataattttttagtgatattcaatgtaaagatagtacattgtcaaagcttgtaccgagtgaaatcatgatacaaagagctttacaaagtctctgcaattggttgttgcggccaggtgtactgtctaaatcagatgtgccaatttgggcaactgtttgtttagatggatccatttgtgggtcagtgagaataaattgtgtgactggga

SEQ ID NO: 3681 - DNA, 1245 bp, Theobroma cacao
  misc_feature (462)..(462): n is a, c, g, or t
  misc_feature (510)..(510): n is a, c, g, or t
ggcaccagaaaagaatcagctttttgttctttgcttgccccattgagagaaaagaaaatggctactaccttctttaggagactcgccaaagctaccccaccttccttcaccgatgcatttggaggtcaacccaaggccggttttgctggatttcgcttctcagcaatcgcagccgttgctggtggaatctcctcttactactacttctccgagtcgaatttggttcatcttgatcaaatcaatgaagagacaggtccaaaagttgctctgaagtcggataagtggattgaatttaagttacaagatactgcaagggttagtcacaatactcagttattcaggttttcatttgatcccacttctaagctgggtttagatgtcgcttcatgcatccttacgagagctccattaggacaagatgctgaaggaaaaacaaaatatgtcataagaccgtatactccnatatcagacccagatgctaagggatctttgacttgttaataaaggtgnatccagaaggaaaaatgagtcagcattttgctagcttaaaaccaggcgatgtagttgaagtgaaagggcccattgaaaagctcagatactctcccaatatgaagaaacacattggcatgattgcaggtgggacaggcataactccaatgcttcaggtaattgaggctatactgaagaagcctgatgacaacactcaggtgtcactgctttatgccaatgtctccccggatgatatactgctaaagcagaagcttgatatacttgctgctagccacccaaatcttaaggttttccacactgtggacaatccatcaaaaaattggaaaggtggtgctggttacatttcaaaggatatggtcacaaaaggcttacctggtcctggtgaagatactctaatccttgtatgcggtccacctgggatgatgaaacacatatctggtgataaggctaaagactattcacaaggagagctaaccggcatactcaaagaacttggatacacagagcaaatggtttacaaattttgaaattcaaggatttgaagggatgactctcgtggtttgaacataatttttgtgtaataaatgtttcctgaacgaacactaattgggcagagtttaaagccccggttatgaaataattttttagtgatattcaatgtaaagatagtacattgtcaaagcttgtaccgagtgaaatcatgatacaaagagctttacaaagaaaaaaaaaaaa

SEQ ID NO: 3682 - DNA, 1401 bp, Citrus sinensis
gggggcccgcagcatatgtcatctccaattctccctaaaaataggggaatttcaaaaaccctcacaccaggttccgtggtatacttttctttgctttgcttcttctccaacattagaaaatggctacgaccttcttcagaagactggctaaagctactccaattgcattcaacgaggcatttggagggcaacccaagtccgatttcaacaaatttcgatttccctttggagcaatcgctgctgttgctggtggagtctcctattactgttacttttcatccccaaatttggttcatctagatcaaatcaatgaagagacgggtccaaaaattgctctcaatccggacaagtggattggatttaagttgcaagacactgcaagggtaagccacaatagtcatttgttcaggttttcatttgatccatctgccaagttgggtttggatgttgcttcatgcatccttacaagggctccattaggacaagatgctgaaggaaatacaaaatatgttgtacggccgtatactcctatatcagatacagaagctaagggacactttgacttgttaattaaggtttatcctgagggtaaaatgagtcagcattttgctagcttaaaaccaggggatgtagttgaagtgaaaggacccattgaaaagctccgatactctcccaatatgaagaaacacatcggcatgatagctggtggcacaggtataactcctatgcttcaggtaattgaggctatactgaagaatccagatgacaacactcaggtgtcactgctgtatggcaatatatccccagatgatatattactcaaacagaagcttgacatactagcagctagccatccaaatttgaaggtgttctacactgtagacaatccaacaaagaattggaaaggaggcgtaggatacatctctaaggatacggccctaaaaggcttgccaagccccagtgatgatgctcttatcctggtatgcggaccccctggaatgatgaaacatgtatctggtgaaaaggccaaagactattcacaaggagagctttctgggatactcaaagatcttggatacactgagcaaatggtttacaaattttgatggatggagggacattatagaagcagccgcgacatcctatgttttttcagccaaaattttgtgtaataaaattgatcttgaataattttgtcgaaatggacataaatcctcccaagatatcaaataatacgggatgaatgttacagaatgcaaaagaaaccttttgatgatgagagaaactacacttttctggatttcattctgtaagaagcttgtagtttcttagtaaatggcaacgcctagcttttccaaaagaaggcggggggggggggggggggggggcggcggcgcggga

SEQ ID NO: 3683 - DNA, 1369 bp, Quercus alba
tagtatcagcggaattcccgggatcacaaaccaaagctttttttccatttcatttcacatttcactcccagaagaaaggcatatatatagcacagtagtagtctctgggttctcaaacaaagtcgaaccgtgagttgttccttcatttccattgtgaaatggctacgttcttcttcaagaggctcgctagagctactccgattgcactcaacaatgcattgtcttttggaggagccaacaaaaccaagtccggcttcagtgggtttcggatacccattggggcaatcgcagcagtttctggtggaatctcctactactactgcttttcctcgtcgaatttggctcatctagatcaaatcaatgaagaggcaggtccaaaagttgcgctcaattcagataaatggattgaatttaagttgcaagacactgcaagggtcagccataatactcaactattcaggttttcatttgatcctactgccaagttgggtctagatattgcttcatgcatccttacaagggctccaacaggacaagatgctgaaggaaaaccaaaatatgtcatacgcccgtatactcctatatcagatccagatgctaagggatactttgatttattaatcaaggtgtatccagaaggaaaaatgagtcagcattttgcgagcttaaaacctggtgatgtagttgaagtcaaagggcccattgagaagcttagatatagtcccaatatgaagaaacacattggcatgattgctggaggcacaggcattactccaatgcttcaggttattgaggctatactgaaaaattctgatgacaacactcaggtatcactgctttatgctaatgtctccccggatgacattttgctgaaacagaagcttgatgtacttgcaactagtcacccaaatttaaaggtattctacactgttgataatccctcaaagagttggagaggaggtacaggttacatatcaaaggatatggccatcaaaggcttacctggtcctagtggcgatactctaatccttgtatgtggtccccctggaatgatgaaacatatatctggtgacaaggctaaagactactcacaaggagagctgactggcttactgaaagaacttgggtatactgagcaaatggtttacaaattttgaatcaggcaatttagcatctgaagcatttgtgcattcacttcaaattttgagttgtacaagttttttcctgaagaaacgttggcagcttgaacttgagcaaaacatcgaataaatttgccagtgatattcaatagaaataatgcattgtgagagctcacactaacttgcattttacttttgaggaaccttgcaaaatctctgtgcctgtatga

SEQ ID NO: 3684 - DNA, 1386 bp, Citrus clementina
gcccgcagcatatgtcatctccaattctccctaaaaataggggaatttcaaaaaccctcacaccaggttcagtggtatacttttctttgctttgcttcttctccaacattagaaaatggctacgaccttcttcagaagactggctaaagctactccaattgcattcaacgaggcatttggagggcaacccaagtccgatttcaacaaatttcgatttccctttggagcaatcgctgctgttgctggtggagtctcctattactgttacttttcatccccaaatttggttcatctagatcaaatcaatgaagagacgggtccaaaaattgctctcaatccggacaagtggattggatttaagttgcaagacactgcaagggtaagccacaatagtcatttgttcaggttttcatttgatccatctgccaagttgggtttggatgttgcttcatgcatccttacaagggctccattaggacaagatgctgaaggaaatacaaaatatgttgtacggccgtatactcctatatcagatacagaagctaagggacactttgacttgttaattaaggtttatcctgagggtaaaatgagtcagcattttgctagcttaaaaccaggggatgtagttgaagtgaaaggacccattgaaaagctccgatactctcccaatatgaagaaacacatcggcatgatagctggtggcacaggtataactcctatgcttcaggtaattgaggctatactgaagaatccagatgacaacactcaggtgtcactgctgtatggcaatatatccccagatgatatattactcaaacagaagcttgacatactagcagctagccatccaaatttgaaggtgttctacactgtagacaatccaacacagaattggaaaggaggcgtaggatacatctctaaggatacggccctaaaaggcttgccacgccccagtgatgatgctcttatcctggtatgcggaccccctggaatgatgaaacatgtatctggtgaaaaggccaaagactattcacaaggagagctttctgggatactcaaagatcttggatacactgagcaaatggtttacaaattttgatggatggagggacattatagaagcagccgcgacatcctatgttttttcagccaaaattttgtgtaataaaattgatcttgaataattttgtcgaaatggacataaatcctcccaagatatcaaataatacgggatgaatgttacagaatgcaaaagaaaccttttgatgatgagagaaactacacttttctggatttcattctgtaagaagcttgtagtttcttagtaaatggcaacgcctagcttttccacgggaattttgcatttgtacgatatgtttggtt

SEQ ID NO: 3685 - DNA, 1407 bp, Citrus sinensis
gcccgcagcatatgtcatctccaattctccctaaaaataggggaatttcaaaaacctcacaccaggttcagtggtatacttttctttgctttgcttcttctccaacattagaaaatggctacgaccttcttcagaagactggttaaagctactccaattgcattcaacgaggcatttggagggcaacccaagtccgatttcaacaaatttcgatttccctttggagcaatcgctgctgttgctggtggagtctcctattactgttacttttcatccccaaatttggttcatctagatcaaatcaatgaagagacggatccaaaaattgctctcaatccggacaagtggattggatttaagttgcaagacactgcaagggtaagccacaatagtcatttgttcaggttttcatttgatccatctgccaagttgggtttggatgttgcttcatgcatccttacaagggctccattaggacaagatgctgaaggaaatacaaaatatgttgtacggccgtatactcctatatcagatacagaagctaagggacactttgacttgttaattaaggtttatcctgagggtaaaatgagtcagcattttgctagcttaaaaccaggggatgtagttgaagtgaaaggacccattgaaaagctccgatactctcccaatatgaagaaacacatcggcatgatagctggtggcacaggtataactcctatgcttcaggtaattgaggctatactgaagaatccagatgacaacactcaggtgtcactgctgtatggcaatatatccccagatgatatattactcaaacagaagcttgacatactagcagctagccatccaaatttgaaggtgttctacactgtagacaatccaacaaagaattggaaaggaggcgtaggatacatctctaaggatacggccctaaaaggcttgccaagccccagtgatgatgctcttatcctggtatgcggaccccctggaatgatgaaacatgtatctggtgaaaaggccaaagactattcacaaggagagctttctgggatactcaaagatcttggatacactgagcaaatggtttacaaattttgatggatggagggacattatagaagcagccgcgacatcctatgttttttcagccaaaattttgtgtaataaaattgatcttgaataacgttgtcgaaatggacataaatcctcccaagatatcaaataatacgggatgaatgttacagaatgcaaaagaaaccttttgatgatgagagaaactacacttttctggatttcattctgtaagaagcttacagtttcttagtaaatggcaacgcctagcttttccacgggaattttgcatttgtacgatatgtttggttgtgtaaaagaattgctttactg

SEQ ID NO: 3686 - DNA, 1201 bp, Castanea mollissima
tttcatttcatttcactcccagaagaaaaggcatatatatagcactgtagtagtctctgagttctcaaacaaagtcgaaccgtgagttggttcttcatttccattgagaaatggctacgttcttcttcaagaggctcgctagagccactccgattgcactcaacaatgcattgtcttttggaggagccaacaaaaccaagtctggcttcagtgggtttcggatacccattgggacaatcgcagcagtttctggtgggatctcctactactactgcttttcctcgtcgaatttggctcatctagatcaaatcaatgaagaggcaggtccaaaagttgcgctcaatccagataaatggattgaatttaagttgcaagacactgcaagagtcagccataatactcaactattcaggttttcatttgatcctgctgccaagttgggcctagatattgcttcatgcctccttaccagggctccaacaggacaagatgctgaaggaaaaccaaaatatgtcatacgcccgtatactcctatatcagatccagatgctaagggatactttgatttattaatcaaggtgtatccagaaggaaaaatgagtcagcattttgcgagcttaaaacctggtgatgtagttgaagtcaaagggcccattgagaagctgagatatagtcccaatatgaagaaacacattggcatgattgctggtggcacaggcattactccaatgcttcaggttattgaggctatactgaaaaattctgatgacaacactcaggtatcactgctttatgctaatgtctccccggatgacattttgctgaaacagaagcttgatgtacttgcaactagtcacccaaatttaaaggtattctacactgttgataatccctcaaagagttggagaggaggtacaggttacatatcaaaggatatggccgtcaaaggcttacctggtcctagtgacgacactctaatccttgtatgtggtccccctggaatgatgaaacatatatctggtgacaaggctaaagactactcacaaggagagctgactggcctactcaaagaacttgggtatactgagcaaatggtttacaaattttgactcaagcaatttagcatctgaagcatttgtgcattcacttcaaattttgagttgttcaagtttttcctgaagaaacattggcagcttgaact

SEQ ID NO: 3687 - DNA, 1012 bp, Manihot esculenta
gcatccttcttccttgaaaaatggcctctacattcatcaggagactggcgaaagccgctccaattgggtattgggggcaaccaaagtccaattacggtgggtttcgcattccttttggagcaattgcagcagtttctggtggaatctcctatctgtactactactcctctccaaacttggcttaccttgatcaagtcaaagaaggggatgctcaaaaagttgctcttaaatccaataaatggattgaatttaagttgcaagacactgcaagagttagccataatactcaattattcaggttctcatttgatccctctgctaagttgggtttagacattgcctcatgcatccttacaagggctccattaggacaagatgctgaaggaaaaacaaaatacgttatacgcccgtatactcctatatcagacccagatgctaagggatactttgacttattaatcaaggtttatcctgagggcaaaatgagtcagcattttgccagcttaaagcctggtgatgttgttgaagttaaagggcccattgaaaagcttagttattctcccaatatgaagaaacacattggcatgattgcaggtggtacaggcattactccaatgcttcaaataattgaggctatccttaagaatcccgatgacaacactcaggtctccttgctttatgccaatatctcccctgatgacatcctacttaaacagaagcttgacttcctcgcggctagccactcaaatttaaaggtattctatacagtagacaatccatcaaaaaactggaaaggaggtgtaggatacatatccaaggacatggttttgaaaggcttacctagtcctagtgatgatacacttatcctggtatgtggcccacccggaatgatgaaacacatatctggtgataaggctaaagactattcacagggagagctcactggcatacttaaagaactgggatatgctgagcaaatggtttacaaattctaatagagccatttaagcat

SEQ ID NO: 3688 - DNA, 1205 bp, Malus domestica
agaaatcagcccaagcaagtagggagcagcatctgtgctttgcttcttccaatggctaccttcttccagaggctcgccaaggcggcgccgaccgccttcaacagctcgtttcgaggccaatcgaagtcaagctttcgcattcccttcggagcagtcgcagccgtctccggcggaatctcctatctctgctactattcctcgccggatttggtttatctagatgaaatcaaagaacaaactggcccaaaagttgcacttaatccagacaaatggattgaatttaagttgcaagatactgcaagggttagccacaatacacaattattcaggtttacatttgatccgaatgccaagttgggtttatatgttgcttcatgtctccttacgagggctccattaggacaggatgctgaagggaaacccaaatatgtcatacgcccgtatactcctatttcagatccagatgccaagggatactttgacttgttaattaaggtgtatccagaaggaaaaatgagccagcatttcgcaagcttaaaaccaggcgatgtagttgaagtgaaggggcccattgaaaaactcagatatactcccaacatgaagaaacatataggcatgattgccggtggtacaggtattactccaatgcttcaggttattgaggccatactgaaaaatcctgatgacacgactcaggtgtcactgctttatgcgaatgtctccccagatgatatactgcttaaacagaaacttgacatacttgcagctagccacccaaatttaaaggtattttacacggtagataatccaacaaagagttggaaagggggaaaaggttacatatcaaaggacatggcagttaaaggcttacctgctcctggtgaagatactctcatcctggtatgtggtcctcctgggatgatgaaacatatatctggtgacaaggctcaagaccgatcacaaggagagctcactggcatactaaaagaactcgggtacactgaaaaaatggtttacaaattttgattcagcatagacgaattagcttttaagaaacaattactaggttttatttcaatttttttgcaataaactgtgttcttaggatagcatacgcaactcgaactcgaatttgaaatctttcaataaatttgggaacaatactgaatagggtatattttgttatgaaatttgtggtattgccc

SEQ ID NO: 3689 - DNA, 1056 bp, Manihot esculenta
gattgcttgctcattggattatgctctactaacactattctgagtcttcttttttccttgaaaaatggcctctacattcttcaggaggctggctaaggccgttcctactggatttggagggcaactcaagtccaattacggtgcgtttcgcattccttttggagcaattgctgcagtttctggcggaatctcctatttgtactactactcatctccgaacttggcttatcttgaccaagtcaaagaagagacaggtccaaaagtcgctcttaaaccagataaatggattgaatttaagttgcaagacactgcaagagttagccataacactcatttgttcaggttctcatttgatccctctgccaagttgggtttagacattgcctcatgcatccttacaagggctccattagaactggatgctgaaggaaaaacaaaatatgtcatacgcccgtatactcccatatcagatccagatgctaagggacattttgatttattaattaaggtttatcctgagggcaaaatgagtcagcattttgccagcttaaagcccggtgatgccatcgaaattaaagggcctattgaaaagcttagatattctcccaatatgaagaaacacattggcatggttgcaggtggaacgggcattacaccaatgcttcaagtaattgaggctattcttaagaatcccaatgacaacacgcaggtttcactgctttatgccaatatctcccctgatgacattctacttaaacagaagcttgatttccttgctgctagccatccaaatttcaaggtattctacacagtagacaatccatcaaagaactggaaaggaggaacaggatacatatcaaaggatatggttgtgaagggcttacctggtcctagtaatgatgcacttatcctggtatgtggaccccctggaatgatgaagcacatatctggtaataaggctgaagactactcacagggagagcttactggcatactcaaagaactcggatatactgagcaaatggtttacaaattctaataaacacatttaagcat

SEQ ID NO: 3690 - DNA, 1409 bp, Populus trichocarpa
aagaatatatttacctagctaacagtttgcttcttcgctttgcagcttggaatttattttgagtgtacaaaaatggcttctaccttcttcaggagactatctaaggccactccagtttcattcggaggtcagcccaagtccacttttggagcaatcgctgcagttaccggtggaatctcttatttgtactactacaactctccaaatttggctcatttagaagaagtgaaagtagaaggcagcccaaaagttgctctcaatccagataaatggattgaatttaagctgcaagacactgccagagttagccataatactcatttattcaggttttcatttgatcctgctgcaaagttgggtttagatattgcttcatgcattattacaagggctccaataggacaagatgctgaaggaaaaacaaaatatgttgtgcgcccgtatacacctatatcagacccagattctaagggatattttgatttattaatcaaggtgtatcctgaaggaaaaatgagtcagcatttcgctaccttaaaatctggagatgttgttgaagtgaaagggcccattgaaaagctcagatattctcccaatatgaagaagcacattggcatgattgcaggtggcacaggcattactccaatgcttcaagtaattgaggctatactgaagaatcccgatgacaacactcaggtatcgttgctttatgccaatgtctcccctgatgacatacttcttaaacagaagcttgactttcttgctgctagccatccaaatttaaagatattctacactgtagacaatccatcgaagaactggaaaggaggttcaggtttcatatcaaaagatatggttgtgaaaggcttacctggtccgtgtgatgatacacttatcctggtgtgtggaccccctgggatgatgaaacatatatctggtgataaggctaaagatcgttcacagggggagctcactggcctactaaaggaagctggatacacagaggaaatggtttacaaattttaatagaagcatttaagcagcttagaaaggctactttatgatttcttctagatttttttttgtaatgaaggttttctaaggaaactcaggtcaaaacttaaacttcaaaatatggaataatttggctgcagcatctagaggccaggcgatttgagattttgtttgaagagagcctagaagagtttatgcctgttgtggaaaatttaatgttgctcaagcatgatacagtttcatgaatgtgtgcaggtctttttggggttcattgccccagttaagaaccttgatactaggagaattttgccatttgaatgttccataggaatcctcagctgtcgagttgtacagtaaatgacaacagtgccaatcaataaatttatattgagaga

SEQ ID NO: 3691 - DNA, 1281 bp, Tripterygium wilfordii
agcccccatttcttgttttctggggtataggagagtctctcgcagtatttgttctttgcttctcgattgaaaatggccgcaactttcttcaagagactcgactaaaggaccaactaccgattgcattcaacaatgcatttggaggccaatcaagttccagtttcactggcttccgcgttccctttggagcaatggcagcagtctctggtgggatctcttatttctactacttttcctccccgaacttggttcatctagatcaaatcaatgaacagccaggcccaaaaattgctctcagtccagataaatgggttgaatttaaattacaagacactgcaagggttagtcacaattctcagttgttcagattttcatttgatcccactgccaagttgggtttagacattgcttcgtgcatccttacaagggctccaacagaactagatcctgaaggaaaaacgaaatatgtcatacggccatatacgcctatatcagatccagatgctaagggatactttgaccttttaattaaggtgtatccagaagggaaaatgagtcaacattttgctagcttgaagcctggcgacgtcgttgaagtgaaagggcccattgagaagctaagatactctccaaatatgaagaaacacattggcatgattgcaggaggcacaggcattactccaatgcttcaggtagttgaggccatattgaagaatccggatgacaacactcgggtgtcgttgctttatgccaatgtctctccagatgacatactgcttaaacagaagcttgactcacttgctgccagccatccaaattttaaggtattctacactgtagacaatccatcaaagaactggagaggaggtgcaggttacatatcaaaggatatggttgtgaaaggcttaccaagccctagcgatgatacccttatccttgtctgtggtcctcctggaatgatgaaacatgtatgtggtgacaaggctaaagactggtcccaaggggagctcacaggcacacttaaagaagtcggttatactgagcaaatggtttacaaattctaattggcagaagcattgtcactggttatattcaactaaaacattgtgcaataaaagtttttacttgaaatccagaatatcatccactttctgatatgtattcatttttcctgttggagaaacatagaacttttgtctttcagcacttttgttcatgtcttggggagattattttagaagaatcttctccttagtttatagttctcaaattccatgttca

SEQ ID NO: 3692 - DNA, 1294 bp, Euonymus alatus
acctggaaaacccccatttcttgttttctggggtataagagattctcaccgtatttgttctttgcttaattgcttctcgattgaaaatggccacaactttcttcaagagactcgctaaggctactccgattgcattcaacaatgcatttggaggccaatcaagttccaggttcactggattccgcgttccctttggagcaatggcagcggtatccggtgggatctcctatttctactacttttcctctccgaacttggttcatctagatcaaatcaatgaacagccaggcccaaaaattgctctcaatccagataaatgggttgaatttaaactacaagacactgctagggttagtcacaattctcagttgttcagattttcatttgatcccactgccaagttgggtttaggcattgcttcgtgcatccttacaagggctccaatagaaccagatcctgaaggaaaagtgaaatatgtcatacggccatatacacctatatcagatccagatgctaagggatactttgaccttttaattaaggtgtatccagaagggcaaatgagtcaatattttgctagcttaaagcctggcgacgtcgttgaagtgaaagggcccatcgagaagctaaaatactctccaaatatgaagaaacacatcggcatgattgcaggaggcacaggcatcactccaatgcttcaggtagttgaggccatattgaagaatccggatgacaacactcaggtgtcgttgctttatgccaatgtctctccagatgacatactgcttaaacagaagcttgacttacttgctgccagccatccaaatttcaaggtattctacactgtagacaatccatcaaagaactggaaaggaggtataggttacctatcaaaggatatggttgtaaaaggcttaccaagtcccagtgatgatacccttatcctagtctgtggtcctcctgggatgatgaaacatgtatctggtgacaaggctaaagactggtcccaaggagaggtcacaggtacacttaaagaagttggttataccgagcaaatggtttacaaattctgattggcagaagccttatcagtggttatatttcaactaaaaattttgtgcaataaaatgttttacttgaaatccagaatatcatccactttctgatatgtattgattttttttgttttggagaaacatatcttacagcacctttgctcatatgttggggagcttattgattttttttgcaccaatgatagagctgcagggataaaacctagaagtctcgtatt

SEQ ID NO: 3693 - DNA, 1150 bp, Euphorbia peplus
ctggttgcttcttcaccgggtttatacacttccagcgccgttgggtgctcctctcttccccgttgagaaatggcgtcgacattctttaggagacttgctaaatccactccactcgcatttgcaggccaagcaaagtccaactatggcggctttcgaattccttttggagcaattgcagctgcctctggtggaatctcctatttgtactactattcttctccaaacttggctcatcttgacgaaatcaaacaagagactggtccaaaatctgctcttaatccagataaatggattgaatttaagctgcaagatactgctagagtcagccataatactcatttattcaggttttcatttgacccttcagccaaactgggtttagatatcgcatcatgcatccttacaagggctccactaggacaagatactgaaggaaaaacaaaatatgttatccgtccgtacactcctatatcagatcctgacgctaaaggatattttgacttattgattaaggtgtatcccgaaggaaaaatgagtcagcactttgctagcttaaagcctggtgactttgtcgaagttaaaggacccattgaaaagctcagatactctcccaatatgaagaaacacattggcatgatcgcgggaggctcaggcattactccaatgcttcaagttattgaggctatcctcaagaatcctgatgacaacactcaggtgtcattactttatgccaatgtttcccctgatgatatactacttaaacagaaacttgactccctggctactagctaccccaattttaaggtgttctacactgttgataatccatcaaagaactggaaaggaggtgttgggtacatttcaaaagatatagctctgaaaggtttacctcgtccaagtgatgatacacttattatggtatgtggtccccctggaatgatgaagcaaatatctggtgaaaaggctaaagactactcacaaggagaggttgatggcatattgaaagatcttggatacaccgagcaaatggtttacaaattttaacagacattttagttcctgttgtcaaatttttgaataaattttgtataaagaatacatggacatgaaacttgcatagcagagaatgaaataattgctcaggacactg

SEQ ID NO: 3694 - DNA, 1347 bp, Prunus persica
cgacgccaagagtagaaagaaagaaagcagtggaggaggcagcaaaagaaagcccccttgtatctttgttgccgggcacacaaatactgagcattgtgctttgcttgtgttttactgaaaatgactgccttctttcagagactggctaaggctgccccaatcgccttcaacaactcatttggaggccaatccaagtccagctttcgcattccctttggagctctcgcagctgtctctggtggaatctcctatctctgctactattcctcgccagatttggtttatctagatgagatcaaagaacaggcaggcccaaaagttgcgcttaatcccaacaagtggattgaatttaagttgcaagatactgcaagggttagccacaacactcaattgttcagatttacatttgatcccactgccaagttgggtttagatgttgcttcatgtctcattacgagggctccaatagaacaagatgcagaagggaaaccaaaatatgtcatacgcccgtatactcctatttcagatccagattccaagggatactttgacttgttaattaaggtgtatccagaaggaaaaatgagccagcattttgcaagcttaaaaccaggcgatgtagttgaagtgaaggggcccattgaaaagttcagatatactcccaacatgaagaaacacataggcatgattgcaggtggcagtggtattactccaatgcttcaggttattgaggctataatgaaaaatcccgatgacacgactcaggtgtcactgctttatgctaatgtctccccagatgacatattgcttaaacagaaacttgacatacttgcagctagccacccaaatttaaaggtatattacacagtagataatccaacaaagagttggaaagggggaaaaggttacatatcgaaggacatggccgttaaaggcttacctggtcctgctgaagatactctcatccttgtatgtggcccccctggattgatgaaacatatatctggtgacaaggctaaagactggtcacaaggagagctcactggcatactaaaagaacttggatacacagaagaaatggtttacaaattttgatcgatgaagaccctttagcatttcaagctatcactaggctttacttcaaatttggtgtaataaattgttttcttaggaagcatacgcaacttgaactcaaaatctacgataataaatttgggaagaatgctgaataggtgatatttggttatgaatttgtgatattgcctacatgagttagctgttagcccttcattttgaacaagttttatatcaattaaggcaaccctaccgtttgatgggcgttatcta

SEQ ID NO: 3695 - DNA, 1250 bp, Ricinus communis
ggagagtagagtgtcaaaaccctaattcctgtcaattgggttatactctctctactaatcactatactgattgttgaaaaatggcttctatgttcttcaaaaggctggctaaagctagctcaataggattcggagggcaatcgaagtccaattttaatgggtttcgcattccaattggagcaattgcagcagcttctggtggaatctcttatttgtactactactcctctccaaatttagcttatcttgatgaagtcaaagaggatgctggtccaaaagttgctcttaaaccagataagtggattgagtttaagctgcaagacactgctagagttagccacaatactcagttgttcaggttttcatttgatccctctgccaagttgggtttagatattgcgtcatgcattcttacaagggctccattaggacatgatgctgaaggaaaaacaaaatatgtcatacgtccgtacactcctatttctgacccagatgctaagggatattttgacttactgatcaaggtgtatcctgaaggaaaaatgagtcagcattttgctagcttaaagcctggtgatgttgttgaagttaaagggcccattgaaaagctgagatactctcccaatatgaagaaacacatcggcatgattgctggtggctcaggcattactcctatgcttcaaatcattgaggctatccttaagaatcctgatgacaacactcaggttacgttgctttatggcaatatctcccccgatgatatactactccaacagaaactcgacttcctggctgctagccacccaaattttaaggtattctacactgtagagaatccatcaaaaaactggaaaggaggtgtaggatatgtatcaaaggatatggctctgaaaggcttacctggtcctagtaatgatacacttatcctggtatgcggcccatctgggatgatggaacacatttctggtagtaaggctaaagattattcgcaaggagagctaactggcttactgaaagaacttggatatactgagcaaatggtttacaaattttaggagaggcatttaagcagcatacagagtcgttttttcggctgttctaaaatttttgtaataaatgttttctacagaatcagtgaatggaaacacaggtttcaaaataccaaataattggaaatgttagggccgtatactgatctgagattttacagagaagttatatgagtaaaagggcttgtgtttatgatactt

SEQ ID NO: 3696 - DNA, 1391 bp, Vitis vinifera
caatggcgctcttcttcaagagactcgctaaggcctccccagtcgcattcaccaatgcgtttggtggtcaacccaagtccggtgcacgcaatttccgtataccctttggagcaattgcagcagtttctggtggaatctcatattactgcttttcttcagagaatttggttcatttagatcaaattaatgaaaatgcaggtccaaaagttgcactaaatccagataaatggcttgaatttaagcttcaagacactgcaagtgtcagccacaatacccaattattcaggttttcatttgatcctactgccaagctgggtcttgacattgcttcatgcattcttacgagggctccaataggacaagatgatgaaggaaaaataaaatatgtcattcgcccgtatactcctatatcagatccagattccaagggttactttgatttattaataaaggtgtatccagaagggaaaatgagtcagcatttctcacatttgaaaccgggtgacattatagaagtgaaagggcccattgaaaagctcaggtatactccaaatatgaagaaacaaattggcatgattgcaggtggcacaggcatcactccaatgcttcagatcattgaagctatactgaagaatcctgatgacaagacccaagtatcactcatttatgctaatgtatccccagatgacatactgctcaaaaagaagcttgacatgcttgcagctacccacccaaattttaagatattctacactgtagataatccatcaaataattggagaggaggtactggatacgtatcaaaggatatggttgtgaaaggcttgccagctcccagtgatgattctcttatccttgtatgtggtcctcctggaatgatgaagcatatatctggtaataaggcaaaagattactcacaaggagagctcacaggcatactcaaagagcttggatacacggaagacatggtttacaaattttgaagtccagaggccatttagaatctggagtattgaactcaaattttgtgtaataaattagttttgaagaaacagcgattgctggaacccaaaagggcaatagatcgagatcaaataatgatggaaacctatttccaacataaaaatgctacatcttgcagcacccccgctcattttgagctgtcatattgagcgctgcagaggctacactgcattggtaggatgttcacagggtgatgataaatttcagaccaagaacccatgcctgctaatcatcccaactgctttggcctctcccattacatgtattgatgtctgaaacataccagcccacgtagtcaaggctggtctgctgccatagaaagacaatggttagcactagtgtatgaagaagatttagacccacttgat

SEQ ID NO: 3697 - DNA, 1465 bp, Amsonia hubrichtii
tctctgcccctctaattcaacactaaaaatggcgttattcttccagaggctggccaaggctgcacccgccgcattttcacaagcatttcgaggccaatcgaagtccaatttcgataacttccatgtcccctttggagctattgccgcgatctctggtggcatgtcgtattattattactgttcttcatcggccgtggtctacttagatgagctcaaagatgatacgggtccaaagactgcactcaatcctgataagtggattgaatttaagctgcaagacaaggcacaggtcgagccacaacactcaattattcaggtttcagtttgatccttctgcaaaattaggtcttgatattgcttcatgcctccttacgagggcacccaatggacaaaatgctgaagggaaaacaaaatatgtcattcgcccttatactccaatatctgatccagatgccaagggatactttgatttgatgattaaggtatatccagaagggaaaatgagtcagcattttgcaagcttaaaaccaggtgatgtagtggaagtgaaagggcccattgagaaactgagatataaaccaaatatgaagaaacacattggcatgattgcagggggaactggcattaccccaatgcttcaggttatagaggctatcctaaagaatcctgatgataatactcaggtctctctgctctatgccaatgtatcccctgatgacatacttctcaaaaagaagcttgatgtacttgcagctagccacccaaatttgaagatattctacactgtggataatccaacaaacgattggacaggagggaagggttacatttcaaaagacatggctgtgaaaggattacctgagcctggtgatgatacattgatcctagtctgcggtcctcctgggatgatgaaacaaatatctggtgataaggccaaagattattcacaaggcgagctaactggcatactcaaggaactgggatatacagaaagcatggtttacaaattctaaaggagaatagactggttgtatctgtgtttctctcatccataccttggaataaacgaatttctgaagaaagcaaccgatttagaagataattaacctaatattcaaatgagaacagaattgggccagatacgttgttatgaagccctgattgcatgagcatatgatgtgaaagctctacaaaacgttctttctgccaggagtttttgctacttctggaggcatttatagaaagtttcggttgatcttttaaccttgaatttctctgcctggatttggagattagaatagtagttgtccttcctatttttggtcagaaaaaatgtaccttgtctgtgtgaggctgcgctcatgttttttctatcagtaagatttggggcctcaaatgcccaaaagttaggttcgatttgttcctttttgtcttatggatgtttatacaaattgataaccattaa

SEQ ID NO: 3698 - DNA, 2456 bp, Gossypium hirsutum
atcttgatccccgtttgcgccgttattggaattgtctttctcttgcacaatggcttcttgtttccaatgtgaagctctcccgggttccccggtaacaacggtgcgggtgggaaaaacggctattccgattacctcattgaagaagaagaaaggtcttaatgaccataatgttgttattaagtgtgctgaaattcagactgccatatctgaaggagcaacctcatttcttttcaccgagtaccagtatgttggcattttcatggttgcttttgcaatcttgattttccttttccttggctcggtagagggtttcagcaccaagagccagccttgcacttatgacaaatctaagatgtgcaaacctgctcttgccactgctatattcagcacagtatctttcttgctcggtgctgtcacttcagtagtttctggctttcttgggatgaaaattgctacctatgctaatgctcgaaccaccctggaggcaagaaagggagttgggaaggcatttattactgcattcagatctggtgctgtcatgggctttcttcttgctgcaaatggtcttttggtgctttacattgccatcaacttattcaagctctactacggtgatgactggggtggtctttttgaggcaatcactggttatgggcttggaggttcgtccatggcgctttttggaagagttggtggaggcatctatacgaaagctgctgatgtcggtgctgatcttgtaggcaaggtggaaaggaacattcctgaggatgaccctagaaacccagctgtgattgctgacaatgttggggataatgttggtgatatcgctgggatgggatctgatctttttgggtcctatgctgaatcatcttgtgctgcacttgttgtcgcttccatctcttcttttggcatcaatcatgaattgactccgatgttatatcctctcattataagttccgttggtatcattgtttgtttaatcacaaccttatttgctactgatttctttgagatcaaggctgttaaggaaatgagccatcattgaagaggcaactcataatctcaactgttctcatgactattgaaatcgggattgttagttggatagctcttccatcttcctttactattttcaatttcggagaccaaaaagctgtgaagaactggcaactattcttatgtgttgctgttggtctttgggccggcctaattatcggtttcgaaactgaatactatactagcaatgcatacggccctgtacaagatgtcactgattcctgcaggactggagctgctactaacgttatttttggccttgcattgggttacaagtcttgcattattcctatttttgctattgcaatcaagcattttcgttagtttttagctttgctgctatgtatggcattgctgttgctgcccttggaatgctgagcaccatagctaccgggttggctattgatgcttatggtcccatcagcgataatgccggaggcattgctgagatggctggcatgagccacagaatacgggagagaactgatgctcttgatgctgcaggcaacaccactgctgctatcgaaagggtttcgccattggttcagcagcactggtttcccttgctctctttggtgcctttgtgagccgagctgctatctcaactgtcgatgtattgacccctaagtttttatcggtttgcttgttggggcaatgcttccttattggttctctgctatgaccatgaagagtgtgggaagtgcagctttgaagatggtcgaggaagtgcgcagacagttcaacacaatccccggtctcatggagggcaccactaagcccgactacgctacctgtgttaagatctctactgatgcttccatcaaagaaatgatcccaccgggtgctcttgtcatgctcacaccccttgttgttgggatctttttcggcgtggaaactctttccggtgtcctcgctggatctctcgtctcaggtgttcagatcgctatctctgcatccaacacggggggcgcttgggacaacgccaagaagtacatcgaggctggtgcttcaacacatgcaaaatctcttggccccaaaggttcagatccacacaaggcagctgttataggcgacaccatcggtgaccctttaaaggatacatccgggccatcgttgaacatcctcatcaagctaatggcagtcgaatcactcgtcttcgctcccttcttcgctacacatggtggactgcttttcaagttattttgagtgaaggtcaacaaaaagtaaacagctaatggtccgtccacccattgcagactctctcaattgatccatttgaatctgtagaacattttgagttgccatattctctttaaaaaggttaaatcggcattgaaaaattttcccttggtaaaagggttgacaaaataactttgatgatgatgataatggtcaaccta

SEQ ID NO: 3699 - DNA, 2838 bp, Populus trichocarpa
ctgccctattctctctctcttccactctatcacgcattcctcatttctttctccagtaacttctctttcttttctgtcattggagaaattaataaagaaatcaattagggtttggagccatggtttcggtgattttgccagatctgggaacggagattctgattccggtatgtgccattattggaatcggattctctctccttcagtggctgttggtttccaaggtcaagcttgtaccgagtcctgcggcgtcgaataacagtggtgctgctggaaagaatgggtacggtgactacttgattgaggaagaagaaggccttaatgaccataatgttgttcttaaatgtgctgagattcaaaatgccatctctgaaggtgcaacttctttccttttcactgaatatcaatatgttggaattttcatggttgcttttgcaatattgattttcgttttccttggctctgttgagggattcagcactaagagtcagccctgcacatatgatctcttgaagatgtgcaagcctgctcttgccactgctggcttcagcaccgtagcctttgtgcttggtgctgtcacttcagtggtttctggctttcttgggatgaaaattgcaacctatgctaatgccagaaccaccctggaggcaagaaaaggagttgggaaggcttttatcattgcatttagatctggggcagtcatgggttttctccttgctgcaaatggactcttggtgctttacattaccatcaatgtcttcaagctatactatggtgatgactgggaagggctttttgagtctataactggctatggacttggaggatcttccatggctctctttggcagagttggtggaggtatctacaccaaagctgctgatgttggtgctgatcttgttggcaaggttgaaaggaacattcctgaggatgacccaagaaatcctgctgtgatcgctgacaatgtaggtgataatgttggtgatatagctggcatgggatccgatctttttggctcatacgccgagtcctcttgtgctgccctagttgttgcttccatctcttcttttggaatcaatcatgaatttactccaatgctatatcctctcattgtcagttctgtgggaatcattatttgtctgataaccaccttatttgcaactgatttctttgagatcaaggctgtgaaggaaattgagccagcactaaagaatcaactcatcatctcaactattctgatgactgttggggttgccattgttagttgggtagctctcccatcttcctttaccatcttcaattttggaacccagaaagttgtcaagaattggcaactcttcttgtgtgttgctgttggtctctgggccggtcttattattggatttgtaaccgagtactatactagcaatgcatacagccctgttcaagatgttgctgattcctgccgaactggagctgccactaatgttatttttgggcttgcattgggatacaaatctgtcatcattcctatctttgctatcgcagccagcatttttgttagtttctcttttgctgctatgtatggtattgctgtagctgcccttggaatgttgagcaccattgccactgggttggcaatagatgcatatggtcccattagtgacaatgccggaggtattgctgagatggcaggcatgagccacagaatccgagaaagaactgatgcccttgatgctgctggaaacaccactgctgctattgggaagggatttgccattggctctgcagctcttgtctccctggccctctttggtgcctttgtcagccgtgcatctatctcaacagtcgatgtattgactccaaaagttttcattggtttgattgtgggtgcaatgcttccttactggttctctgccatgacaatgaagagcgtgggaagtgcagcacttaagatggttgaggaagttcgcaggcaattcaacaccatccctggcttgatggaaggcactgccaagcctgactatgccacctgtgttaagatctccactgatgcatctatcaaggagatgatcccacctggtgcacttgtcatgctcacacccctcattgttgggatctttttcggtgttgaaactctatctggtgtccttgctggatcccttgtgtctggtgtccagattgccatctctgcctccaacactggtggtgcatgggataatgccaagaaatatattgaggctggtgcttcagagcatgcaagatctcttggccctaaaggatcagatccacacaaggcagctgttattggtgacaccattggggatccattgaaggatacatctggaccatcacttaacatcctcatcaaactgatggctgttgaatcactcgtctttgctccattctttgccacgcacggtggcctgctcttcaagatattctgagaatgagaaccggacaggcagaagaaatggtcccaccagtcccatctctcttgttttgccctgctattcatctttacctcaatatatgtagtttgtagttcgtgatgactttaaatttctctcctcgtgttgaatggtggagaaaatcttccctgttagggggttgatgatgacagcgatgatgacgataatcaatctagtgaagagagctggaccaaagttgtcattttgttttctagtaagaacagttaattttgcacattttacgcaattttgattgtatgttctctccttttgctctgtcttttcattttcatttttcttttctgtgctccacgctaaatattttaatcagctgttgtgtaaaatgcacaaaacatgccccagctgcctatttaaaattaaaaaaaaa

SEQ ID NO: 3700 - DNA, 2845 bp, Populus trichocarpa
tctctctccccttcaccatatcacacattcctcatcaggagcacactcctctctctctctctcgctcgctctctttctctcctgttagtggagaaacaaacaaacaagataaaatcagggtttcgtagggatgggttcgccgattttgccagatctgggaacggagattctgattccggtatgtgccattatcggaatcggattttctctctttcaatggctgttggtctccaaggtcaagcttacaccgggttcggcggcgtccaataacagtggaggtgctggaaagaatggacatggtgattacttgattgaagaagaagaaggacttaatgaccataatattgttcttaaatgtgctgagattcaaaacgccatctctgaaggtgcaacttctttccttttcactgaatatcaatatgttggaattttcatggttgcatttgcaatcttgattttcgttttccttggctctgttgagggatttagcacaaagagtcagccttgcacctatgacccattgaagctttgcaagcctgctcttgccactgctggcttcagcaccatagccttcgtgcttggtgccgtcacatcagtggtttctgggtttctcgggatgaaaattgccacctatgcaaatgccagaaccaccctggaggcaagaaaaggtgttgggaaggctttcatcactgcatttagatctggggcagtcatgggttttctccttgctgcaaatggtttattggtgctttacattgccatcaatctcttcaagctctactacggagatgactgggaagggctttttgaagctataactggttatggacttggaggatcttccatggctctctttggcagagttgcaggaggtatctacaccaaagctgctgatgttggtgctgatcttgttggcaaggttgaaaggaacattcccgaggatgacccaagaaatcctgctgtgattgctgacaatgtaggtgacaatgttggtgatatagctggcatgggatctgatcttttcggctcatatgccgagtcctcttgtgctgccttagttgttgcttccatctcctcttttggaatcaatcatgagtttactccaatgctatatcctcttattgtcagttctgtgggtatcattgtttgtttgctcaccaccttatttgcaaccgatttcttcgagatcaaggctgtgaatgaaattgagccagcactaaagaatcaactcatcatctccactgttctgatgactattggagttgccattgttagttggattgctctcccatcttcctttaccatcttcaatttcggaacccagaaagttgtcaagaattggcaactcttcttgtgtgttgctgttggtctctgggctggtcttgttattggatttgtaactgagtactatactagcaatgcatacagccctgttcaagacgttgccgattcctgccgaactggagctgccactaatgttatttttgggcttgctttgggatataaatctgtcattattcctatctttgcgattgcagtcagcatttttgttagtttctcctttgctgctatgtacggtattgctgtagctgcccttggaatgctgagtaccattgccactgggttggcaattgatgcatatggtcccattagtgacaatgccggaggtattgctgagatggcaggaatgagccacagaatccgagagagaactgatgcccttgatgctgccggaaacaccactgctgctattgggaagggctttgccattggctctgcagctctcgtctccctggccctattcggtgcctttgtcagccgtgctgctatttcaacggttgatgtgttgactcctaaagttttcattggtttgattgtgggtgcaatgcttccttattggttctctgccatgacaatgaagagtgtgggaagtgcagctcttaagatggttgaggaagtatgcaggcaattcaacaccatccctggcttgatggaaggcactgccaagcctgactatgcaacctgtgtcaagatctctaccgatgcttccatcaaggagatgatcgcacctggtgcacttgtcatgctcacaccccttattgttgggatcttttttggtgttgaaaccctctctggtgtccttgctgggtcccttgtgtctggtgtccagattgccatctctgcctccaacactggtggtgcatgggataatgccaagaaatatattgaggctggtgtttctgagcatgcaagatctcttggccctaaaggatcagatccacacaaggcagctgttattggtgacaccattggggacccattgaaggatacatcaggaccatcacttaacatcctcatcaaactgatggccgttgaatcacttgtctttgccccattcttcgccacacacggaggcctgctcttcaagatattctgagaacgagacatgacaagcagtgaaaatggtccaccagtcccatctctactgttttgtcctactatttttctcccctcaaaagtatatgtgtagttcgtagttgatgatggactttaaatctctctcctgatgttgactggtggagaaaattttccctgctcaaggggctgattgcgatgatgataatcaatctagtgaagagagctggacaaaaagttgtcattttattttctagcaagaacagttaaatttttgcaaatctgtcgcaaattttgattttattatgctttcttctgtttgagttgcctctattttgttttccttgaagatgcaagttcaaatttgaaaacataaatggattctgctcctggatatatatcaatcagctgcagtaatatgcgcagtgca

SEQ ID NO: 3701 - DNA, 2625 bp, Manihot esculenta
acacacataccttcattgctccagcgccccatactctattttcattctctgtgctctgtatctttagtttcttggttcttgtttttctggcttaaatttgggagattatgggtggggtgattttaccagatattggggctgagattctgattcccctgtgtgcgattatcggaattggattctcattgtttcagtggctgcttgtttcgaaagtgaagctggtccctggtggtagagatgcggcggcggggaataatggtgtaaggaagaatggttacaatgactatcttattgaagaggaggagggtctcaatgaccacaacgttgttcttaaatgcgccgatattcaaagcgccatatctgaaggggcaacttccttccttttaaccgaatacaagtatgttggagttttcatgattgcttttgcaatccttattttcctgttcctcggctcagttgagggattcagcaccaaggctcaaccttgcacctatgacccattgaagacgtgcaagcctgctctagccactgctgtcttcagcacagtttccttcttgcttggtgctatcacttctgtaatttctggctttcttgggatgaaaattgctacatatgcaaatgctagaaccacccttgaggcaagaaaaggagttggtaaggcttttatcactgcatttaggtctggtgctgtcatgggttttctccttgctgcaaatggtctcttggtgcttttcattgccatcaacctctttaagatatactatggtgatgactgggctggtctattcgaggctataactggttacggtcttggaggatcttccatggccctctttggtagagtggggggaggtatctacacaaaagctgctgatgttggtgctgatcttgttggaaaggtggaaaggaatattcctgaggatgacccaaggaatccagctgtaattgctgataatgttggtgataatgttggggatatagctggtatgggatctgacctttttggctcatatgcagagtcttcttgtgctgccctagttgttgcttccatttcctcttttggaattgatcatgagttgactccaatgctataccctcttatcatcagttctgtgggtatccttgtttgtttgctcaccactttgtttgcaactgacttctttgagatcaaggctgtaaaggaaattgagccagctttgaaaaagcagctcatcatctcaactgtgcttatgactgttggaattgccattgttagttggattgctctaccatcttccttcaccatcttcaattttgggactcagaaagttgttaagaattggcaacttttcttatgcgttgctgttggtctttgggctggtctcattattggatttgtaactgaatactacactagcaatgcatacagccctgttcaagatgttgctgattcttgccgcactggagctgccactaacgttatttttgggcttgctttgggatataaatcggtcattatccctatttttgccattgcagtcagcatttttgtcagtttcacctttgctgctatgtatggtattgcagtagctgcccttggaatgctgagcaccattgccaccggattggcaattgatgcctacggtcccattagtgataatgctggaggtattgctgagatggcaggcatgagccacagaatccgtgagaggactgatgcccttgatgctgcaggaaacaccactgctgctattggaaagggtttcgccattggctctgcagctctcgtgtcccttgctctctttggtgcctttgttagccgtgcttcaatttcaatagtagatgtgttgacaccgaaagtttttattggtttgattgttggtgcaatgcttccctattggttttctgctatgacaatgaagagtgtgggaagtgcagctctgaagatggttgaggaggtccgcaggcaattcaacaccatccctggtctgatggaaggcactactaagcctgactatgctacctgtgttaagatctccactgatgcttccatcaaagagatgatcccacctggtgcacttgtcatgctcaccccactcattgttggtatctttttcggtgtcgaaacactatccggtgtcctagctggatccctcgtatctggtgtgcagattgccatctctgcatctaacaccggtggtgcttgggataatgccaagaagtacattgaggcgggagcttctgagcatgcaagaactcttggccctaaagggtcagatgcgcacaaagcagctgttattggtgacactattggggacccattgaaggacacatctggaccttcacttaacatcctaatcaaacttatggcagtggaatcacttgtgtttgctccattctttgctacacatggagggctactcttcaagatactttaagtgggttcaagagaagcaagcacaaaatggcgacctagtcgcaatgttgtccggttcttcttcttcttcaaatccttgttattttgctcccaaaatatatgtagtctgtagttgaaaatttcccctttcagaagggtactcctgatgagtgataacaatgacaatgaccatgataatggttaatctagagttttccaatttcaaaatt

SEQ ID NO: 3702 - DNA, 2898 bp, Eucalyptus grandis
ccccccccccctctttctctctctctctctctctctctgctgtcccctcgttccttggagtttctccggcgagttccgcggccgagctccccccaccgccaccgcccgccaccgtcgtgccatggcgacgacgatactgtcggatctcggcgccgagatcctcatccccgtgtgcgccgtcgtcggcatcgtgttctccctcgtccagtggctcctcgtctccaaggtcaagctcacccccgccgacgccgccgccgctcccgccgcgaacaacgggaagaacgggtacaccgactacctcatcgacgaggaggagaacatcaacgaccacagcgtcgtcctcaaatgcgccgaaatccagaccgccatctccgagggagcaacttccttcctcttcaccgagtatcagtatgttggtgttttcatggttgcctttgccgtcttaatcttccttttcctcggatctgtggagggatttagcatgaagagccagccttgcacttatgacgcaaccaaattgtgcaagcccgccctggctactgctgtcttcagcactgtggccttcttgcttggtggtattacatcagtggtttctggcttccttggaatgaaaattgccacctatgcaaatgcaaggaccacccttgaggcaaggaaaggtgtcggcaaggcttttatcactgcattcaggtcgggtgccgtaatgggcttccttcttgctgcgaatggtcttctggtcctttacattgccatcaacctattcaagatttactatggtgatgactggggaggcctttttgaggctataactggttatggccttggtggatcctccatggctctatttgggagagttggtgggggtatctacactaaagctgctgatgtaggtgccgatcttgtcgggaaggttgaaaggaacattcctgaggatgaccctagaaacccagctgtgattgctgataatgtaggtgataatgtgggggacatagctggtatgggctcggatctctttggctcatatgccgagtcatcttgtgctgcgcttgttgtggcctctatctcttcctttgggatcaaccatgagttgactgcaatgctgtaccctctgattgttagctctgtgggtatccttgtttgtctggtcaccaccttattcgcaactgatttctttgagatcaaggctgttaaggagattgaaccagcactgaagaaacagctgataatttccacagttctcatgactgtgggaattgctgttgtcacttggatttccgttccttcttccttcaccattttcaactttggaactcagaaagttgtcaaaaactggcagctgttcttgtgtgtcgctgttggtttgtgggctggccttatcattgggtttgtgactgaatactatacaagcaatgcatacagccctgtccaagatgtggctgattcttgccgaactggagctgctactaacgtcatctttggtcttgcattgggatataaatcagtcatcattcccatttttgcaattgctgtcagcatttttgttagctttagctttgctgcaatgtatggaattgcagtagctgcgcttggaatgctgagcacaattgccactggattggcaattgatgcgtacggtcctatcagtgataatgctggaggaattgctgagatggcaggcatgagccacagaattagggagaggactgatgcccttgatgctgctggaaacactactgctgctattggaaagggtttcgccattgggtctgcagctcttgtgtcccttgccctctttggtgcctttgtgagccgtgcacatattgtgactgtcgatgtgttgactccgaaagtgttcatcggtttgattgtgggtgctatgcttccttactggttctctgcaatgaccatgaagagtgtgggaagtgccgccttgaagatggtggaggaggtccgtaggcaattcaacaccatcccaggtctcatggaaggcactgccaagcctgactacgcaacatgtgtcaagatctccaccgatgcttccatcaaagagatgatcccgccaggtgcactggtgatgctcactcccctcattgtcgggatctttttcggtgttgagactctgtctggtgttcttgccggatccttggtctccggggttcagattgccatctctgcttccaacactggcggtgcttgggacaatgccaagaagtacatcgaggctggcgcctcggagcatgcgaggacccttggtcccaagggatcagacccacacaaggctgccgtaatcggtgacaccatcggggaccctctcaaggacacatccggaccctcgctgaacatcctcatcaagctgatggcggtcgagtcacttgtctttgcgcctttctttgcaacccacggaggtttgctcttcaagatcttttgataggtggaaggaagagccgtagaaggcaacacgcctccgatttttttcctaatccgtctgtccaccctccttgtctcgccaatgtatctgccacaataactgtctttcttagaggatgttcgatttttgatgatgtatctgctcaaggcagcgttatctaacagtcctgaagaggctgacgacgatgacgacgataacgatgatctttttgtaagttggggttgcctgtcttttttcactagtgagaggtacttttttacaaattgaatgagttcggcctggtgtttcttcattttcttcttgcttaccattcgctacgacttggagcgtgaactggttatcttcttagcatcattatatgctgagaaatgagtttggtcatgataaatttcggtggccatttgctttgccaagaggctgatgacaagcaagtgattatactttgcgaggctcttttggaagtgcagatt

SEQ ID NO: 3703 - DNA, 2698 bp, Solanum tuberosum
ctccgaaaagccgtgttgttcttcactcttcatttaatcttcttgccgctattttccggcgaggtttttagggttccgttcataggatggggtcggcgttgttgccagatctagggacagagatagtgattccagtatgtgccgtcgttggaatcgtcttctctttattccagtggtaccttgtctcgcgtgttaaagtctcgtcggaacgtggagctacttctccgagtaacaataataagaatggatatggagactatttgattgaagaagaggaaggaattaacgaccagaacgttgttgcgaagtgcgccgagatacagaatgccatctctgaaggggcaacatcttttttatttaccgagtatcagtatgtgggtatcttcatgattgcttttgcaatcctgatcttccttttcttgggctcagttgaaggtttcagcactaagggccagccatgtacttacaacaaggagaagatgtgcaagccagcccttgcaactgcaatcttcagcacgatatccttcttgcttggtgctgtcacttctgttatctctggtttcttagggatgaaaattgcaacatatgcaaatgcaagaacaactttggaagcgagaaaaggtgttgggaaagcttttattgttgcattcaggtctggtgcagtgatgggttttctccttgccgccaatggcctcctagttctttacattgccattaatctcttcaagctttactatggtgatgactgggagggtctttttgaggcaattactggatatgggcttggtggatcctcaatggctcttttcggtagggttggtggtggtatttacaccaaagctgctgatgttggtgctgatctcgttggtaaggttgaaaggaacattccagaagatgatcccagaaatcctgctgtgattgctgataatgttggggataatgttggggacattgcaggaatggggtctgatctttttggttcatatgctgaatcatcttgtgctgctcttgtggtggcttccatctcatcttttggaattgaacatgattttacatccatgtgttaccccctgcttataagctccatggggattcttgtttgtttgataaccaccctttttgctaccgacttttttgaaattaaggctgtcaaagaaattgaaccagcactgaagaaccaacttattatatcaactgttcttatgacaattggaattgcaattgttacatggacttgccttccgtcttccttcaccatctttaattttggcactcagaaagttgtcaagaattgggagctctttttatgtgtggccgttggtctttgggctggacttatcatcggatttgtcaccgagtactacactagcaatgcttacagccctgtccaagatgtagcagactcctgcaggactggtgctgcgacaaatgttatttttggccttgctcttggatacaaatctgtcatcattcctatctttgccattgcaatagctatctttgtcagtttttcttttgctgccatgtatggtattgcagttgctgctcttggaatgttgagcacaattgcaactggattggcgattgatgcatatggtcctatcagtgacaatgctggaggcattgctgagatggctggcatgagccaccggatccgtgaaagaactgatgcccttgatgcagctggaaataccactgctgcgattggaaagggctttgccattggatctgctgcacttgtgtccctggctctgtttggtgcttttgttagtcgggctgcaatttcaacggttgatgtcttgacccccaaggtgtttattggtttgattgttggagccatgcttccctactggttctctgccatgaccatgaagagtgtgggtagtgcagctttgaagatggttgaggaagtgcgcagacaatttaacactattcctggtctcatggaaggccttgctaaacctgattatgccacttgtgttaagatctcgactgatgcatctatcaaggaaatgattccaccaggtgccctagtcatgctcacacccctcatagttggtattttctttggagtggagacactttctggtgtacttgccggtgctttggtatccggtgtacagatagcaatatctgcatcaaacactggaggtgcatgggacaacgccaagaagtatattgaggctggtgcttcagagcatgcaaggactctcggcccaaagggttctgaacctcacaaggctgctgttattggcgacaccatcggtgaccccctgaaggacacttcaggcccatcactcaacattttgatcaaactgatggcagttgagtcacttgtatttgctccattctttgccactcatggtggtatccttttcaagatcttttaaggaaagttggttgtagccgagacttgtggcatctttttcagtcaacatagcaagggatttttggattagtttctagtcagaagtggagtttcggtgatttgatgatgatgatagttgtcactgtaaggagggtagaagaaaattggtcagtgttgtagtaaaatagtcttgaagctagcgtattagctttctcatatttcatagacattaacttccaattttgtctgtactatcattatccacgtttaagttaatggagcaactattcagcttttcatttgttacagaaggtaggtagtcttttcatc

SEQ ID NO: 3704 - DNA, 2710 bp, Solanum phureja
actcaggaaaccctccgaaaagccgtgttgttcttcactcttcatttaatcttcttgccgctattttccggcgaggtttttagggttccgttcatagaatggggtcggcgttgttgccagatctagggacagagatagtgattccagtatgtgccgtcgttggaatcgtcttctctttattccagtggtaccttgtctcgcgtgttaaagtctcgtcggaacgtggagctacttctccgagtaacaataataagaatggatatggagactatttgattgaagaagaggaaggaattaacgaccagaacgttgttgcgaagtgcgccgagatacagaatgccatctctgaaggggcaacatcttttttatttactgagtatcagtatgtgggtatcttcatgattgcttttgcaatcctgatcttccttttcttgggctcagttgaaggtttcagcactaagggccagccatgtacttacaacaaggagaagatgtgcaagccagcccttgcaactgcaatcttcagcacgatatccttcttgcttggtgctgtcacttctgttatctctggtttcttagggatgaaaattgcaacatatgcaaatgcaagaacaactttggaagcgagaaaaggtgttgggaaagcttttattgttgcattcaggtctggtgcagtgatgggttttctccttgccgccaatggcctcctagttctttacattgccattaatctcttcaagctttactatggtgatgactgggagggtctttttgaggcaattactggatatgggcttggtggatcctcaatggctcttttcggtagggttggtggtggtatttacaccaaagctgctgatgttggtgctgatctcgttggtaaggttgaaaggaacattccagaagatgatcccagaaatcctgctgtgattgctgataatgttggggataatgttggggacattgcaggaatggggtctgatctttttggttcatatgctgaatcatcttgtgctgctcttgtggtggcttccatctcatcttttggaattgaacatgattttacatccatgtgttaccccctgcttataagctccatggggattctcgtttgtttgataaccaccctttttgctactgacttttttgaaattaaggctgtcaaagaaattgaaccagcactgaagaaccaactcattatatcaactgttcttatgacaattggaattgcaattgttacatggacttgccttccgtcttccttcaccatttttaattttggcactcagaaagttgtcaagaattgggaactctttttatgtgtggccgttggtctttgggctggacttatcatcggatttgtcaccgagtactacactagcaatgcttacagccctgtccaagatgtagcagactcctgcaggactggtgctgcgacaaatgttatttttggccttgctcttggatacaaatctgtcatcattcctatctttgccattgcaatagctatctttgtcagtttttcttttgctgccatgtatggtattgcagttgctgctcttggaatgttgagcacaattgcaactggattggcgattgatgcatatggtcctatcagtgacaatgctggaggcattgctgagatggctggcatgagccaccggatccgtgaaagaactgatgcccttgatgcagctggaaataccactgctgcgattggaaagggctttgccattggatctgctgcacttgtgtctctggctctgtttggtgcttttgttagtcgggctgcaatttcaacggttgatgtcttgacccccaaggtgtttattggtttgattgttggagccatgcttccctactggttctctgccatgaccatgaagagtgtgggtagtgcagctttgaagatggttgaggaagtgcgcagacaatttaacactattcctggtctcatggaaggccttgctaaacctgattatgccacttgtgttaagatctcgactgatgcatctatcaaggaaatgattccaccaggtgccctagtcatgctcacacccctcatagttggtattttctttggagtggagacactttctggtgtacttgccggtgctttggtatccggtgtacagatagcaatatctgcatcaaacactggaggtgcatgggacaacgccaagaagtatattgaggctggtgcttcagagcatgcaaggactctcggcccaaagggttctgaacctcacaaggctgctgttattggcgacaccatcggtgaccccctgaaggacacttcaggcccatcactcaacattttgatcaaactgatggcagttgagtcacttgtatttgctccattctttgccactcatggtggtatccttttcaagatcttttaaggaaagttggttgtagccgagacttgtggcatctttttcagtcaacatagcaagggatttttggattagtttctagtcagaagtggagtttcggtgatttgatgatgatgatagttgtcactgtaaggagggtagaagaaaattggtcagtgttgtagtaaaatagtcttgaagctagcgtattagctttgtcatatttcatagacattaacttccaattttgtctgtactatcattatccacgtttaagttaatggagcaactattcagcttttcatttgttacagaaggtaggtagtcttttcatc

SEQ ID NO: 3705 - DNA, 2752 bp, Cucurbita pepo
cactcactctgccaccaccccccaccaaaccctcgttttcttcttccttttctccttccttttgtggggttcgtttccctgtgtgtgttggtaattctttcgccatgagcgttaccattcttccagatctcgggactgagattttcattccggtatgtgccgttatcggaatcgtcttctctttggtgcagtggtattatgtttcgcaggttaagctctcgcctggccgagatgccgctcacaacaacagcgccggttctaagaatggttactccgactacctcatcgaggaggaagagggcgtcaacgaccataacgttgtgattaagtgtgccgaaattcagagtgccatttctgagggagcaacgtccttccttttcacggagtacaagtacgttggcatctttatggtgctgtttgcagtcttgatcttcgtattccttggctcagttgagagttttagtaccaagcctcaaccgtgcacatatgacaaaacaaggacttgtaagccagctttggcgactgctatattcagcactgtatcatttttacttggtgcagttacttcagtggtttctggtttccttggaatgaaaattgctacatacgcaaatgccagaaccaccttggaggcaagaaaaggtgttggaaaggcatttattactgcttttaggtctggtgctgtcatgggctttctcctagctgccaatggtctcttggttttgtttattgccattaacctcttcaaattgtactatggtgatgattggggtggtctttttgagtctatcactgggtatggtcttggtggttcttccatggctctctttggaagagttggtggtggtatctacaccaaagctgccgatgttggtgctgaccttgtgggcaaggtggaaaggaacattcccgaggatgatcccagaaacccagctgtgattgctgacaatgttggtgacaatgttggggatatagccggtatgggatctgatctgtttggttcgtatgctgaatcttcatgtgctgctctcgttgttgcttctatctctccttttggcaacaaccatgaattgacaccaatgctctaccctctcatcgttagttctatgggtattcttgtttgcctgatcaccaccttatttgcaactgatttctttgagatcaaggctgttaaggaaattgagccagcattgaagaagcaacttataatttccactgttctaatgacctttggaattgcaattgttacttggttgtctgttccatcatcattcaccattttcaactttggaactcaaaaagttgttacgaactggaaactgttcttgtgcgttgctgtgggtctctgggctgggcttataataggattcgtgacagagtactatacgagcaatgcatacagccctgtgcaagatgttgctgattcttgccgaactggagctgctacaaatgtcatttttgggttggcgttgggatacaaatctgtcattatccctatttttgcaattgcggtcagtatttttgtgagtttcacctttgctgccatgtacggcattgctgtagctgcccttggaatgctgagtaccatagctactggtttggccattgatgcatatggtccaatcagtgacaatgctggaggcattgctgagatggcaggcatgagccacagaattcgggagagaactgatgccctcgatgctgctggaaacaccactgcagccattggaaagggttttgccattggttcagctgcccttgtgtcccttgctcttttcggtgcctttgtcagccgtgccggtgtcactgctgttgacgtcttgacacccaaagtttttattggtttgattgtgggtgccatgctcccctactggttttctgccatgacaatgaagagtgttggtagcgcagccctaaaaatggttgaggaggtgcgaaggcagttcaacactatcccaggtctcatggagggtactgccaagcccgactacgctacatgtgtcaagatctcaactgatgcttctatcaaggagatgatcccacctggtgctcttgtcatgttgacaccactaattgttggtatccttttcggagttgaaactctttctggtgtccttgctgggtcccttgtttctggtgtgcagattgccatttctgcatctaacaccggaggtgcctgggataacgctaagaagtacatcgaggctggtgcctctgagcacgcaagaacccttggcccgaaaggatcagacccacacaaagccgctgttatcggtgacacgatcggagacccgctgaaggatacatccggaccatctttgaacattctgatcaagttgatggctgtcgagtcccttgtgtttgctcctttcttcgccagtcacggtggtcttctcttcaagatcttctgaaaagaagaacacgagtaatgggggaatggctggggcattgcattatctctggccctcctcctccattgacataactaccgcgcctcttctccgaaattttcattgcttttttagactccatattatatgctcctcaagtctgtagcttttgattccctttgagaaacgtgtagtttcaaatggacgagcgttttatcttctcatcggttgatgatgagaagatgatgaagaaaaaaaagaagatatttggttaaatcttgtgaaatgagactgcgaccttattctctttttcccaattgagaacaggctattattgttgttcccacactatgtctctctgt

SEQ ID NO: 3706 - DNA, 2777 bp, Hevea brasiliensis
acgcggggctctctttcacgctttacttacagtctctctctctttcaccctttgaaagttgccggcgttctgaagccggagaattgttttaggttcaggtgaggaggatggggacggcggtgctgtctgagctagggacggagatactcgtgcctgtttgcgcggtggttggcatcgttttctcattaattcagtggtacttggtctcgcgcgtgaagctcacgccggagcgccaggcacctgggtcatctccggccggtgctaacaagaatggctacaatgattgcctgattgaagaagaggaaggtctcaatgaccacagcgttgtggccaagtgcgctgagatacggactgcaatctctgaaggtgccacatcttttctgttcaccgaatatcagtatgttggggtgttcatggtggcttttgcaattctgatattccttttcctgggttctgttgagggctttagcacaaagagccaaccttgtacttatgataaacaaaaaacatgcaagccagcacttgctactgcaatattcagcactgtctcatttttgcttggtgctttcacctcagttgtctctggtttcctagggatgaaaattgctacctatgccaatgcaagaacaacactggaagcaagaaagggtgttggcaaggcttttattactgcatttaggtctggtgcggttatgggttttctccttgctgcaaatggtctattagttctctacattgctataaatctcttcaagctttactatggggaagattgggaaggcctctttgaatctattactggctatggtcttgggggttcttccatggctctttttggaagggttggtggtggtatttataccaaagctgctgatgttggtgcagatcttgtgggaaaggttgagagaaacattccagaagatgatcctagaaacccagctgtcattgctgacaatgttggtgacaatgttggagatattgctggtatggggtctgatctttttggctcatatgccgagtcatcttgtgctgcccttgttgttgtccccatctcctcttttggtatcaaccatgatttcactgcaatgctgtatcctctgcttattagttctgtgggtatcctcgtttgtttgataacaaccctctttgcaactgatttctttgaaatcaaggctgtaaaggaaattgaaccagcattgaagaagcagctcattatctccactgttcttatgactgtgggaattgcaattgtaacctggattggcttgccttcatctttcacaattttcaattttggaactcagaaggttgtcaagaactggcagttgttcttgtgtgtggctgttggtctttgggctggacttatcattggatttgttacagagtactacactagcaatgcatatagccctgtgcaagatgttgctgattcctgtaggactggggctgcaactaatgtcatctttggtcttgccttgggatacaaatctgtcatcattccaatttttgccatagcaattggtatttttgttagttttagttttgcagccatgtatggcattgctgtggctgctcttggaatgttaagcactattgccactggattggccattgatgcttatggtcccatcagtgacaatgctggaggcattgctgagatggctggcatgagccaccgcatccgtgagcgaactgatgcacttgatgcagctggcaacactactgctgctattgggaagggatttgccattggatctgctgcacttgtatctctggctttgtttggtgcttttgtgagccgtgcatctatttcaactgttgatgtcttgaccccaaaggtcttcattggtttgatagtgggtgccatgcttccgtactggttctccgccatgaccatgaagagtgtgggaagtgcagctttgaagatggttgaggaagttcgcaggcagttcaacaccattcctggtctcatggagggtcatgccaagcctgattatgctacctgcgtcaagatctctactgatgcatccatcaaagagatgattcccccaggtgctcttgtcatgctcacgcccctaattgtcggaaccttctttggcgttgagactctttctggtgttctggctggtgcccttgtttctggtgttcagatagcaatttctgcatctaacactggtggtgcatgggataatgccaagaagtatattgaggctggtgcttcagagcatgcaaggacactaggcccaaaaggttcagatccacacaaagcagctgtgattggtgacaccatcggtgacccacttaaggacacttcaggcccatcactcaacattctcatcaagcttatggctgtggaatctctcgtctttgctcccttctttgccactcatggtggcctgcttttcaagatgttctaaaagggataatgacgaagacatgggaaaggggagttgttataacgttgccttctcttgcagaatcctcatccacccacattctacttctgcatttatcttttctcccatttaatgggattttaaagctagtttccctagtttagtcaaatgctatttttgatgggctgatgatgacaattaaagatggtttgaatggcggctagaaaaatggtcattggttgcaagttgcaaatggttagtcatgtctgagggggagagtctgagaatttggtacattactctgtagttttggaacgacttgcttttaaaattttgtattgttacccttttctcttgctgaaaggatggcattttggattc

SEQ ID NO: 3707 - DNA, 2801 bp, Solanum lycopersicum
acttaggaaaccctccgaaaagccgtgttgttcttcactctacatttaattttcttgccgctattttccggcggggtttttagggttccgttcataggatgggttcggcgttgttgccagatctagggacagagatagtgattccagtgtgtgccgttgttggaatcgtcttctctttataccagtggtacgttgtctcgcgcgttaaagtctcgtcggaacgtggagatacttctccgagtaacaataataagaatggatatggagactacttgattgaagaagaggaaggagttaacgaccagaacgttgttgcgaagtgcgccgacatacagaatgccatctctgaaggggcaacatcttttctatttactgagtatcagtatgtgggtatcttcatgattgcttttgcaatcctgatcttccttttcttgggctcagttgaaggtttcagcactaagagccagccatgtacttacaacaaggagaagatgtgcaagccagcccttgcaactgccatcttcagcacgatatccttcttgcttggtgctatcacttctgttatctctggtttcttagggatgaaaattgcaacttatgcaaatgcaagaacaactttggaagcgagaaaaggtgttgggaaagcttttattgttgcattcaggtctggtgcagtgatgggttttctccttgctgccaatggcctccttgttcttcacattaccattaatctcttcaagctttactatggtgatgactgggagggtctttttgaggctattactggatatggacttggtggatcctcaatggctcttttcggtagggttggtggtggtatttacaccaaagctgctgatgttggtgctgatctcgttggtaaggttgaaaggaacattccagaagatgatcccagaaatcctgctgtgattgctgataatgttggggataatgttggggacattgctggaatggggtctgatctttttggttcatatgctgagtcatcttgtgctgctcttgtggtggcttccatctcgtcttttggaattgaacatgattttacatccatgtgttaccccctgcttataagctccatggggattcttgtttgtttgataaccaccctttttgctactgacttttttgaaattaaggctgtcaaagaaattgaaccagcactgaagcaccaacttattatatcaactgctcttatgacaattggaattgcaattgttacatggacttgccttccgtcttccttcaccatctttaattttggcactcagaaagttgtcaagaattgggagctctttttatgtgtggccgttggtctttgggctggacttatcatcggatttgtcaccgagtactacactagcaatgcttacagccctgtccaagatgtagcagactcttgcaggactggagctgcgacaaatgttatttttggccttgctcttggatacaaatctgtcatcattcctatctttgccattgcaatagctatctttgtcagtttttcttttgctgccatgtatggtattgcagttgctgctcttggaatgttgagcacaattgcaactggattggctattgatgcatatggtcctatcagtgacaatgctggaggcattgctgagatggctggcatgagccaccggatccgtgaaagaaccgacgcccttgatgcagctggaaataccactgctgcgattggaaagggctttgccattggatctgctgcacttgtgtctctggctctgtttggtgcttttgttagtcgggctgcaatttcaacggttgatgtcttgacccccaaggtgtttattggtttgattgttggagccatgcttccctactggttttctgccatgaccatgaagagtgtgggtagtgcagctttgaagatggttgaggaagtgcgcagacaatttaacactattcctggtctcatggaaggtcatgctaaacctgattatgccacttgtgttaagatttcgactgatgcatctatcaaggaaatgattccaccaggtgccctagtcatgctcacacccctcatagttggtattttctttggagtggagacactttctggtgtacttgctggtgctttggtatccggtgtacagatagcaatatctgcatcaaacactggaggtgcatgggacaacgccaagaagtatattgaggctggtgcttcagagcatgcaaggactctcggcccaaagggttctgaacctcacaaggctgctgttattggcgacaccattggtgaccccctgaaggacacttcgggcccatccctcaacattttgatcaaactgatggcagttgagtcacttgtatttgctccattctttgccactcatggtggtatccttttcaagatcttttaaggaaagttagttggagccgagacttgtggcatctttttcagtcaaacatagcacggaatttttggattagtttctagtcagaagtggagtttcagtggagctgatgatgatgatagttgtcactttaaggagggtagaagaaaattggtcactgctgtagtaaagtagtcttgaagctagtgtaatagctctctcatatttcatagacattaacttccaattttgtctgtactaccatataatgacccttattatcgtttaatggagcaattattcagcttctcatttgttagagaaggtaggtaatcttttcatcacattcatactttatttttggtttgtgtatttttgtcatgcagtcttctcagctctcacttcttccacccctctctggaggga

SEQ ID NO: 3708 - DNA, 2636 bp, Solanum lycopersicum
acttaggaaaccctccgaaaagccgtgttgttcttcactctacatttaattttcttgccgctattttccggcggggtttttagggttccgttcataggatgggttcggcgttgttgccagatctagggacagagatagtgattccagtgtgtgccgttgttggaatcgtcttctctttataccagtggtacgttgtctcgcgcgttaaagtctcgtcggaacgtggagatacttctccgagtaacaataataagaatggatatggagactacttgattgaagaagaggaaggagttaacgaccagaacgttgttgcgaagtgcgccgacatacagaatgccatctctgaaggggcaacatcttttctatttactgagtatcagtatgtgggtatcttcatgattgcttttgcaatcctgatcttccttttcttgggctcagttgaaggtttcagcactaagagccagccatgtacttacaacaaggagaagatgtgcaagccagcccttgcaactgccatcttcagcacgatatccttcttgcttggtgctatcacttctgttatctctggtttcttagggatgaaaattgcaacttatgcaaatgcaagaacaactttggaagcgagaaaaggtgttgggaaagcttttattgttgcattcaggtctggtgcagtgatgggttttctccttgctgccaatggcctccttgttcttcacattaccattaatctcttcaagctttactatggtgatgactgggagggtctttttgaggctattactggatatggacttggtggatcctcaatggctcttttcggtagggttggtggtggtatttacaccaaagctgctgatgttggtgctgatctcgttggtaaggttgaaaggaacattccagaagatgatcccagaaatcctgctgtgattgctgataatgttggggataatgttggggacattgctggaatggggtctgatctttttggttcatatgctgagtcatcttgtgctgctcttgtggtggcttccatctcgtcttttggaattgaacatgattttacatccatgtgttaccccctgcttataagctccatggggattcttgtttgtttgataaccaccctttttgctactgacttttttgaaattaaggctgtcaaagaaattgaaccagcactgaagcaccaacttattatatcaactgctcttatgacaattggaattgcaattgttacatggacttgccttccgtcttccttcaccatctttaattttggcactcagaaagttgtcaagaattgggagctctttttatgtgtggccgttggtctttgggctggacttatcatcggatttgtcaccgagtactacactagcaatgcttacagccctgtccaagatgtagcagactcttgcaggactggagctgcgacaaatgttatttttggccttgctcttggatacaaatctgtcatcattcctatctttgccattgcaatagctatctttgtcagtttttcttttgctgccatgtatggtattgcagttgctgctcttggaatgttgagcacaattgcaactggattggctattgatgcatatggtcctatcagtgacaatgctggaggcattgctgagatggctggcatgagccaccggatccgtgaaagaaccgacgcccttgatgcagctggaaataccactgctgcgattggaaagggctttgccattggatctgctgcacttgtgtctctggctctgtttggtgcttttgttagtcgggctgcaatttcaacggttgatgtcttgacccccaaggtgtttattggtttgattgttggagccatgcttccctactggttttctgccatgaccatgaagagtgtgggtagtgcagctttgaagatggttgaggaagtgcgcagacaatttaacactattcctggtctcatggaaggtcatgctaaacctgattatgccacttgtgttaagatttcgactgatgcatctatcaaggaaatgattccaccaggtgccctagtcatgctcacacccctcatagttggtattttctttggagtggagacactttctggtgtacttgctggtgctttggtatccggtgtacagatagcaatatctgcatcaaacactggaggtgcatgggacaacgccaagaagtatattgaggctggtgcttcagagcatgcaaggactctcggcccaaagggttctgaacctcacaaggctgctgttattggcgacaccattggtgaccccctgaaggacacttcgggcccatccctcaacattttgatcaaactgatggcagttgagtcacttgtatttgctccattctttgccactcatggtggtatccttttcaagatcttttaaggaaagttagttggagccgagacttgtggcatctttttcagtcaaacatagcacggaatttttggattagtttctagtcagaagtggagtttcagtggagctgatgatgatgatagttgtcactttaaggagggtagaagaaaattggtcactgctgtagtaaagtagtcttgaagctagtgtaatagctctctcatatttcatagacattaacttccaattttgtctgtacta

SEQ ID NO: 3709 - DNA, 2549 bp, Euonymus alatus
gaagcaatacagcgagcttcactgcttctgcgtctcttttccgggtttaaggtctctgattgtatttccggcgtaaagtgcaccggcaagttagggtcccggcgattagtagcaagatgggagagacggcggtgctgtcggagctggcgacggagatcttgatcccggtctccgcagtgattggcatcgtgttctctctcgtgcaatggtttctggtctcgcgcgtgaagctcacccccggacgacatgcatcgtcggcgaataacaagaagaacgggtacggtgactacttgattgaagaagaggaaggtcttgatgaccatagtgttgtcaccaaatgcgccgaaatccagaacgcaatttcggaaggtgcgacatcctttcttttcacggaatatcaatatgttggcatcttcatggtggccttcgcaattctgatctttcttttcttgggttctgtggagggctttagtacgaagagccaaccttgtacttataatgagcataagatgtgcaagccagcacttgctactgctgtcttcagcactgtgtctttcctgctaggtgctatcacttctatcctttctggtttcctggggatgaaaattgctacttatgccaatgcaagaacgacattagaagcaagaaagggtgttggcaaggcttttattactgcatttagatctggagcagtgatgggttttctccttgcagccaacggtctcttggtgctttatattgctattaacctcttcaagctgtattatggggatgactgggaaggcctgtttgaggctattactggatatgggcttgggggatcctccatggctctctttgggagagttgggggtgggatctacactaaagctgccgatgttggtgctgatcttgtgggaaaggtggagagaaacattcctgaggatgacccaagaaatccagctgttattgctgacaatgttggcgataatgttggagacattgctggtatgggttctgatcttttcggctcatatgcagaatcatcctgtgctgcccttgtcgttgcctccatctcctcttttggaattgaccatcagtttactgcaatgtgttatcctctgctcattagttctatgggtatccttgtttgtttaatcacaaccctctttgccactgatttctttgaaatcaaggctgtcaaggaaattgagcctgcactgaagaagcagcttattatttctactgttcttatgactgcgggaattgccattgttacttggcttggtttgccctcatcctttacaatttacaattttggtgttcagaaggttgttaagaactggcaactgttcttgtgtgtggctgttggtctttgggctggacttataattggatttgttactgagtactacaccagcaatgcctatagcccggtgcaagatgttgctgattcttgcagaactggagctgctacaaatgttatatttggccttgctttgggatacaagtctgttatcattccaatttttgccatcgcggtcagcatttttgttagtttcagctttgctgccatgtatggcattgcagtggcagccctgggaatgctgagcaccattgccactggattggcaattgatgcttatggtccaatcagtgacaatgctggtggtattgcagagatggctggcatgagccaccacatccgtgagagaactgatgcacttgatgctgctgggaacaccactgctgccattgggaagggatttgccattggatctgctgcacttgtctctttggctttatttggtgcctttgtcagccgtgctgcactatctactgttgatgttttgacccccaaggttttcattggtttgcttgttggcgccatgcttccttactggttctctgccatgaccatgaagagtgtaggaagtgctgctttgaagatggttgaggaggttcgaaggcagttcaacacaattccaggtctcatggaaggtctagccaagcctgattacgccacctgtgtcaagatatctactgatgcatccctcaaggagatgattccacctggtgcacttgtcatgcttactcccctcattgttgggacattctttggtgtggaaactttgtctggcgttctggcaggctcccttatttctggcgttcagatagcaatatctgcatctaacactggtggtgcatgggataatgcgaagaaatatatcgaagctggtgcttcagagcatgcgaggacccttggccctaaagggtccgacccacacaaggctgctgtcattggtgacaccattggagaccctctcaaggacacctcaggtccatcacttaacatcctcatcaagctcatggctgtggagtcgcttgtatttgctccctttttcgctactcatggtggtctcctgttcaagattttctgaggaaggaaacgaaacaaaaacaaaaaaaactggggaaagaggtttattactgtcactcccgctgtcttgtagaagcaatcctcgtttaccctgcatcatgtcaataataagttatgtttttgtttgttt

SEQ ID NO: 3710 - DNA, 2892 bp, Euonymus alatus
gggaaatgcccgcacacgctcactcttatcatgtccataccacacccgcaactcctctcttgtatataaactgctccacctcttcggtttccttcgcctccataaccatctctcgttcgttctctatctctctttcacactttcgtttatttggttcttgtatttcaagtcatgggttcggggattttgccagatctcgctaccgagatcttgattccggtgtgtgccgttataggcatagtcttcgctttagttcagtgggttattgtctctcgcgttaagctcacaccgggaagtgactctccggcgaacagtggagggaagaatgggtactctgattacctcatcgaggaggaggaaggacttaatgaccacaacgtcgtcctcaaatgcgctgaaatccagagtgcaatctctgaaggagcaacctcattcctttatacggaatatcagtacgtcgggattttcatggttgcttttgcaatcttgattttccttttccttggctccgttaatgggttcagcacaaagagccagacttgcacttatgacacacaatcaatgtgcaagccagctcttgccactgctgccttcagcacagtagccttcctgcttggtgctgtcacttcagtggtttctggcttcctagggatgaaaattgccacatatgcaaatgccagaactacgttggaggcaagaaaaggggttgggaaggcatttatcatcgcatttaggtctggcgctgtaatgggttttctcctcgcagcaaatggacttttggtactctacattgtgatcaacctcttcaagctgtactatggtgatgactgggaaggcctttttgaggctataactggttatggtcttgggggttcctccatggctcttttcggcagggttggtggaggtatctacaccaaagctgctgatgttggcgctgatcttgtgggcaaggttgaaagaaacattcctgaggatgacccaagaaatccagctgtgattgcggacaatgttggtgataatgttggggatatagctgggatgggttccgatctctttggctcatatgctgagtcatcatgcgctgccctagtcgttgcttccatctcctcattcgggattaatcatgattttactgcaatgttgtatcctctaatcatcagctcagttgggattgtcatttgtttgatcacaaccttgtttgcaacagatttctttgaggtcaaagctgtcaatgagattgagcctgcattgaaaaagcagctcatcatctcaacagttctgatgactgttgcagttgcaattgttacatggatatctgttccattttcattcaccatcttcaactttggaacccaaaaagtagtaaagagctggcaactcttcttatgtgttgctgttggtctttgggctggactcataattggatttgttactgagtattataccagcaatgcatacagtcctgtgcaagatgttgctgattcctgccgaactggagcggctactaacgtcatatttgggcttgcattgggatacaaatctgtcattattcctatatttgctattgcagttagcatatttgttagttttagctttgctgccatgtatggtgttgcggtagctgcccttggaatgctgagcaccattgcgactgggttggctattgatgcatatggtcccatcagtgataatgctggaggcattgctgagatggctggcatgagccacagaatccgagagagaaccgatgcccttgatgctgctggaaacacaactgctgctattggaaagggttttgccattggttctgctgctctggtgtccttggctttgtttggtgccttcgtgagccgtgcatctatcacgacagttgatgtgctcactccaaaggtttttattggtttgattgtgggtgctatgcttccttattggttctctgccatgacaatgaagagcgtgggaagtgcagctttgaagatggttgaggaagtccgtaggcaattcaacaccattcctggtcttatggagggaactgcaaagcccgactatgccaactgtgtgaagatttccactgatgcttctatcaaggagatgatcccacctggtgcccttgttatgctcaccccactcattgttgggatccttttcggtgtagaaactctggctggtgttcttgctggatctctagtgtctggtgtacaggtcgccatctctgcttccaacactggtggtgcttgggacaatgccaagaagtacattgaggctggtgcttccgagcatgcacgaaccctgggtcccaagggatcagatccacacaaggcagctgttattggtgacaccattggagaccctctgaaggacacatctggaccttcactcaacatcctcatcaagctaatggccgttgaatcactggtgtttgccccatttttcgctacacatggtggcatcctctttaagatattataaatcattggatagtctactggttactgtctgtcggatctctgttcctctttcctcataaaaaattattatgtagtttgtagtgcatggttgactctttaattcgccgcaaatttccctccccgggggttgctgaggacaatgacgatgatgataatagtcagcgttaggaagagtcggtgactcaattgtaatcctttttggtttttgggtctgggtagagctattcgtttccgaatcccttacattcattcgctttttgttatgcaatagattcgagtcttggtgttgtatcctggttcttacctaatggcttagatgccacagagtgttgtttctttttttacttgaggatcatatcgaataactcttaagcatctctcagattgcctgctatctatcttgttcacaggtagtttcatt

SEQ ID NO: 3711 - DNA, 2584 bp, Tropaeolum majus
aacacaattctttctacctctcttagcattttaccaggattgtgtgttgtttacgttcttccttgcctaactaatggggacggttatacttccagatctcggcaccgaaatccttattccggcatgtgctgtgatcggaatccttttctcactccttcagtatattaaggtggctagtgtcaagctgtcgccgccacgcgaatctgctgagaaaaatggccacaacgattacttgttggaggaagaggaaggccttaatgaccacaacgtagttgccagatgcgctgaaattcaacaggccatctccgaaggggcaacttcattccttttcaccgagtatcagtatgttggtattttcatggttgcttttgcaatcttgatctttgttttccttggctctgttgaaggatttagtacgaagagccagccatgttcttacgaccaggtcaagatgtgcaagcccgctcttgctacagctgccttcagcaccatatccttcttacttggggctatcacttcagttgtttctggttttcttgggatgaagattgctacatatgctaatgcaagaaccaccctagaggcaagaaagggagttgggaaggctttcatcgtagcatttagatctggtgctgtcatgggctttcttcttgctgcaaatggccttttggttctttacattaccattaacttattcaagatttactacggagatgactggtctggtctttttgagtctattactggttatggacttggaggatcctccatggctctctttggtagagttggtggaggcatttacactaaagctgctgatgttggagctgatcttgttggaaaggtggaaaggaacattccagaggatgacccaagaaatccagctgtgattgctgacaatgttggtgacaatgttggagatattgctggtatgggttctgatctttttggctcatatgctgaagcatcctgtgctgctcttgttgttgcttccatatcatcttttggaatcaatcacgagtttacttcaatgttatatccactcatcataagttctgtgggtatcattgtttgcttaattaccaccttatttgcaaccgacttctttgagatcaaagctgtgagcgaaattgaaccttcattgaaaaggcagctcataatatccactgttctaatgactattggaattgcaattgttagttgggtagctctgccgccttcctttaccattttcaattttggaacccaaaaggttgtgaagaactgggaattatttttatgtgttgctgttggtctttgggctgggcttattattggcttcgtaactgaatactacaccagtaatgcatacagtcctgtgcaagatgttgcagattcatgcaggactggggccgcaacaaatgtcatatttggtcttgcattgggatataagtctgtcatcattccaatttttgccattgcagtcagcatttttgttagcttcacttttgcagctatgtatggtgttgctgttgctgcacttggaatgctgagcactatagctactggattggctattgatgcatatggtcccatcagtgacaatgctggaggcattgctgagatggctggtatgagccacagaattagagagagaactgatgcccttgatgctgcaggaaacacaactgctgctattggaaagggttttgccattggctctgctgcccttgtgtctcttgccctgttcggggcctttgtgagccgtgctggcatttctacagttgatgtgttgactccaaaagtaatcattgggttgcttgttggtgctatgcttccttactggttttcggccatgacaatgaagagtgttggaagtgcagcactaaagatggttgaggaagtgcgcagacagttcaacacaatcccaggtctcatggaaggcactgccaagcccgactatgccacttgtgttaagatctctaccgatgcttccatcaaagaaatgataccacctggtgcccttgtcatgcttactccactcatcgttggcatcttatttggtgttgaaactctatctggtgttctcgctggttcccttgtttctggtgtacagattgccatttctgcatccaacacaggtggtgcttgggataatgccaagaaatatattgaggctggtgtttctgagcatgcgagaagtcttggtccaaaaggatcagatccacacaaggctgcggtcattggtgacaccattggagaccctctgaaggacacatctggaccatcactaaacatcctcatcaagcttatggctgttgagtcccttgtgtttgctcctttctttgcaacccatggtggcctgcttttaaagttataaatttgtggtcctcttgcactgataccatattttctagtacattagttagcagacaatttgcttgtcatacaatggatgtagtgaagagggaaaatatgttgctgtgtttggttagtgttaatgttatctgtacttcgtagaagtttagaatatttttgggctaaacgattcctcaaaggtctaggttaagagttgtgatcattcttcaattatatgataaacgag

SEQ ID NO: 3712 - DNA, 2706 bp, Catharanthus roseus
acatctccgccgtgataaggcagaggataacagaggatgggtgcggcgatactaccagatcttggtactgagattctgatcccggcttgtgcagtcgttggtatcgttttcgcgcttttccaatggattcttgtgtctaaggttaaactttcatctgataagcatcattcttccgccgccgctgcctctgacggaaagaatggattcactgaagcacttattgaggaagaagaaggtatcaatgaacatagtgttgttcagaagtgcgccgacattcaaaacgccatctctgaaggtgcaacctcctttctgttcactgagtaccaatatgttggggttttcatggtggcatttgccattttgatctttgttttccttggctctgtggagggattcagcacaaagggccgaacctgtacgtatgacacttccaagatatgcaagcctgctcttgctactgctggatttagcactgtatctttcttgcttggtgctgttacctctgtgctttcgggatttcttgggatgaaaattgctacctatgcaaatgctagaaccaccctggaggctagaaagggagttggaaaggcttttattaccgcatttaggtctggtgcagtgatgggattccttcttgctgcaaatggccttctggtgttgtatattgccataaacctctttaagttgtactatggcgatgactgggaaggtctgtttgaggctataactggttatggtctgggtggatcttcaatggctctttttggtagagttggtggaggcatctatacaaaagctgctgatgtaggagctgatcttgtgggaaaggtggagagaaacataccagaggatgaccctcgtaatcccgcggtgattgctgataatgttggtgataatgttggggatattgccggaatggggtctgatctatttggctcctatgctgagtcatcctgtgctgctcttgtagttgcttctatctcctcttttgggatcaatcatgatttgactgctatgttgtatcctcttctcatcagttctgttggaatcattgtttgtttgatcaccactttatttgcaactgacttctttgaagtcaaggatgtgaagcaaattgagccagcattgaagaggcaacttattatctccacaattttgatgacagtcggtattgctattgtcagtttggttggtcttccatcatccttcaccatatttaactttggtgttcagaaggaagttcggaactggcagctatttttgtgtgttgctgttggcttgtgggctgggcttattattggttttgtaactgagtattatactagcaatgcttacagccctgttcaagatgttgccgattcctgccgcactggagctgctaccaatgttatttttggccttgctttgggatacaagtcagttattattccaattttcgccatagcagtcagcatctttgtgagtttcacctttgctgctatgtatggtattgctgtagctgcacttggtatgcttagcaccatcgctactggattggccatcgatgcctatggtcccatcagtgacaatgctggaggcattgctgagatggctggcatgagccatagaattcgtgagagaactgatgcccttgatgctgctggcaataccactgctgccattggaaagggatttgcaattggttctgctgcacttgtgtcccttgctctctttggtgcgtttgtcagcagagctgcaatttcaactgtggatgtcctgacaccaaaggtgtttattggtttgattgtgggtgctatgcttccttactggttttctgccatgaccatgaagagtgtgggtagtgcagcacttaagatggttgaagaagtgcgcaggcaattcaacaccataccaggtctcatggaaggtactaccaagcctgactatgctacctgcgtcaagatctccacagatgcttctattaaggagatgattcctcctggtgcacttgtcatgctcacacccctcattgttgggatcttatttggtgtggagacactatctggagtacttgctggatccctcgtttcaggtgttcagattgctatttctgcatccaacactggaggtgcttgggataatgccaagaaatacatcgaggctggtgcttctgagcatgctagaactctcggtcccaagggatcagatgcccacaaagcagctgtgatcggtgacactattggtgatcctctcaaggacacatcaggaccatcactcaacattctgatcaagctcatggccgttgaatcactcgtctttgctcccttctttgccacccatggtggcctgctcttcaagatattctagagtactaggagtattacagaggaaactcgcccgcctgtaattcgcgtcattgtatggtctctccctcaaaagtatactacacattcatctctgttcctccccttagtttcctaacttttattttgtagtccccatgtctgtttagctgcaagctagaaatcttaaaagacaataggtttttggagagtagttttcccggtgggtctgtcgatgatgatgatgatgataattgtcgagttttcgcgtgacaggaaggtttgacaatggtattcgttccaagtaaatgaatgaacattataaatgcttacagcttactataaacaatcatgcattgttattttcatttgccaaggcaatgat

SEQ ID NO: 3713 - DNA, 2715 bp, Tabernaemontana elegans
ttttggttgagagctccagctagtgtttagggttgtgctgaaggatggcgtcggcgttgctgccagatcttgctactgagatcgtgattccggtgtgtgctgtcgtcggaattgtcttctcattaattcagtggtacctagtgtcccgcgtgaaactgtcgccggaacgaagcgcttcgagcaacaacaacaaaaatggttacaatgattacttgattgaagaagaggaaggcatcaatgaccagaacgtcgtcgttaagtgtgccgagattcaaagcgccatctcggagggtgctacatcgtttttgtttacggaatataaatacgttggattgttcatggtagcttttgcaatccttatcttcctcttcctgggatctgtcgatggcttcagcacaaagagccagccttgcacttataacaaggagaaaatgtgcaagtcagctcttgcaactgccatatttagcactgtatccttcttgcttggtggtttcacctcagttgtttctggtttccttgggatgaaaattgctacctatgctaatgcaaggacaactctggaagctagaaaaggtgttggcaaagcttttatcactgcgttcaggtctggtgcagttatggggtttctccttgcttcaaatgggcttttggttctctacattgcaatcaatctctttaagctgtactacggtgaagactgggaggggctgtttgaggcaattactggttatggtcttggtggatcttccatggctctctttggcagagttggtggaggtatatataccaaggccgctgatgttggtgctgatcttgttgggaaggttgaaaggaacattcctgaggatgatccccgaaatcctgcggtgattgctgacaacgtgggagataatgttggtgatattgctggaatggggtctgatctttttgggtcctatgctgaatcatcatgtgctgccctagttgtggcttctatttcttcttttggaatctatcatgagttcactcctatgttatatcccttgcttattagttccatgggcattctcgtctgcttgattacaaccctctttgcaaccgacttctttgagattaaggctgtcaaagaaattgaaccagcattgaagaagcagcttattatctccactgctcttatgactgttggagttgcaataattacatggacttgcttgccctcgtcgtttacgattttcaactttggtactcagaaggttgtcaagaactggcagctattcttgtgtgttggagtgggcctttggtccgggcttattattggatttgtgaccgagtattataccagcaatgcttatagtcctgtgcaagatgttgctgattcctgcaggactggagctgcaaccaatgttatatttggccttgctttgggatacaaatcggttatcattccaatttttgctattgcaataagtatttttgttagtttcagttttgctgccatgtatggtattgccatggccgcccttggaatgttgagcacaattgctactgggttggctattgatgcttatggccccatcagtgacaatgctggaggcattgctgagatggctggtatgagtcacagaatccgtgagagaactgatgcccttgatgctgctgggaacaccactgctgccattggaaagggatttgccattggatctgctgcacttgtttctcttgctctgtttggtgcctttgtcagtcgggcgggtatttcgacagttgatgtcttgacccctaaggttttcattggtttgattgttggtgccatgctaccatactggttctctgctatgacaatgaagagtgttggtagtgccgctctaaagatggtagaggaagttcgcaggcaatttaataccatccctgggctcatggagggtcaagccaagcctgactatgccacttgtgtcaagatctctactgatgcatctatcaaggagatgattcctccaggtgctcttgtcatgcttacacctctcattgttggtactttatttggtgtggagactcttgctggggtgcttgccggttcccttgtttctggtgtccagatagcaatctctgcatcaaacaccggtggtgcttgggacaacgctaagaaatacattgaggctggtgcttctgagcacgctagaacccttggtcccaagggatctgaaccacacaaagcagctgttattggagatactattggggatcctctcaaggatacatcaggtccatctctcaacattctcatcaagctgatggccgtcgagtctcttgtgtttgctcccttctttgcaactcatggtggcttgcttttcaagatataaggccttaatggccagaaaatatgggaggagtggcacagcctgcttttcctttgtagcattattctgagctccttagttatctttaccattttatcaccacccctttcttcgtttcatttcccagatgagtttttcttttagttagtttgtagctgcttggatattatttttgatgaggtgatgacgaagattgacaactgtgctggcgagaatgaagatgaaagaagcagatcatactgcagccccgcagagctaagaagaaatggttttgttaaacttctagatcagctagtttttaacttttgtttgtatgtgattgtttagctgaatgaacatggcagaattgtggcgatacatactaatgagtagcttcggc

SEQ ID NO: 3714 - DNA, 2751 bp, Malus domestica
tctcttcacactccgaagctctcagcagctcgaagaggctttcttttttgtcttttaagttctccggcatacggataccggctaagctagggttccggtgagtatggcagttctgctctcaaccctcgcgacggagattgtgatccccgtcgccgccgtcgtggggatcgtgttctctctcgtccagtggttcctggtctcgctcgtgaaggtcacgcccgagcgcaacgcgccgccttccggccccaacagtaacaagaacggctacaatgactacctaattgaggaggaggaaggcttgaatgaccagaacgtcgtcgttaagtgcgctgagatacagaacgctatctctgaaggttcaacatcctttcttttcactatgtaccagtatgttggggtcttcatggttgtatttgcaatcctgatcttcctcttcctcgggtctgtggagggcttcagcacaaagagccagccctgcacctatgatgccgcaaagacctgcaagccagcacttgcaactgcaattttcagcactgtagcttttgtacttggtggtataacctctgtcctgtctggttttcttggcatgaaaattgccacttatgccaatgctaggacaacattggaggccagaaaaggtgttgggaaggcctttattactgcatttaggtctggtgcagttatgggtttcctccttgcagcaaatggtcttttagtacttttcattactatcaatctctttaagctgtactatggtgatgactgggaaggactttttgagtccattactggctatggtcttggtggatcatctatggctctcttcgggagagtcggtggtggtatctataccaaggctgctgatgttggggctgacctggtaggaaaggttgaaagaaacattcctgaagatgacccaagaaacccagctgtgattgctgacaacgttggtgacaatgttggggatattgctggtatgggatctgatctctttggctcatatgccgaatcatcttgtgctgctttggttgttgcttccatttcctcatttggaatcaaccatgagttcacccctatgttgtatcctctcctcatcagttctgtgggcatcattgtttgtttaatcacaaccctatttgccactgatttctttgagatcaaggctgtcaaggaaattgaaccagctttgaaaaagcagcttatcatctccactggtctcatgactattggaattgcaattgttagctggattgctctgccatcatccttcacaattttcaattttggagttcagaaagttgttaaaaactggcaattgttcttgtgtgtggctgttggtctttgggctggactcattattgggttcgtcaccgagtattatactagcaacgcatacagccctgtgcaagatgttgctgactcctgcagaactggtgctgccaccaatgttatctttgggcttgctctgggatacaaatcagtcatcattccaatttttgccattgcagtcagcatttatgttagttttagctttgctgctatgtatggcattgcagtggctgcacttgggatgctgagcaccattgctacaggattggccattgatgcttacggtcccatcagtgacaatgctggaggcattgctgaaatggctggcatgagccatagaatccgtgagagaactgatgctcttgatgctgctgggaataccactgctgctattggaaagggatttgccattggatctgctgctctggtgtcattggctctatttggcgcctttgtcagtcgtgcagcaatctcaactgttgatgtcttaaccccaaaggtctttattggacttatcgtgggcgcaatgcttccttactggttctctgccatgacaatgaagagtgtgggaagtgctgcactaaaaatggttgaggaagtccgtaggcagttcaataccattccaggtctcatggagggcactgctaagcctgactatgctacctgcgtcaagatctccactgatgcatccatcaaggagatgattccacctggtgcccttgtcattcttacacctcttattgttggaacattctttggcgtggagaccctatccggtgttctggctggttcccttgtttctggtgtgcagatagcgatatctgcttctaacactggtggtgcatgggacaatgctaagaagtacattgaggccggtgcttcagagcatgcaaggacccttggcccgaagggttcagacccacacaaggcagcagtgattggtgacaccattggagacccgctcaaggacacctcagggccatcactcaacatccttattaagctcatggcagtggagtccctcgtgtttgctcccttcttcgccactcatggcggcctacttttcaagatcttttgagggaaggagtgtatgatggccattgtatcagggggaaatggccttgtaatatcattttgttctatttttggtccagagagcggaggttttattaacttttctttttcttgtaccagtattcctcttcccaccttgcttcttaggcagtgttgcagttaaattgcaaactctgagaattaatgacgaagatttgatgtaccgaaatgaaatgttcaacgaaaattgggttctatcttgaactcgagatttcgttttcccccgaattttggtagcaccgccgacttttgggatcatcaatttgattttctgtcattaacacaatttgttgatggcaactgaatgta

SEQ ID NO: 3715 - DNA, 2750 bp, Malus domestica
tcttttcacactccgaagctctcagcagctcgaagaggctctcttttttgtcttttaagttctccggcatacggacaccggctaagctagggttccggcgagtatggcagttctgctctcaaccctcgcgacggagattgtgatccccgtcgccgccgtcgtggggatcgtgttctctctcgtccagtggttcctggtctcgctcgtgaaggtcacgcccgagcgcaacgcgccgccttccggccccaacagtaacaagaacggctacaatgactacctaattgaggaggaggaaggcttgaatgaccagaacgtcgtcgttaagtgcgctgagatacagaacgctatctctgaaggttcaacatcctttcttttcactatgtaccagtatgttggggtcttcatggttgtatttgcaatcctgatcttcctcttcctcgggtctgtggagggcttcagcacaaagagccagccctgcacctatgatgccgcaaagacctgcaagccagcacttgcaactgcaattttcagcactgtagcttttgtacttggtggtataacctctgtcctgtctggttttcttggcatgaaaattgccacttatgccaatgctaggacaacattggaggccagaaaaggtgttgggaaggcctttattactgcatttaggtctggtgcagttatgggtttcctccttgcagcaaatggtcttttagtacttttcattactatcaatctctttaagctgtactatggtgatgactgggaaggactttttgagtccattactggctatggtcttggtggatcatctatggctctcttcgggagagtcggtggtggtatctataccaaggctgctgatgttggggctgacctggtaggaaaggttgaaagaaacattcctgaagatgacccaagaaacccagctgtgattgctgacaacgttggtgacaatgttggggatattgctggtatgggatctgatctctttggctcatatgccgaatcatcttgtgctgctttggttgttgcttccatttcctcatttggaatcaaccatgagttcacccctatgttgtatcctctcctcatcagttctgtgggcatcattgtttgtttaatcacaaccctatttgccactgatttctttgagatcaaggctgtcaaggaaattgaaccagctttgaaaaagcagcttatcatctccactggtctcatgactattggaattgcaattgttagctggattgctctgccatcatccttcacaattttcaattttggagttcagaaagttgttaaaaactggcaattgttcttgtgtgtggctgttggtctttgggctggactcattattgggttcgtcaccgagtattatactagcaacgcatacagccctgtgcaagatgttgctgactcctgcagaactggtgctgccaccaatgttatctttgggcttgctctgggatacaaatcagtcatcattccaatttttgccattgcagtcagcatttatgttagttttagctttgctgctatgtatggcattgcagtggctgcacttgggatgctgagcaccattgctacaggattggccattgatgcttacggtcccatcagtgacaatgctggaggcattgctgaaatggctggcatgagccatagaatccgtgagagaactgatgctcttgatgctgctgggaataccactgctgctattggaaagggatttgccattggatctgctgctctggtgtcattggctctatttggcgcctttgtcagtcgtgcagcaatctcaactgttgatgtcttaaccccaaaggtctttattggacttatcgtgggcgcaatgcttccttactggttctctgccatgacaatgaagagtgtgggaagtgctgcactaaaaatggttgaggaagtccgtaggcagttcaataccattccaggtctcatggagggcactgctaagcctgactatgctacctgcgtcaagatctccactgatgcatccatcaaggagatgattccacctggtgcccttgtcattcttacacctcttattgttggaacattctttggcgtggagaccctatccggtgttctggctggttcccttgtttctggtgtgcagatagcgatatctgcttctaacactggtggtgcatgggacaatgctaagaagtacattgaggccggtgcttcagagcatgcaaggacccttggcccgaagggttcagacccacacaaggcagcagtgattggtgacaccattggagacccgctcaaggacacctcagggccatcactcaacatccttattaagctcatggcagtggagtccctcgtgtttgctcccttcttcgccactcatggcggcctacttttcaagatcttttgagggaaggagtgtatgatggccattgtatcagggggaaatggccttgtaatatcattttgttctatttttggtccagagagcggaggttttattaacttttctttttcttgtaccagtattcctcttcccaccttgcttcttaggcagtgttgcagttaaattgcaaactctgagaattaatgacgaagatttgatgtaccgaaatgaaatgttcaacgaaaattgggttctatcttgaactcgagatttcgttttcccccgaattttggtagcactgccgacttttgggatcatcaatttgattttctgtcattaacacaatttgttgatggtaactgaatgt

SEQ ID NO: 3716 - DNA, 2746 bp, Tripterygium wilfordii
ccctgaagcattaacggagagcttctatacttcttcgtctcgtttccttgcttaaggtctgtaattgcatttccggcaggcgagttagggtccaggagattagtagcaggatgggagggacggtcatgctgtcggagctggctacggagatcttgatcccggtatgcgcagtgattggcatcgtgttctctctcgtgcaatggtctctggtctcgcgcgtgaagcttacgtacgaacgacacgactcgtcgccgaacaacaaaaagaacggttacggtggtgactacttgattgaagaagaggaaggtcttaatgaccatagtgtcgtcaccaaatgcgccgaaatccagaacgcaatctcggaaggtgcgacatcctttcttttcacggaatatcaatatgttggcatcttcatggtggcctttgcaattctgatctttcttttcttgggttctgtggagagctttagtactaagagccaaccttgtacttataatgagcataagatgtgcaagccagcacttgctactgctgtcttcagcactgtatctttcctgctaggtgccatcacttctgtcgtttctggtttcctggggatgaaaattgctacttacgccaatgcaagaacaacattagaagcaagaaagggtgttggcaaggcttttattactgcatttagatctggagcagtgatgggttttcttcttgcagccaacggtctcttggtgctttatattactattaacctcttcaagctgtattatggggatgattgggaaggtctgtttgaggctattactggatatggtcttgggggatcttctatggctctctttgggagagtgggtggtgggatctacactaaagctgccgatgttggggctgatcttgtgggaaaggtggagagaaatattcctgaggatgacccaagaaatccagctgttattgctgacaatgttggcgataatgttggagacattgctggcatgggttctgatcttttcggctcatatgctgaatcatcctgtgctgctcttgtcgttgcctccatctcctcttttggaattgaccatcagtttactgcaatgtgttatcctctgctcattagttctatgggcatccttgtttgtttaatcacaaccctctttgccactgatttctttgaaatcaaggctgtcaaggaaattgaacctgcattgaagaagcagcttattatttctaccgtttttatgactgtgggaattgcagttgtttcttggcttgctttgccctcatcctttacaatttacaattttggtgttcagaaggttgttaagaactggcaactgttcttgtgtgtgggtgttggtctttgggctggacttataattggatttgttactgagtactacaccagcaatgcatatagcccggtgcaagatgttgctgattcttgcagaactggagctgctacgaatgttatatttggccttgctttgggatacaagtctgttatcattccaatttttgccatcgcggtcagcatttttgttagtttcagctttgctgccatgtatggcattgcaatggcagccctgggaatgctgagcaccattgccactggattggcaattgatgcttacggtccaatcagtgacaatgctggtggtattgcagagatggctggcatgagccaccgcatccgtgagagaactgatgcacttgatgctgccgggaacaccactgctgccatcgggaagggatttgccattggatctgctgcactcgtctctttggctttatttggtgcctttgccagccgcgctgcaatatctactgttgatgttttggcccccaaggttttcattggtttgattgttggcgccatgcttccttactggttctctgccatgaccatgaagagtgtaggaagtgctgctttgaagatggttgaggaggttcgaaggcagttcaacacaattccaggtctcatggagggtctagccaagcctgattacgccacctgtgtcaagatatctactgatgcatccatcaaggagatgattccacctggcgcacttgtcatgcttactcccctcattgttgggacattatttggtgtggaaactttggctggcgttctggcaggctcccttgtttccggcgttcagatagcaatatctgcatctaacactggtggtgcatgggataatgcgaagaaatatattgaagctggtgcttcagagcatgcaaagaccctcggccctaaagggtctgaaccacacaaggctgctgtcattggtgacaccatcggagaccctctcaaggacacctccggtccatcacttaacatcctcatcaagctcatggccgtggagtcacttgtatttgctccctttttcgctactcatggtggccttctgttcaagattttctgaggcagaaaacgaaacaaaaaacaactggcgctgccttgtcgaagtaatccttgtttacagttgtattaccttgcatcatgtgagtgataagtttttttttagtttgtttttgttagtgattactactatttttgaagggcgaataattttgcgaattgagctaggttttattgatgacgaaaatggtcattcatatcgagggtgagttcaggtattattcccttgtagccttggaaaaacttcattttgaaagctgtactgttataatttttcatgcttggcaaggaaagcattttcaaagcttttgttgtaataataagattttggag

SEQ ID NO: 3717 - DNA, 2765 bp, Amsonia hubrichtii
acagagccaccgcagtattcgcccctccatctactctctttatttatttcgggagtttttttagtcttcagtgttagcagataagccgggaaagctacgccttagcgccaccgtgataaggcagaggaacagaggatgggtgaggcgatactaccagatcttggaacacagattctgatccctgtgtgtgctgttgttggtatcgtctttgcgcttgtccaatggtttattgtgtctaaggttaaggtctcctctgataagcaccattcttccgcggccgccgatggtaagaatggcttcactgaagctcttattgaggaagaggaaggcatcaacgaacatagtgttgttcagaagtgcgccgacatccaaaacgccatctccgaaggtgcaacctcctttctctttactgagtatcagtatgttggggttttcatggttgcatttgccgtcttgatcttcgttttccttggctctgtggaggggttcagcacaaagggccgggcttgtacatttgatagttccaagatatgcaagcctgctcttgctactgctgggtttagcactgtatctttcttgcttggtgctgttacctctgtgctttctggctttcttggaatgaaaattgctacctatgcaaatgctagaactaccctagaggctagaaagggagttggaaaggcttttattactgcatttagatctggtgcagtgatgggtttccttcttgctgcaaatggtcttctggtgttgtacattgccataaacctctttaagttgtactacggtgatgactgggaagggctgtttgaggctataactggttatggtcttggtggatcttcaatggccctttttggtagagttggtggaggcatctacacaaaggctgcagatgttggagctgatcttgtgggaaaggtggagaggaacataccagaggatgaccctcgaaatcctgcggtgattgctgacaatgttggtgataatgttggggatattgctggtatgggatccgacctgtttggctcctatgctgagtcatcctgtgcagcccttgtagttgcttcaatctcctcttttgggatcaatcatgaattcacccctatgttgtatcctcttctcataagctctgtcggaatccttgtttgcttgctcaccaccttattcgccactgacttctttgaagtcaaggatgttaagcaaattgagccagcactgaagaagcaacttattatctccacagttttgatgactatcggtattgcaattgtcagttggattggtcttccaacatccttcaccatatttaactttggtgtccagaaggaagttcggaactggcagctgtttttgtgtgttgctgttggtttgtgggctgggcttattattggatttatcaccgagtactatacaagcaatgcgtacagccctgttcaagatgttgcggattcctgtcgcactggagctgctaccaatgttattttcggccttgctttgggatacaaatcagttattattccgatattcgcaatagcagtcggcatttttgtgagtttcagctttgctgctatgtatggtattgcagtagctgcacttggtatgcttagcaccatagctactggattggccatcgatgcctatggtcccatcagtgataatgctggagggattgctgagatggctggcatgagccacagaattcgtgagagaaccgatgcccttgatgctgccggcaataccactgctgccattggaaagggatttgcaattggttctgctgcccttgtgtcccttgctctctttggtgcatttgtcagcagggctgcaatttcaactgtggatgttctgacaccaaaagtttttattggtttgctggtcggtgccatgcttccttactggttctctgccatgacaatgaagagtgtgggcagtgcagctcttaagatggttgaagaagtgcgcaggcaattcaataccataccaggccttatggaagggactaccaagcctgactatgctaactgcgtcaagatctccacagatgcttccatcaaagagatgattcctcctggtgcacttgtcatgctcacacctctcattgttggaatcttctttggtgtggaaacactatctggcgtccttgctggatcccttgtatctggtgttcagattgctatctctgcatctaatactggaggtgcttgggataatgccaagaagtatattgaggccggtgcttctgagcatgctagaactctcggtcccaagggatcagatccccacaaagcagctgtgattggtgacactatcggtgatcctctcaaggacacatcaggaccatccctcaacattctcatcaagctcatggccgttgaatcacttgtctttgctcccttctttgccactcacggtggcctgctcttcaagatattctagaagtaggagacagacagcaacttcattgcagaggatctgcctctaattcgtgtcattcaactgtcttcccgaaagtcccatttaccgctttttcctacagtttctaactttattttgtagtctgtgtccgtagctgcaaagttctagaaaatttaaagacataggtttgtggagagaagttttcccggtgggtctgtgctgatgatgatgattattctcagtcttgtgaacagggatgtcggcattgatatttttgcaaagtaaaatgaacagtttaaatatctactatacaaatcttgccctgttattttcagctatgaggattg

SEQ ID NO: 3718 - DNA, 3846 bp, Lotus japonicus
ctctttcaatcccttcttcttcttcttcttcttcttcttcttcttcctcaccaccatgggtgcagtccttctcccagatctcggaaccgagattttaattcccgtctgcgccgtcattggaatcgtcttcgctctcttccagtggttcctcgtctccaaggttaagatcaccgccgccactagagacgccgcttcccccgacgccgccggtaagaatggctacaacgattacctcatcgaggaagaggaaggtatcaacgaccagaacgttgttctcaaatgcgctgaaatccagcaagctatctctgaaggagcaacctctttccttttcactgagtacaagtatgtgggtatcttcatggtcttctttgccattgtgatattccttttccttggctccgtggaaggattcagcacaagccaccagccttgcaaatatgatgaaactaagatttgcaagccagctcttgccaccgcccttttcagtacaatttctttcgtgcttggtggcatcacatcagttgtttctggtttccttggaatgaaaattgcaacttatgccaatgctagaaccaccctggaggctagaaagggtgtcgggaaggctttcattacagcatttagatcaggtgctgtcatgggatttttgcttgcagccaatggccttttggttctttacattaccatcaacctattccagatttactacggtgaggactggggtggtctttttgaggccatcactggttatggtcttggtgggtcttctatggctttgtttggacgagttgctggaggtatctatactaaggctgctgatgttggtgctgatcttgtcggcaaggtagaaagaaacattcctgaggatgaccccagaaatccagctgtgattgctgataatgttggtgacaatgttggggatattgctggtatgggatctgatctttttggttcttatgctgaggcgtcatgtgctgctcttgttgttgcttccatctcttcttttgggattaatcacgagtttactgccatgctgtaccctctcattgtcagttctgtgggtatcgttgtttgtcttataaccaccttatttgcaactgacatttttgagatcaagctcgtaaaagaaattgagccagcattgaaaaaacagctcattatttcaacagtgctgatgactgttgggattgcaattgttagttggattgcactcccatcttccttcactatcttcaattttggagtgcagaaagatgtcaagaactggcagctattcttgtgtgttgctgttggtctttgggcagggcttatcattggatttgtaactgagtactatactagcaatgcatacagtcctgtgcaagatgttgctgattcctgcaggactggtgctgctaccaatgttatatttggccttgccttgggatacaagtctgttattattccaatttttgctattgcaattagtatttttgttagtttcagctttgccgccatgtacggtatcgctgttgctgcacttggaatgctgagtaccatagccaccggattggccattgatgcatatggtccaatcagtgacaatgctggaggtattgctgagatggctgggatgagtcacagaattcgagagagaactgatgcccttgatgctgcaggaaacaccactgctgctattggaaaggggtttgctattggttctgctgcccttgtgtccctggccctctttggtgcttttgtgagccgagctaatatcacaacagttgatgtgctgactccaaaggttttcatcggtttgatcgtgggtgctatgcttccttactggttctctgccatgaccatgaagagtgtgggaaaagccgcactgaagatggttgaggaggttcgcaggcaattcaacaccattccagggttgatggagggaactgctaagcctgactacgccacatgtgttaagatctccactgatgcttctattaaagaaatgattccacccggtgctcttgtcatgctcacacccctcatcgtaggaatctttttcggtgtcgaaacactttctggtgtcctcgccggatctctggtgtctggtgtacagattgctatctctgcatccaacactggtggtgcttgggataatgccaagaagtacattgaggctggtgcttctgaacatgccagaagccttggtcctaaaggctcagattgtcacaaagctgctgttattggtgacaccattggagaccctcttaaggatacatctggtccctcacttaacatcctcatcaagctaatggctgttgagtctctcgtgttcgcacccttcttcgctacccatggtggcttactcttcaagatctaagatttggcacaaaagagcatgccccatcaattttctataactgcagaacaaggaaaatcaccatatcttttctgtgttagtcttgactctttctgtgatgctgattctattggttttagaaatcttctccccccaccccgaatcaaagtaatgttttgtctcatctgtagagctgagattctcaattacgatgaatctgcagagaaaacttccttcctaggtgaggttggttgatgatgacgatcatattttattatctacaatctcttccttgtgaacattttcttactattgttattattattatgttcagatgaccaaaattttgagctcgttgtttgattaattattagagcagagtctattattatttcgattatattttaatatctactatctctttctcgtggtcattttcttataatgttcttcagctaccctgtttgattaattattagaccagctatacacatgggcattttctagtatattccttttgcttttcctgtatatccgtttggaaccgaagtgatgaaaggatggaataatgtttattgacatgattggatttgtggttaaattattttctcatcagtttttcttatataagttgttttgttagtttcttctcacatgagtttttcttccaacttgaatactgatctggtttttaaatgcacgcagagattgcatagacacttaaacgaaggaatagatccccatgtttcttgtaatttcatatctatgatattgggtcacctagccaaactaaacattgagataatgttgcttaggtgtgaccatggttcatacagtgtttgttctcactttccactgatatgttttgtttgtaaattaccaaattataaccatagttcatattcaatccaccatttcctttgaaaatcctataaacaaagtaaaaacagaatgccattttttaattgttaatacaatggtgtaaatgtgcttgttcaaggagaagaggagcttgtttttccttccctattgatgattttgcctttcttccaaattttggaaatcagaaatctgatctatttcttctccatgtgtgaagtaacaagtgatactcatcctgatagtagcatggtaagagaaacttgtctgggtatgaaaatttgaaaagagcagccctatagtcattttgtagtttctttctaaaaggcaagttcatatgattttattgagatgtgactagacaaaaaaagttttatacaggtaaaaatctacgtaaattaaccagactgtaaacacatttcttctattttgtggtgaattaacagaaaaaaacaatgaaaaatagtcattatcgaagaacagttagctagctgatgcttgaactgaattccaattctctgtggaatagtttactgaacgtgatatgttgcaatgtgtctttgcgatattttaatgttacgtgacgtgaaactaaaaattagatatgtgaagattgaaaatctttaatc

SEQ ID NO: 3719 - DNA, 2308 bp, Solanum lycopersicum
tggtacaatgggatcggcattgttgtcggaattcggtacagagattgtaattccgatttgcgccgttatcggaattgtgttctctcttgtacaatggtaccttgtctcgcttgttaaactgtcgcctgagcagggaggttgttctccgagaaacaacaagaacaatggattcaacgaaagtttagttgaggaagaggaaggtatcaatgaccagaacgttgttgttaagtgtgccgaaatacagaatgccatctccgaaggcgcaacatccttccttttcactgaatatcagtatgtgggtatcttcatggttgcttttgcagtcttgatcttcgtgttccttggctctgttgagggcttcagcaccaagagccagccatgcacttacaacaaggagaaaatgtgcaagccagcccttgctacggccatcttcagcacaatatccttcttgcttggtgctgtcacttcagttgtttctggtttccttgggatgaaaatagcaacatatgcaaatgcaaggacaactctggaagccagaaaaggagtcgggaaagcttttattactgcattcagatctggtgcggtaatgggttttctcctagctgccaatggcctcttggttctttatattacaattaatctctttaagctatactatggtgatgactgggagggactttttgaggcaattactggctacgggcttggtggatcttccatggctctttttggtagagttggtggtggcatttacaccaaggctgccgatgttggtgctgaccttgttggaaaggttgaaaggaacattccagaagatgatcccagaaatcctgctgtgattgctgacaatgttggtgataatgttggggacattgctggaatgggttctgatctttttgggtcatacgcggaatcatcatgtgctgctcttgttgtggcttccatctcgtcttttggaatagatcatgatttcactgcaatgtgttatcccctgctcataagttctatgggaatccttgtttgtttgataaccaccctttttgcaactgacttcttcgaaattaaggctgtcaaggaaattgaaccagccttgaagcaccagcttatcatctcaactgctcttatgacggtgggaattgcaattgtgacttggacttgccttccatcttcctttactatcttcaattttggcacacaaaaggttgtaaagaactggcaactgtttttatgtgtggctattggtctttgggctggacttatcattggatttgtcacagagtactatactagcaatgcttacagccctgtccaagatgtagctgactcctgcaggactggagctgcaaccaatgttatttttggccttgctcttggctacaaatctgtcatcattcctatctttgccattgcagtagctatctttgtcagttttacttttgccgccatgtatggtatcgctgttgctgctcttggaatgttgagtaccattgctactggattggccattgatgcatatggacctatcagtgacaatgctggaggtatagctgagatggctggaatgagccacaggatccgtgaaagaactgatgcccttgatgctgctggaaacaccactgctgctattggcaagggttttgccattggatccgctgcacttgtgtctctggccctgtttggtgcttttgtgagtcgggcttcaatttcaacagtcgatgtcttgacccctgaggtcttcattggtttgattgttggtgccatgcttccctactggttctctgccatgaccatgaagagtgtcggtagtgcagctctgaagatggttgaggaagttcgccgacaatttaacaccatccctggtctcatggaaggccttgccaagcctgattacgctacttgtgttaagatctcgactgatgcatctattaaagaaatgattcctccaggtgctctggtcatgcttacgcccctcatagttggaattttcttcggagtggagactctttctggtgttcttgccggtgctttggtttctggtgttcagattgcaatatctgcatcaaacactggtggtgcatgggacaatgccaagaagtatattgaggctggtgcttcggagcatgcaaggacccttggcccaaaaggttctgaaccacacaaagctgcggttattggtgacaccattggtgatcctctgaaggatacttcaggtccatcactcaatatcctaatcaagctgatggcagtagagtcacttgtctttgctccattctttgcaacacatggcggtatacttttcaagattttc

SEQ ID NO: 3720 - DNA, 2436 bp, Solanum lycopersicum
gtggtacaatgggatcggcattgttgtcggaattcggtacagagattgtaattccgatttgcgccgttatcggaattgtgttctctcttgtacaatggtaccttgtctcgcttgttaaactgtcgcctgagcagggaggttgttctccgagaaacaacaagaacaatggattcaacgaaagtttagttgaggaagaggaaggtatcaatgaccagaacgttgttgttaagtgtgccgaaatacagaatgccatctccgaaggcgcaacatccttccttttcactgaatatcagtatgtgggtatcttcatggttgcttttgcagtcttgatcttcgtgttccttggctctgttgagggcttcagcaccaagagccagccatgcacttacaacaaggagaaaatgtgcaagccagcccttgctacggccatcttcagcacaatatccttcttgcttggtgctgtcacttcagttgtttctggtttccttgggatgaaaatagcaacatatgcaaatgcaaggacaactctggaagccagaaaaggagtcgggaaagcttttattactgcattcagatctggtgcggtaatgggttttctcctagctgccaatggcctcttggttctttatattacaattaatctctttaagctatactatggtgatgactgggagggactttttgaggcaattactggctacgggcttggtggatcttccatggctctttttggtagagttggtggtggcatttacaccaaggctgccgatgttggtgctgaccttgttggaaaggttgaaaggaacattccagaagatgatcccagaaatcctgctgtgattgctgacaatgttggtgataatgttggggacattgctggaatgggttctgatctttttgggtcatacgcggaatcatcatgtgctgctcttgttgtggcttccatctcgtcttttggaatagatcatgatttcactgcaatgtgttatcccctgctcataagttctatgggaatccttgtttgtttgataaccaccctttttgcaactgacttcttcgaaattaaggctgtcaaggaaattgaaccagccttgaagcaccagcttatcatctcaactgctcttatgacggtgggaattgcaattgtgacttggacttgccttccatcttcctttactatcttcaattttggcacacaaaaggttgtaaagaactggcaactgtttttatgtgtggctattggtctttgggctggacttatcattggatttgtcacagagtactatactagcaatgcttacagccctgtccaagatgtagctgactcctgcaggactggagctgcaaccaatgttatttttggccttgctcttggctacaaatctgtcatcattcctatctttgccattgcagtagctatctttgtcagttttacttttgccgccatgtatggtatcgctgttgctgctcttggaatgttgagtaccattgctactggattggccattgatgcatatggacctatcagtgacaatgctggaggtatagctgagatggctggaatgagccacaggatccgtgaaagaactgatgcccttgatgctgctggaaacaccactgctgctattggcaagggttttgccattggatccgctgcacttgtgtctctggccctgtttggtgcttttgtgagtcgggcttcaatttcaacagtcgatgtcttgacccctgaggtcttcattggtttgattgttggtgccatgcttccctactggttctctgccatgaccatgaagagtgtcggtagtgcagctctgaagatggttgaggaagttcgccgacaatttaacaccatccctggtctcatggaaggccttgccaagcctgattacgctacttgtgttaagatctcgactgatgcatctattaaagaaatgattcctccaggtgctctggtcatgcttacgcccctcatagttggaattttcttcggagtggagactctttctggtgttcttgccggtgctttggtttctggtgttcagattgcaatatctgcatcaaacactggtggtgcatgggacaatgccaagaagtatattgaggctggtgcttcggagcatgcaaggacccttggcccaaaaggttctgaaccacacaaagctgcggttattggtgacaccattggtgatcctctgaaggatacttcaggtccatcactcaatatcctaatcaagctgatggcagtagagtcacttgtctttgctccattctttgcaacacatggcggtatacttttcaagattttctaagtagaaagacacttcaccaagtcctatggtattttcattcttcaccaacccttttttgctctaatttctccaagcatggaatttcttcattagttcttagctagtcacaggtttagtttgaaga

SEQ ID NO: 3721 - DNA, 2756 bp, Fragaria vesca
aaacacaaaacacaacagtccaaatcaaactctctgtcttccttttgttcttgtttctctttcggttcggtcgtgttcggcgcagctctatgggggcgagtattctcccagatctcggggccgagattttgattccgttctgcgcggtggtcggaatcgtcttctctctgctccagtgggtctacgtgtcacgtgttcagctctcgccggcgagagactccaattctaactccaccggaaaaaatggctacaacgattaccttatcgaggaggaagagggtgttaacgacaacaacgttgttcagaagtgcgccgaaatccagaacgccatctccgaaggagcaacatcatttctttacactgaatataaatatgttggtgctttcatggtggcatttgcaatcttgatattcgttttccttggctctgtggagggatttagcactagtggccataaatgtgctaatgacgaaacaaagatgtgcaaacctgctcttgcaactgccttattcagcactgtttcctttttgcttggtgctataacttcagtggtttctggattccttggtatgaagattgctacttatgcaaatgccagaactactttggaggcaagaaaaggtgttgggaaggcttttatagttgcatttagatcaggtgctgttatgggatttctccttgctgcaaatggtttattggttctttacattgtgatccttgtcttcaagatgtactatggtgaggactggggtggtctttttgagtccataactggttatggtcttggcggatcttctatggctctctttggcagagttggtggaggcatctataccaaagctgctgatgttggtgctgaccttgttggcaaagttgaaaggaatattcctgaggatgacccaaggaacccagctgtgattgctgataatgttggggacaatgttggggatattgccggaatgggatctgacctctttggatcatatgctgagtcatcatgtgctgctcttgttgttgcttcaatttcctcatttgggatcaatcatgagttaactgcaatgttatatcctctcatcgtcagttccattggtatcattgtttgtctgatcaccacccttttcgcaactgatttctttgagatcaaggctgtaaaggaaattgagccagcattgaagaggcaactcattatttccactgtactgatgactgttggagttgcgatcgttacatggatttctgttccttcttccttcaccatctttaattttggaacccagaaagttgttaagaactggcaactgttcttatgtgtgtgtgtgggtttgtgggctggacttatcatcggatttgtaacagagtattataccagtaatgcgtacagccccgtgcaagatgttgctgattcgtgccggacaggagctgctactaatgtcatttttggcctggcattgggatacaaatcagtcatcattcctatttttgccattgccattagtatttatgttagttttagctttgccgctatgtatggtattgctatagctgcccttggaatgcttagcaccatagcgactggattggccattgatgcatatggtccgatcagtgacaatgctggaggtattgctgagatggcaggcatgagccacagaatcagagagagaacggatgctcttgatgctgcaggaaacacaacagctgctattggaaagggttttgcaattggctctgctgctctcgtgtcccttgctctctttggtgcctttgtgagccgtgctggaattgcaacagttgatgtgttgactccaaaagtgtttattggtttgattgtgggtgcaatgcttccctactggttctctgccatgacaatgaagagtgtgggaagtgctgctctgaaaatggttgaagaagtacgcaggcaattcaacaccatccctggcctcatggagggtactgccaagcctgactatgctacgtgtgttaagatctctactgatgcttccatcaaggaaatgattccacctggtgcccttgtcatgcttacgcccctcatcgtcgggatcttttttggtgtggagactctctccggtgtccttgctggatccctcgtctctggtgtacagatcgcaatctctgcatccaacactggtggtgcttgggacaacgccaagaagtatattgaggctggagcttctgaacacgcaaggagtcttggtcccaagggttcagatccacacaaagcagctgtcattggtgacactgttggagaccctctcaaggacacatctggcccatctctcaacatcctcatcaagctcatggccgtcgagtcccttgtctttgcacctttcttcgccacacacggtggcctccttttcaagctctaaatgaaaacccgagatatcagacaagcgagaagtagtccaagctcccctctccccatcaagtgccgcatttcaccccaattctcggacgttatcaagctcacctccatcagccgatcctttcaccttgtcaccttattggtctgtaggacatgttttagccttttcagtagtttctgagattagaattgacgggaaaagcctgaaaattttccccctttgtcataggggttgatgtaacgtggaatggtgattgaaattgataatgatgatgatgatatatgaaacctcttgactgttgcatttcccatgatattagaaacaaaataaaaaagtttactagttcaattatatatttgtggtaagtggaac

SEQ ID NO: 3722 - DNA, 2700 bp, Aquilegia formosa
ctgtttcatttccggccaatttggacggaaaacaaaacattttgtttaccggcggtgaaatttatataagtatgggagcaacaataatttcagatcttgtaacagaaattgttattccggtttgtgcagtaatcggaatcttgttttcattacttcaatggtatttagtttctcaagttaaactttctcctgatagacaacaatctcctaaaaataataaaagtggttttaatgattatttgattgaagaagaagaaggtttaaatgataataatgttgttatcaaatgtgctgaaatccaacaagctatttctgaaggagcgacttccttcttgttcacggaatatcagtatgttggtatcttcatggttgcatttgcagtcttgattttcctcttccttggatctgttgagggattcagcacaaagagccagccttgcacctacaacaagcatgaaatgtgcaaatctgctcttgccaatgctctcttcagcaccatatcatttgtgcttggtgccatcacctctgtggtatctggtttccttggaatgaaaatcgcaacttatgcaaacgccaggacaaccctagaggcaaggaagggtgttggaaaggctttcatcactgcattcagatctggtgcagttatgggattcctcctagctgctagtggactcttggtgctttttattacgattaactgctttaagctatactatggtgatgattgggaaggtctttttgaggctattactggatacggtcttggtggttcttccatggctctctttgggagagttggtggtggtatttacacaaaagctgctgatgttggtgcagatcttgttggtaaggttgagaggaacattcctgaggatgaccctagaaatccagcggttattgctgacaatgtcggagataatgttggtgatattgctggaatgggttctgacctttttggctcatatgctgaggcctcttgtgctgctttggttgttgcctccatctcatcctttggaattaaccatgaatacactgcaatgttgtatccactactcatcagctctatgggtatccttgtatgcctactcaccaccctctttgccactgatttctttgaaatcaaggctgtcaaggaaattgagcctgcgttgaagaaccagctcattatatcaactgccttaatgactgttgggattgcacttgttacctggcttgcccttccttcatccttcacaattttcaattttggagagcagaaagttgtgaagaattgggagctatttttttgtgttgccattggtctatgggctgggctggttattggatttgtgactgagtactatacgagcaatgcatacagccctgtgcaagatgttgctgattcctgcagaactggagctgctacaaatgttatatttggccttgctctgggatacaaatctgtcattattccaatttttgccattgctgtcagtatttttgtgagtttcagccttgctgccatgtatggtattgcagtagctgctcttgggatgttgagcaccattgctactggcttggctattgatgcatatggtcccattagtgataatgctggaggcatcgctgagatggctggcatgagccacaggatccgagagagaactgacgctcttgatgctgctggaaacactactgctgctattggaaagggttttgccattggctctgctgctttggtgtctttggccctctttggtgcttttgtgagccgtgcagctatttccactgtcgatgtccttacccctaaggtctttattgggctgattgttggtgcaatgcttccatactggttctctgcaatgaccatgaagagtgttggaagtgctgctctaaagatggtagaggaagtgcgcaggcagttcaataccatccctggtctcatggagggtactgctaaacccgactatgcgacatgtgttaagatctctactgatgcatctatcaaggagatgatcccacctggtgccctggttatgctcacacctcttattgttggcaccttttttggtgttgagactttgtctggtgtcttggctggctcccttgtttctggcgtacagattgccatctctgcttcgaacactggtggtgcatgggataatgccaagaagtatattgaggctggtgcttctgagcacgccagaagccttggtccaaagggatctgatccacacaaggcagctgttattggtgacaccattggagatcctctcaaggacacttcaggcccatctctcaacattcttatcaagctcatggccgtggagtcgcttgtgtttgctcctttctttgctaaacatggtggcctactctttaagattttctaaacggttgaagcaaaagaaaggtgttttgcattctctcggtactcaacaagtagtcacctttcaatccacatttcaaaattgagtttgatttagttttccatgatgaacggtaggtactatttttgtagttactatatttttctagggttcagtagcttgagtaaaaatttcctgattggctggcggtggtgatgatgatgatgataatttttcaagtggaagggaaacagtggtataaggtcttatgttctttttttttttttttattgtgtcgtcaagaaggatttaatgtgtaacttaaattgtatctcttgaaatatagagaaagtat

SEQ ID NO: 3723 - DNA, 2874 bp, Aquilegia formosa
accctttgaagctctcttcatacttgtgggtgtttctctctttctttttttctgtttcatttccggccaatttgaacggaaaacaaaacattttgttttctttttttctgtttcatttccggccaacaaaacattttgttttctttttttctgtttcatttccggccaatttggacggaaaacaaaacattttgtttaccggcggtgaaatttatataagtatgggagcaacaataatttcagatcttgtaacagaaattgttattccggtttgtgcagtaatcggaatcttgttttcattacttcaatggtatttagtttctcaagttaaactttctcctgatagacaacaatctcctaaaaataataaaagtggttttaatgattatttgatcgaagaagaagaaggtttaaatgataataatgttgttatcaaatgtgctgaaatccaacaagctatttctgaaggagcgacttccttcttgttcacggaatatcagtatgttggtatcttcatggttgcatttgcagtcttgattttcctcttccttggatctgttgagggattcagcacaaagagccagccttgcacctacaacaagcatgaaatgtgcaaatctgctcttgccaatgctctcttcagcaccatatcatttgtgcttggtgccatcacctctgtggtatctggtttccttggaatgaaaatcgcaacttatgcaaacgccaggacaaccctagaggcaaggaagggtgttggaaaggctttcatcactgcattcagatctggtgcagttatgggattcctcctagctgctagtggactcttggtgctttttattacgattaactgctttaagctatactatggtgatgattgggaaggtctttttgaggctattactggatacggtcttggtggttcttccatggctctctttgggagagttggtggtggtatttacacaaaagctgctgatgttggtgcagatcttgttggtaaggttgagaggaacattcctgaggatgaccctagaaatccagcggttattgctgacaatgtcggagataatgttggtgatattgctggaatgggttctgacctttttggctcatatgctgaggcctcttgtgctgctttggttgttgcctccatctcatcctttggaattaaccatgaatacactgcaatgttgtatccactactcatcagctctatgggtatccttgtatgcctactcaccaccctctttgccactgatttctttgaaatcaaggctgtcaaggaaattgagcctgcgttgaagaaccagctcattatatcaactgccttaatgactgttgggattgcacttgttacctggcttgcccttccttcatccttcacaattttcaattttggagagcagaaagttgtgaagaattgggagctatttttttgtgttgccattggtctatgggctgggctggttattggatttgtgactgagtactatacgagcaatgcatacagccctgtgcaagatgttgctgattcctgcagaactggagctgctacaaatgttatatttggccttgctctgggatacaaatctgtcattattccaatttttgccattgctgtcagtatttttgtgagtttcagccttgctgccatgtatggtattgcagtagctgctcttgggatgttgagcaccattgctactggcttggctattgatgcatatggtcccattagtgataatgctggaggcatcgctgagatggctggcatgagccacaggatccgagagagaactgacgctcttgatgctgctggaaacactactgctgctattggaaagggttttgccattggctctgctgctttggtgtctttggccctctttggtgcttttgtgagccgtgcagctatttccactgtcgatgtccttacccctaaggtctttattgggctgattgttggtgcaatgcttccatactggttctctgcaatgaccatgaagagtgttggaagtgctgctctaaagatggtagaggaagtgcgcaggcagttcaataccatccctggtctcatggagggtactgctaaacccgactatgcgacatgtgttaaaatctctactgatgcatctatcaaggagatgatcccacctggtgccctggttatgctcacacctcttattgttggcaccttctttggtgttgagactttgtctggtgtcttggctggctcccttgtttctggcgtacagattgccatctctgcttcgaacactggtggtgcatgggataatgccaagaagtatattgaggctggtgcttctgagcacgccagaagccttggtccaaagggatctgatccacacaaggcagctgttattggtgacaccattggagatcctctcaaggacacttcaggcccatctctcaacattcttatcaagctcatggccgtggagtcgcttgtgtttgctcctttctttgctaaacatggtggcctactctttaagattttctaaacggttgaagcaaaagaaaggtgttttgcattctctcggtactcaacaagtagtcacctttcaacccacatttcaaaattgagtttgatttagttttccatgaacggtaggtactatttttgtagttactatatttttctagggttcagtagcttgagtaaaaatttcctgattggctggcggtggtgatgatgatgatgataatttttcaagtggaagggaaacagtggtataaggtcttatgttctttttttttttttattgtgtcgtgaagaaggatttaatgtgtaacttaaattgtatctcttgaaatatagagaaagtattgggaagaaagatttcttgatttctattc

SEQ ID NO: 3724 - DNA, 2411 bp, Vinca minor
tcctaacatttctcttcgtctctccggctagttagtttttagggttgcagtgaaagatgacgtcagctttgttaccagatctaggtactcagatcgtgattccggtatgtgctatcatcggaatcgtgttctcattgattcagtgggtcctagtttcccgcgtaaaactctcgcctgaaagaaattcttcgaccaacaaaaataaagatggttacaatgattacttaattgaagaagaagaaggcatcaatgaccacaacgtcgtcgctaagtgtgctgagattcaaagcgccatctccgaaggtgctacatcatttttgtttacggaatacaaatatgttggctttttcatggctgcttttgcaatccttatcttcctcttcctgggatctgtcgagggcttcagcacaaagagccagccttgcacgtataacaaggaggaaacgtgcaagccagcccttgcaactgctgtatttagcactttatccttcgtgctcggtgctgttacctcagttgtctctggtttcctggggatgaaaattgctacttatgccaacgcgaggaccactttggaggcgagaaaaggtgttggcaaggcttttatcgttgcgttcaggtctggtgcagtaatgggatttctccttgcagcaaatgggcttttggtgctctacattgtgatcaacgtctttaagttgtactatggcagtgattgggagggtcttttcgaggccattactggctatggtcttggtggatcttccatggctctcttcggcagagttggtggaggtatctataccaaggctgctgatgttggtgctgatcttgtcgggaaggttgaaaggaacattcccgaggatgatccgagaaatcccgctgtgattgctgacaatgtgggggataatgttggtgatattgctggaatggggtctgatcttttcggttcttatgctgaatcatcatgtgctgccctcgttgtggcttctatttcctcttttggaatcgatcatgacttcactgcaatgttatatccgttgctgattagttccatgggaattattgtctgcttgattactaccctttttgcaactgacttctttgagattaagactgtggaggaaattgaacctgcactgaagaagcagcttattatttccactgttcttatgactgttggagttgcaatagttacatggacttgcttgccttcttcgtttacaattttcaacttcggtactcagaaggttgtcaagaactggcaactattcttgtgtgttggtgttggtctctgggccgggcttattattggatttgtaacagagtattataccagcaatgcttacagtcctgtgcaagatgtagctgattcctgcaggactggagctgctacaaatgttatttttggccttgccttgggctacaaatcagtcatcattccgatttttgctatcgccataagtatttttgttagtttcacttttgctgccatgtacggtattgctatggctgctcttggaatgttgagcacaattgctactgggttggctattgatgcttatggccccatcagtgataatgctggtggcattgcagagatggctggaatgagccacagaattcgtgagcgaactgatgctctcgatgccgctggaaacaccactgctgccattggaaagggtttcgccattggatctgctgcacttgtctccctggcattgtttggtgccttcgtcagtcgagcatctatttcaacagttgatgtcttgactcctaaggttttcattggtctgattgttggtgccatgcttccatactggttctctgctatgacaatgaagagtgtcggtagtgcagctctaaagatggtagaggaagtccgtaggcaattcaacactattcccggactcatggagggtactgctaagcctgactatgccacctgtgtgaagatctctactgatgcatctctcaaggagatggttcctccgggtgctctagtcatgcttactcctctcattgtcggtactttctttggtgtggagaccctctctggtgtacttgctggttcccttgtttctggtgtccagatagctatttctgcttcaaacactggcggtgcttgggacaatgcgaagaaatacattgaggccggtgcttctgagcatgctagaacccttggacccaagggatctgaaccccacaaggctgctgttatcggagatactattggggatcctctcaaagatacttcaggtccatcactcaacattctcatcaagctgatggctgtcgagtctcttgttttcgctcccttctttgcaactcacggtggtttgcttttcaagttatggtagaaaataatggagaagtcgcgttctgctgcttttcctcagcactcgactatcttcacc

SEQ ID NO: 3725 - DNA, 2806 bp, Vinca minor
tatactccgatccatctttatttaatcctttccggcggctaactccagcaaatcaccaccgtgatagaagaacacataattaatatgggtgaggcgatactaccagatcttggaacccagattctgatcccggcttgtgccgtcgttggtatcgttttcgctcttatccaatgggttattgtgtctaaggttaagctctcctctgataagaaccattcttccaccgctgctgacgacggaaagaatggcttcactgaagctctaattgaggaagaagaaggaatcaatgaacacagcgttgttcagaaatgcgctgaaattcaaaccgccatctctgaaggtgcaacctcctttctatttactgagtaccagtatgtcggggttttcatggttatatttgccattttgatctttgttttccttggctctgtggagggattcagcacaaaaggccgagcttgtacatatgacagtaccaagatgtgcaagcctgctcttgctactgctggatttagcaccctgtctttcttgcttggtgctgtgacctctgtgctttcaggctttctcggaatgaaaattgctacctatgcaaatgctagaactaccctggaggctagaaagggagttggaaaggcttttattgttgcatttagatctggtgcagtgatgggtttccttcttgctgctaatggccttttggtgttgtacattgccataaacctcttcaagttgtactatggtgatgactgggaaggcctgtttgaggctataactggttatggtctgggtggttcttcaatggccctttttggtagagttggtggaggcatctatacaaaagctgcagatgtaggagctgatctcgtgggaaagctggagagaaacattccagaggatgaccctcggaatcctgcggtgattgctgacaacgtgggtgataatgttggggatattgctggtatgggttctgatctatttggctcctacgccgagtcatcctgtgccgcccttgtagttgcttcaatctcctcttttgggatcaatcatgatttcaccgctatgttgtatcctcttgtcataagttctgtcggaatcattgtttgtttgatcaccaccttattcgccactgacttcttcgaggtcaaagatgtgaagcaaattgagccagccttgaagaagcaacttattatctccaccgctttgatgacagttggtattgcaattgtcagttggattggtcttccatcatccttcaccatatttaactttggtgttcagaaggaagttcagaattggcagctgtttttgtgtgttgctgttggtttatgggctggacttattattggttttgtcacagagtattatacaagcaatgcttacagccctgttcaagatgttgccgattcctgccgcactggagctgctaccaatgtcatcttcggccttgctttaggatacaaatcagttattattccaattttcgccatcgcagtcggtatttttgttagttttagctttgctgctatgtatggtattgcagtagctgcccttggtatgcttagcaccattgctactggattggccattgatgcctatggtcccatcagtgacaatgctggaggcattgctgagatggctggcatgagccaccgaattcgcgagagaaccgatgccctcgatgctgcaggcaataccactgctgccattggaaagggatttgcaattggttctgctgctcttgtatcccttgctctctttggtgcatttgtcagcagggcttcaatttcaactgtggatgtcctgacgccaaaggttttcatcggtttgcttgttggtgcgatgcttccttattggttctctgcaatgacattgaagagtgtgggcagtgcagcacttaagatggttgaagaagtgcgtaggcaattcaacaccataccaggtctcatggaaggaactaccaagcctgactatgccacctgcgtgaagatctccacagacgcttctatcaaagagatgattcctcctggtgcacttgtcatgctcacacctcttattgtgggtatcttctttggtgtggaaacactatccggcatccttgctggatccctcgtttctggtgtgcagattgctatttctgcatctaatactggtggtgcttgggataacgccaagaagtatattgaggcaggtgcttctgagcatgccagaactctcggtcctaagggatcagattgccacaaagcagctgtgattggtgacactgttggtgatcctctcaaggacacatcaggaccatccctcaacattctgatcaagctcatggctgttgagtcacttgtctttgctcccttctttgccacccacggtggtctgctcttcaagatattctagacttagtaggagtcctcaaatttcgtacccattataaatatggtctttgttcaagtcctcattcacctctgtttcctcctatatggttatctaactttattttgtagtctgtcctgtctagtagctgcgatgtagaagttaggtttttggaaagaagttttccaggtgggtctgtggtggtggtggtggtggtggtgatggtgatggtgatgataattcccaagtcttgtggtgaagacgaacagtttaaaatgtttactatacaaatcttgcattgccatcttcagttatgaagggtacttgcaatgtatgccccaatggtcgattttatgctcaattcctgtgttctgcttctatcgtgtttgtacattatcggtgtttaatgtattgcaccctgattgctcctcttctgtaa

SEQ ID NO: 3726 - DNA, 2595 bp, Cleome gynandra
atctctatctctctctctagcgttcggttcagtttttctctctctttctcttctgtttcaggagcgtacggacggcggagagggatggttacggcgacgatgttgtcggagatggggacggagattttggtgccggtgtgtgccgtgattgggatagtgttttcgttagtccagtggttcctcgtctctcgtgtgaagttaaccgccgacaggagtacggcttctggtggggctaacaatggtaagaacggatatggagattatctcatcgaagaagaagaaggagttaacgaccaaagcgtcgtcaccaagtgtgctgagattcagaacgctatatctgaaggtgcaacgtcattccttttcactgagtacaaatacgttggagctttcatggtaggctttgccattcttatcttcatattcctgggttctgtggagggctttagcagagagagtcagccgtgtacttatgataaaacaagaacgtgtaagcctgctcttgccacggcagccttcagtactgtctctttcttacttggtgctgtgacatctctcctgtctggttttcttgggatgaaaattgccacgtatgccaatgctagaaccactttggaagccagaaaaggtgttggaaaggcattcattacagcattcaggtctggtgctgtaatgggtttccttcttgctgcaaatggtctgttggttctttacattgcaatcaatctattcaagttgtattacggtgatgattgggaaggtctttttgaggccattactggttatggacttggaggatcttccatggctctctttggtagagttggtggtggaatctacactaaggctgctgatgttggtgctgatcttgtgggcaaagtagaaaggaatattccagaagatgacccgagaaacccagctgttattgctgacaatgttggtgacaatgttggagatatagcgggaatggggtctgatctatttggttcatacgcggaatcatcatgtgcggcgctcgttgttgcttcgatttcatcttttggattaaaccatgattttacagccatgtgttacccattactcatcagttcaatgggaatcttggtttgtttaatcacaacgctattcgctaccgatttcttcgaaatcaaagctgtcaaggaaattgaaccggcattgaaatggcaactcataatctcaaccgcgatcatgactataggaatcgctattgtcacgtgggtcggattgccatcatccttcaccatttacaatttcggaacacagaaagtcgtcaagaactggcagttattcctctgtgttggtgtcggtctttgggcgggactcatcattggttttgttaccgagtattacactagcaatgcatacagtcctgtacaagatgtggcagattcttgcaggacaggagccgcgaccaatgtgatctttggtcttgctttgggatataaatctgtcataattccgatatttgccattgctgtcagtattttcgtgagtttcagtttcgctgccatgtacggtattgcggttgctgctcttggaatgcttagtactattgccactggtttggccattgatgcttatggtcccattagtgataatgctggtggtattgctgaaatggctggaatgagtcatcgtattcgtgaacgaaccgatgctcttgacgctgctggaaacactactgccgctattggaaagggtttcgctatcgggtcagctgcgcttgtgtcattggctctctttggtgcattcgtaagccgcgcagagattcaaaccgtagatgtcttgaccccgaaagtcttcatcggcttacttgtcggtgccatgcttccatattggttttccgccatgacaatgaagagtgtcggaagtgcagctcttaaaatggtagaagaagttcgtcgccaatttaacacaatcccgggactcatggaaggtacggccaaacccgattacgccacgtgcgttaagatctcaaccgatgcatcaatcaaagaaatgcttcctcctggtgccctcgttatgcttactcctctcatcgttggaaccctttttggcgtcgagactctctccggtgtcctcgctggttcactcgtctctggcgttcagattgccatatctgcatctaacaccggtggtgcttgggacaatgccaagaagtacattgaggcgggtgtatcagagcatgcgaggagtctgggaccaaagggatcagagccacataaggcagctgtaattggagacaccattggagaccctttaaaggatacctcaggaccttcattgaacattctcattaagcttatggctgttgaatctcttgtctttgctcctttcttcgccacccatggaggtatccttttcaagatcttctgaatgaaaaagaggtttatgatgatgatgttatgatggtgaaatgatgatgatgatgatgatgatctctttttgtttcctcgttgtttagatgttagaaaccctcaaaataactcaaaaaagaaacatcatgaattttttggacttgtagttctctctttctttctacctatgacttttgtcttaatcatgttttctcggagc

SEQ ID NO: 3727 - DNA, 2687 bp, Prunus persica
ctcactctccgaagctcatcagctcgaagagtctctctgtttctgagttctgaattctccggcgtacggtcaccggcgaggatggcggttctgctttctaccctcgcgacggagattgtgatccccgtcgccgccgtcatcgggatcgtgttctcgcttgtccagtggttcatcgtatcgcgcgtgaaggtcacgccagagcgtcacgcgccgccgcctgggcccaacagtaacaagaacggcttcaacgactacctcattgaggaggaggaaggcctccatgaccaaaacgtcgtcgctaagtgcgctgagatacagaacgctatctctgaaggtgcaacatcctttcttttcaccgagtatcagtatgttggggtcttcatggttgtttttgcaatcttgatcttcctcttccttgggtctgtggagggtttcagcacaaagagccaaccctgcacttatgatgcgcaaaggacctgcaagccagcacttgcaactgcaattttcagcactgtagctttcgtacttggtggtgttacctcgatcctttctggttttcttgggatgaaaattgccacttatgcgaatgctaggacaacattggaggcaagaaaaggtgttgggaaggcctttattgttgcatttaggtctggtgcagtaatgggatttctccttgctgcaaacggtcttttggtactttatattactatcaatgtctttaaggtgtactatggtgatgactgggaaggccttttcgagtcaattactggctatggtcttggtggatcagccatggctctctttggaagagttggtggtggtatctataccaaggctgctgatgttggtgctgacctggtaggaaaggttgaaagaaatattcctgaagatgacccaagaaatccagctgtgattgctgacaatgttggtgataatgttggggacattgctgggatgggatctgatctttttggctcatatgctgaatcatcttgtgctgccctagtcgttgcttccatttcctcatttggaatcaaccatgagttcacctctatgttgtatcctctcctcatcagttctatgggcatccttatttgtttaatcacaaccctatttgccactgatttctttgagatcaaggctgtcaaggaaattgaaccagctttgaaaaagcagcttatcatctccactgttctcatgactgttggaattgcaattattagctggattgctctgccgtcatccttcacaatttataactttggggttcagaaagttgtaaagaactggcaattgttcttgtgtgtggctgttggtctttgggctggacttattattgggttcgtcactgagtattatactagcaatgcatacagccctgtgcaagatgttgctgattcctgcaggaccggtgctgccaccaatgttatctttgggcttgctctgggatacaaatcagtcatcattccaatttttgccattgcagtcagcatttttgttagttttagctttgctgcaatgtatggcattgcagtggctgcacttgggatgctgagcaccatcgctacaggtttggccattgatgcttacgggcccattagtgacaatgctggaggcattgctgaaatggcaggcatgagccatagaatccgtgagagaactgatgctcttgatgctgccggcaataccactgctgccattgggaagggatttgccatcggatctgctgctctggtgtctttggccctgtttggtgcctttgtcagccgcgcagcaatttcaacagttgatgtcttaaccccaaaggtctttattggactgattgtcggtgcaatgcttccttactggttctctgccatgaccatgaagagtgtgggaagtgcagcactaaaaatggttgaggaagtccgcaggcagttcaataccattccaggtctcatggagggtaccgctaagcccgactatgctacttgtgtcaagatctccactgatgcatccatcaaggagatgattccaccgggtgcccttgtcattcttacccctctcattgttggaacattatttggcgtggagaccctatctggtgttcttgctggttcactcgtttccggtgtgcaggtagcaatatctgcttccaacacaggtggtgcatgggacaatgctaagaagtacattgaggctggtgcttcagagcatgcaaggacccttgggccaaagggatctgacccacacaaggcagcagtgattggtgacaccattggggacccactgaaggacacctctggcccatcactcaacatcctcatcaagctcatggcagtggagtcccttgtgtttgctcccttctttgccactcatggtggcctacttttcaagatcttctgaggagttggagttggggggagagtgtgttttctgccatggccattgtatcaggggaaaatggccttataatatcgtttggttctatttttggtctggcgggctgaggttttattattaacttttccttttcttgtaccagtatctctcttccctcttccctcttccccccaccctcttttagttagtgtttctgttaatttgtcaactctgagaattttaatgacgaaaattagatgtaccaattgaaacgtttttatgaaaaatgggttctaacttggactcaaaatttcattttcccccca

SEQ ID NO: 3728 - DNA, 2710 bp, Catharanthus roseus
agggagtttcggctagtttagtagggttccggtgaagatgacgtcggcgttgttgccagatctaggtactgagatcgtgattccggtgtgtgctgtcatcggaatcgtcttctcattaatccaatgggtacttgtatcccgcgtgaagctctcgccggaacgaaacgctaccaacaacaacaataagaatggttacaatgattacttgattgaggaagaggaaggcattaatgaccagaacgtcgtcgttaagtgtgcggagattcaaaacgccatctccgagggtgctacatcatttttgtttacggagtacaaatatgttggcattttcatggttgcttttgcaatcctaatattcctattccttggatctgttgagggcttcagcacaaagagccagccttgcacatatgacaaagaaaagatgtgcaagccagcccttgcaactgccgtgtttagcactgtgtccttcttgcttggtgctgtcacctcagttctttctggtttccttgggatgaaaattgctacctatgctaatgcaaggaccactttggaagcaagaaaaggtgttggcaaggcttttatcattgcattcaggtctggtgcagttatggggtttctcttggcagctaatgggcttctggtgctctacattgcaatcaatctctttaagctctattatggtagtgactgggaggggctctttgaggcaattaccggttatggtcttggtggatcttcaatggctctctttggcagagttggtggaggaatatataccaaggctgctgatgttggtgccgatcttgttgggaaggttgaaaggaacattcccgaggatgatcccagaaatcccgctgtgattgctgacaatgtgggggataatgttggtgatattgctggaatggggtctgatcttttcggttcctatgctgaatcatcatgtgctgcccttgttgtggcttctatttcttcttttggaatcaatcatgacttcactgcaatgttatatcctctgcttgttagttccatgggtattcttgtctgcttgattacaactctttttgcaactgacttcttcgagattaaggctgtcaaagaaattgaaccagcattgaagaagcagcttatcatctccactattcttatgactgttggagttgcaatagttacatggacttgcttgccttcttcatttacaattttcaactttggtactcagaaggttgtcaagaactggcaactattcttgtgtgttggagtgggtctttgggctgggcttattattggatttgtgacagagtactatactagcaatgcttacagccctgtgcaagatgtagctgattcctgcaggactggggctgccacaaatgttatttttggccttgcattgggttacaaatctgtcatcattcctatttttgctattgcaataagtatttttgttagtttcacttttgctgccatgtatggtattgccatggctgctctgggaatgctaagcacaatcgctactgggttggctattgatgcttatggccccattagtgataatgctggaggaattgctgagatggctggaatgagtcacagaatccgtgagaggactgatgcccttgatgctgctggaaacaccactgctgccattggaaagggttttgccattggttctgccgcacttgtttccctggcattgtttggtgccttcgtcagtcgagcagctatttcaacagttgatgtcttgacccctaaggttttcattggtttgattgttggtgctatgcttccatactggttctctgctatgacaatgaagagtgtcggaagtgcagctctgaagatggttgaggaagttcgcaggcaatttaataccatccctgggctcatggagggtactgccaagcctgactatgccacctgtgttaagatctctactgatgcatctatcaaggagatgattcctccgggtgctctggtcatgcttacacctctcattgttggtactttctttggtgtggagaccctctccggggtgcttgctggttccctagtttctggtgtccagatcgccatctctgcatcaaacactggtggtgcttgggacaatgcaaagaagtatatcgaggctggtgcttctgagcatgctagaacccttggacccaagggatctgaaccccacaaagcagctgttattggagataccatcggagatcctctcaaggacacctcaggtccatctctcaacattctcatcaagctaatggcagtcgaatctcttgttttgctcccttctttgcaactcatggtggtttgctcttcaagatattaggataggattcgtcgccaccgagctgcccctttccattgtagcattatcctcagcactcaaaattatcttcttctttcttccaaattttccaatgagtttttcatttttaagttttagcttttgtagttggtcgaatattatttttgtcaagagttgatgattatgatgaaaagatgattatcgcgctgtcgataatcaatcaaaagatgcgtgctctctttttagagagcacaacattgagaagaactcatgtaggaggttttcttgattttctacttagatcagtttagtctctacttagtttttatttgtacgtgatttgttagcaacatgaagtgaacagccacgtttgtggcatatatgaacaaccagtctttt

SEQ ID NO: 3729 - DNA, 2713 bp, Nicotiana tabacum
cgtgaacctcattcttcactcgttcctcaccctcttaattttcttttaatttattgtccggcaaggtcttttagggttccggcaaaggatgggatcggcgttgttaccagatcttggaacgcaaatagttattccagtttgcgccgtcattggaatcgtgttctcttcattccaatggtaccttgtctcgcgcgtgaaagtctcgtcggaacatggagccacttctccgagcagcaacaaaaacaacaagaatggatacggtgactgtttgattgaagaagaagaaggaatcaatgaccacaacgttgttgctaagtgcgccgacatacagaatgccatatctgaaggggcaacatcattccttttcactgaatatcagtatgtgggtatcttcatgattgcttttgcaatcctgatcttccttttcctgggatccgttgaaggcttcagcactagtagccagccatgtacttacaacaaggagaagaggtgcaagccagcccttgcaactgccatcttcagcactgtatccttcttgcttggtgctatcacttccgttatttctggtttccttgggatgaaaattgcaacatatgcgaatgcaagaacaactttggaagcaagaaaaggtgttgggaaagcttgtctggtgcaggtgatgggttttctccttgctgccaatggccttctggttctttacattgcaattaatctcttcaagctatactatggtgatgactgggagggtctttttgaggcaattactggctatgggcttggcggatcctcaatggccctttttggtagggttggtggtggtatttacaccaaagctgctgatgttggtgctgatcttgttggtaaggttgaaaggaacattccagaagatgatcctagaaatcctgctgtgatcgctgacaatgttggggataacgttggggacattgctggaatgggatctgatctttttggttcatatgctgaatcatcttgtgctgctcttgtggtggcttccatctcgtcttttggaattgatcatgatttcactgcaatgtgttatcccttgcttataagctctatgggaatccttgtttgtttgataaccaccctttttgctaccgacttttttgaaattaaggctgtcaaggaaattgaaccagcattgaagaaccagcttattatctcaactgctatcatgacagttggaattgcaattgttacatggacttgcctcccatcttccttcaccatctttaattttggcactcagaaggttgttaagaactggcaactctttttatgtgtggctgttggtctttgggctggacttataattggatttgtcactgagtactacactagcaatgcttacagccccgtccaagatgtagccgactcctgcagcactggagccgcaacgaatgttatttttggcctagctcttggatacaaatctgtcatcattcctatctttgccattgcgatagctatctttgtcagttttacttttgctgccatgtacggtattgcagttgctgctcttggaatgctgagcaccattgcaactggactggccattgatgcatatggacctatcagtgataatgctggtggcattgctgagatggctggcatgagccaccggatccgtgaaagaactgatgcccttgatgcagctggaaacaccactgctgcaattggaaagggcttcgccattggatccgctgcacttgtgtccctggctctctttggtgcttttgtgagtcgggctggaatttcaacagttgatgtcttgacccctcaggtgtttattggtttgattgttggagccatgcttccctactggttctctgccatgaccatgaagagtgtgggtagtgctgctctgaagatggttgaggaagttcgcagacagtttaacaccattcctggtctcatggaaggtcttgccaagcctgattatgccacttgtgttaagatctcaactgatgcgtctatcaaggaaatgattccacctggtgccctagtcatgcttactcccctcatagttggtattttctttggagtggagacactttctggtgtccttgctggtgctttggtttcaggtgtacagatagcaatatctgcatcaaatactggaggtgcatgggacaatgccaagaagtatattgaggctggtgcttcagagcatgcaaggactcttggcccaaagggttccgaacctcacaaggctgctgttattggtgacacaattggtgaccccctaaaggacacttcaggcccatcactcaacattttgatcaagcttatggcagttgagtcgctcgtatttgctccattctttgccactcatggtggtatacttttcaagatcttttagggcaggttggaggcgttgcgtagacttgtggcatatctttcagtcaacatccttctcaaatatccccaagcacgggatttttaaattagttgctagtcagaagtggaattttggtgactgatgatgatgataattgtcactgtaaggaggatagaggaaaattgtcagtcttgtggtacaatagacctaagctagtgtatcaactttcttcatacttcatagacactagtttccaattttgtctgtattgtcattatccacgtctaagataatggacctatgttttcagcttcttttttttcacgtcttaaagaaagtaggttgtcgttt

SEQ ID NO: 3730 - DNA, 2686 bp, Vinca minor
cagacctaccgtaacatccgctgcaccatctctattctataatcccctttccgtcggccattaattccggcaaaataccaccgtagcgccaccgtgactagggcagacacagaagaacagtaggatgggtgcagcgatactaccagaccttggaactgagattctgatcccggcatgtgctgtcgtcggtatcgttttctctcttatccaatggtttcttgtgtctaaggttaaggtttcctcctctgataagcaccaggcggcgggtaccgccgacggtaagaatggctttactgaagcacttattgaggaagaagaaggtatcaatgaacacagtgttgttcagaaatgcgccgacattcaaaacgccatctctgaaggtgcaacttcctttctatttaccgagtaccagtacgtcggggttttcatggttatatttgccattttgatcttcgttttccttggctctgtggagggattcagcacaaagggccgagcttgtacatatgacagtaccaagatatgcaagccagctcttgctactgctggatttagcactctgtctttcttgcttggtgctgttacctccgtgatttcaggctttcttggaatgaaaattgctacctatgcaaatgcgagaactaccctagaggctagaaagggagttggaaaggcttttgttgttgcatttagatctggtgcagtgatgggtttccttcttgttgctaatggccttttggtgttgtacattgccataaacctcttcaagttgtactatggcgatgactgggaaggcctgtttgaggctataactggttatggtctgggtggatcttcaatggccctttttggtagagttggtggaggcatctatacaaaagctgcagatgtaggagctgatctcgtgggaaaggtggagagaaacattccagaggatgacccacggaatcctgcggtgattgctgacaatgtgggtgataatgtcggggatattgctggtatgggttctgatctatttggctcctttgctgagtcgtcatgtgccgcgcttgtagttgcttcaatctcctcttttggaatcaatcatgatttgaccgctatgttgtatcctcttctcataagttctgtcggaatcattgtttgtttgatcaccaccttattcgccactgacttctttgagatcaaggatgtgaagcaaattgagccagcattgaagaagcaacttattatttccacggctttgatgacagtcggtattgcaattgtcagttggattggtcttccatcttccttcaccatatttaactttggtgtccagaaggaagttcagaactggcagttgtttttgtgcgtttctgttggtttatgggccgggcttattattggttttgttacagagtattatacaagcaatgcttacagccctgttcaagatgttgccgattcctgccgcactggagctgctaccaatgttatctttggccttgccttaggatacaaatcagttatcattccaattttcgccatagcagtcagcatctttgttagtttcagttttgctgctatgtatggtattgcagtatctgcacttggtatgcttagcacccttgctactggattggccatcgatgcctatggtcccatcagtgacaatgctggaggcattgctgagatggctggcatgagccaccaaattcgtgagagaaccgatgccctcgatgctgcaggcaataccactgctgccattggaaagggatttgcaattggttctgctgccctcgtatctcttgctctctttggtgcgtttgtcagcagggcttcaatttcaactgtggatgtcctgacacctaaggttttcatcggtttgcttgtgggcgccatgcttccttattggttctctgccatgttaatgaagagtgtgggtagtgcagctcttaagatggttgaagaagtacgtaggcagttcaacaccatgccaggtctcatggaaggaactaccaagcccgactatgctacctgcgtgaagatctccacagacgcttctatcaaagaaatgattcctcccggtgcacttgtcatgctcacacctctgatcgtgggtatcttctttggtgtggaaacactatctggtgtccttgctggatctctcgtttctggtgtgcagattgctatttctgcatctaatactggaggtgcttgggacaatgccaagaagtatattgaggccggtgcttctgagcatgctagaactctcggtcccaaggggtcagatgcccacaaagcagctgtgatcggtgacactgttggcgatcctctcaaggacacatcaggaccatctctcaacattctgatcaagctcatggccgttgagtcgcttgtctttgctcccttctttgccacccacggtggcctgcttttcaagttattctagactagctgtcctcaaattcatgccattgtatggtcttcgttcaagtcgccgccgttcacctctgtttcctatagttttctaattttatattgtagtccgtgtagctgcaatgtagaagttttaaaaaatgtaggtttctggagagaaattttcgtggtgggtcagtgactgtggttttgttgttgtggttttgtggataaacaagaaggttggcaatgatattcttttcaagtaattgaacagcttaaatgttta

SEQ ID NO: 3731 - DNA, 2658 bp, Vitis vinifera
agtgagagaaccggagccaaaggcaactccattattctctctcgtgttctcgtgatattggttttccggcgccggattttgtcggtccgtccgtccgtccatggcgattctgtcagatctcggcactgagatcttggttccggcctgcgccatcgtcgggatcgtcttctctgtggttcagtggattctggtctcccgcgtcaagctttctccagagcggcactcgctctctaactccagcaagaatggcaccgctgagtacctgattgaggaagaagaaggcctcaatgatcacagcgtcgttcagaaatgcgctgagatacagaatgctatctctgaaggagcaacctctttcctctataccgaatatcagtatgttggaattttcatggttgcttttgcaatcttgattttcgttttccttggctctgtggagggtttcagcacaaagagccagccttgcttatacaacaaaggagagatgtgtaagccagcacttgccaatgctatcttcagcacaatatccttcttgctcggtggtttaacttctctgctttctggtttccttgggatgaaaattgctacttatgcaaatgccagaaccactctggaggcaaggaagggtgttgggaaggcttttatcactgcatttagatctggtgcagtcatgggattccttcttgctgcaaatggtcttttggtcctctatattgccatcaacctcttcgagatatactatggtgatgactgggaaggcctttatgaggctataactggttatggccttggtggttcttccatggctctctttggcagagtaggtggaggtatctatacaaaagctgctgatgttggtgcagatcttgtgggcaaggttgagaggggaattcctgaggatgacccgagaaatccagctgttatagctgacaatgttggtgataatgttggggatattgctgggatgggagctgacctttttggttcgtatgctgagtcatcatgtgctgcccttgtggttgcttccatctcctcatttgggatcaatcatgaaatgactgcaatgttctatcctctcatcattagttccataggcattcttgtttgtttgatcaccaccttatttgcaactgacttttttgagatcaaagctgtaaaggaaattgagccagcactgaagaagcagctcatcatctccactattttgatgactgctggaattgcatttgttagttggattgctcttccatcttccttcaccatcttcaattttggaagccaaaaggttgtgaagaactggcagctgttcttgtgcgttggagttggcctctgggctgggcttattattggatttgtaacagagtattatactagcaacacatacagccctgtgcaggatgtcgctgattcctgccggactggagctgctacaaatgttatttttggccttgcattaggatacaaatctgtcattatacctatttttgccattgcagtgagcatttttgtcagtttcagctttgctgctatgtatggtattgcagtagctgcccttgggatgctgagcacaattgctaccggattggccattgatgcttatggtcccatcagtgacaatgctggaggcattgctgaaatggctggcatgagccacagaatccgtgagagaactgatgcccttgatgctgcaggaaacaccactgctgctattggaaagggttttgcaattgggtctgcagctctagtgtccctggccctctttggtgcctttgtgagccgtgcagctatttcaacagttgatgtcctgactccaaaagttttcattggtttgcttgtgggtgcaatgcttccttactggttctctgcaatgacaatgaagagtgttggaagtgcagctctaaagatggttgaggaagtgcgccgacaattcaataccatcccaggtctcatggaaggcactgccaagcctgattatgccacctgtgttaagatctctactgacgcttcaatcaaagagatgataccacctggtgcccttgtcatgctcactcccctcatagttgggaccttgttgggtgtagaaactctagctggtgttcttgccggatctcttgtctctggtgtccagattgccatctctgcttccaacactggtggtgcttgggataatgccaagaagtatattgaggctggggcttcagagcatgcaaaggccctcggtccaaaaggatcggacccacacaaggcagctgtgattggtgacacaattggggaccctctcaaggacacttctggcccgtctctcaacatcctcatcaagctaatggcagttgaatctcttgtctttgctcccttttttgctgcacatggtggcctgcttttcaagatttggaagtagagaggatgtgacatattactggcgcatccagcgatgaaccacaaattcccttatgttttactttttagtgtcttccgtcaccccaggtctggtttttcatgtctttttctggctctttcctttgttctgctttaatctttttgagtatacgtttagtctgtagtgcaagcttttttccccttcaaacacagctgagccagtaggtaatactttcccatttttggggtgaataacaacagtgctgaccataatggtcaatgttt

SEQ ID NO: 3732 - DNA, 2711 bp, Fragaria vesca
ggctctctcccatatctcctatctcttcgctacttcactctctccagcctcctcctcgtgttttcaatttttgaattctccggcgtacggattccggcgaggatggcggtgctgctctcgtaccttgccacggagattgtgattcccgtctgcgccgtggtcgggatcttgttctcgctgttgcagtggtacttggtgtcgcgcgtgagagtgacgcccgaccgtaacgctcccgccccaggaaccaacgcaaagaagaacggcttcaatgactacctcattgaggaggaggaaggcgtcaccgaccaaaacgtcgtcgctaagtgcgccgagattcagaatgctatctccgaaggggccacatccttccttttcaccgaataccagtatgttggggtcttcatggttgtttttgcagtcttgatcttcctcttcctcggatctgtgaagggcttcagcacagagagccagccatgcacttatgatgtgacaagcacctgcaagccagcacttgccactgcactcttcagtactgttgcattcttacttggtggtatcacctcactcctgtctggttttcttggtatgaaaatcgccacttatgccaatgccaggacaacattggaagcaagaaaaggtgtggggaaggcctttatcgtggcctttaggtctggtgcagtcatgggttttctccttgcagccaatggtcttttggtactttacattaccatcaatctctttcagctgtactatggtgatgactgggaaggcctttttgaggcaattactggctatggtcttggtggatcagcaatggctctttttgggagagtaggtggtggtatctataccaaggctgctgatgtcggtgctgaccttgttggaaaaattgaaagaaacattcctgaagatgacccgagaaacccagctgtgattgctgacaatgttggtgataatgttggggatattgctggtatgggatctgatctttttggctcctatgctgaatcatcttgtgctgcgctagttgttgcttccatttcctcatttggaatcaaccatgagttcactgccatgctgtatccccttcttgtcagttctatgggcattcttatttgtttaatcacaaccttgtttgccactgatttctttgagatcaaggctgtcaaggacattgaaccagctttgaaaaatcagcttattatctccactgttcttatgactattggaattgcaattgttagctgggttgctctgccatcatctttcacaatttacaactttggagttcagaaagttgtaaagaactggcaattgttcttgtgtgtatctgttggtctttgggccggacttatcattggatttgtcactgagtattatactagcaatgcatatagccctgtgcaagatgttgctgattcctgtaggactggtgctgccaccaatgttatctttgggcttgctctgggatacaaatcagtcatcattccaattttcgccatcgcagtcagcatttttgttagttttagtttcgctgctatgtatggcattgcagtggctgctcttgggatgctgagcaccatcgctacagggttggcaattgatgcctacgggcccatcagtgacaatgctggaggcattgctgagatggctggcatgagccatcgtattcgtgagagaaccgatgctcttgatgccgctgggaataccactgctgcaattggaaagggatttgctattggatctgctgctctagtttctttggctctatttggtgcctttgtcagtcgtgcagcgatttcaacagttgatgtcctaaccccaaaggtctttatcggactgatcgtgggtgcaatgcttccttactggttctctgccatgaccatgaagagtgtgggaagtgcagctttgaaaatggttgaggaagttcgcaggcagttcaataccatcccaggactcatggagggtcttgccaagcccgactatgctacctgtgtcaagatctccactgatgcatccatcaaggagatgattccacctggtgcccttgtcatccttacacctctcattgtcggaacattgttcggtgtggagaccctctctggtgtccttgctggttcccttgtttctggtgtgcaggtagcaatatctgcctctaacactggtggtgcatgggacaatgccaagaagtacattgaggctggtgcttcggagcatgcaaggactcttggcccaaaggggtctgacccccacaaggctgcagtcatcggtgacaccattggagatccactgaaggacacttcaggcccatcactcaacatcctcattaagctcatggctgttgagtcccttgtgtttgctcccttctttgccactcatggtggcctgctctttaagatcttttaaaggaaaggaggctatgccactttcacaagtattgggcaaagtggtctatatttctttttgttctatttttgttcggcaaggcagagtttatcaacatttcttctgttgtaccagtatctctatcctccccctcctagttagtatttcaatttgatatgaactctgagaatcaatgatgaaaattagttttctcgaaatgaattttctccatatgaaatgtttagtttagagaaatcatatcttgtgttcatgtgtcctgcttgtgttcaaacatcgtctctctggaagtttggcttttcagtttc

SEQ ID NO: 3733 - DNA, 2679 bp, Lippia dulcis
cgaccggattattccggtgagattgctagggttccggggagaaatggcgctgcttccagatctgggggcggagatcgtgattccggtgtgcgcagtcatcggaatcgtctcttcgctcgtgcagtggttccttgtgtcgcgtgtgaagctcaccggggagcacggcggcgagtctccagctaagaatgggaagaatggctacagtgactacttgatagaggaggaggacggcatcaacgaccagaacgttgttgttaagtgcgctgagatccagagtgccatctctgagggtgcaacatctttcctgttcacggaatatcagtatgtcggtgttttcatgtttgcttttgcaatcctcatcttcctcttcctggggtcggttgagggtttcagcacaaagagccagtcttgcacttacgacaaggaaaagatgtgcaagcctgctcttgcaactgccatcttcagcaccacctccttcttgcttggtgctgtcacttcgcttgtatctggtttccttgggatgaaaattgcaacctatgcaaatgcaaggaccacattggaagctagaaagggtgttggaaaagccttcatcgttgcatttagatctggtgcagttatgggttttctccttgctgccaatggcctcttgattctgtacattgccatcaatgtgttcaagatctactatggtgatgattgggaaggtctttttgaggccatcactggatatggtctaggtggatcttccatggctttgtttgggagagtcgggggtggtatttacacgaaggctgctgatgttggtgctgaccttgttggaaaggtcgaaaggacattccggaagatgaccctaggaatcctgctgtgatcgctgacaatgtcggtgataacgttggagatattgcttggtaatgggtattcttgtattctttttcggtttcgttattgctgagtcatcgtgtgctgctcttgttgtggcttctatttcctcttttgggtaacacccatgattttactgcaatgtgctatccgttacttattagttccatgggtatccttgtttgcttgatcaccactctttttgctactgacttccttgagataaaggctgttaaggaaattgagccagctttgaaaaagcagcttattatctccactattctcatgactgttggaattgcaattgtcacctggacatgcttgccatcatccttcacaatcttcaattttggtgctcaaaaagttgttaagaactggcagctgttcctctgtgtttgcgttggcctttgggctggacttattattggatttgtgactgaatactacacaagcaatgcatacagccccgtgcaggatgttgctgattcatgcagaactggtgctgcaaccaatgttatctttggccttgccttgggatataaatcagtcataattcccattttcgccatagcagttagcatctttgttagtttctcatttgctgctatgtatggtattgctgtagctgctctaggtatgctaagcacaattgctactggtttagcaattgatgcttatggtcccatcagtgacaatgccggaggcatagctgagatggccggcatgagccacaggattcgtgagagaaccgatgcccttgatgctgctggaaacaccactgcagctattggaaagggatttgctattggatctgctgcgcttgtctcattggcactgtttggcgcctttgtcagccgtgctgcaatttcaaaagtcgatgttttgacccctaaagtcttcattggtttgcttgttggtgctatgctcccatactggttctctgccatgaccatgaagagtgttggcagtgctgctttgaaaatggtggaggaagtccgtaggcagttcaatactatccctggtatcatggagggacatgcgaagcctgattacgctacatgtgtcaagatctcaaccgatgcttctattaaggagatgattccacctggcgccctcgtcatgcttacccctctcattgttggtaccttctttggtgtcgagaccctctccggcgttcttgctggttctcttgtgtccggtgttcagattgcgatatctgcatccaacaccggtggtgcatgggacaatgctaagaagtacattgaggccggtgcttcagaacatgcaagaactctcgggccgaagggatcagatccgcacaaggcagctgtgattggcgacaccatcggagaccctcttaaggatacttcaggtccatctctcaacattctcatcaagctcatggcggttgagtccctcgttttcgcaccattcttcgccactcacggtggtctgcttttcaagctttgaaatgatcttcgctcttttgaacattatgtctccattggagttctctggtgcttcaccactccttttttacgagttagctttcctaggtagtgagatattttgtcctctctttttgtctttttgatgagctgaaattgatgataattccgacggtgcggttggagatggtgcaattccgcatccttgttgtagtggtttccggtggaatgtactagtttttgttgagtttattttccaacagctctaattctctggttctctgtaatggaattaattttgcttcgaggacatgtgattctttcgggtccataatttcactttatttgagct

SEQ ID NO: 3734 - DNA, 2675 bp, Arnica chamissonis
tattcgttcgatttctttcgccggatctcgttttccggccaatagacgccgtcacacgacgcaaaagtcatggcgacgtccacaattctctcagatctcggaactcaaatccttatcccaatctgcgcagttgttggaattctcttctctctcttccaatggtatctcgtatcacaagtcacactgtcgccggagaaacccgctgccgacggcaaaaacggttacaaggaagcgttgattgaagaggaagaaggaattaacgaccataccgtcgttcaaaaatgcgctgaaattcagagcgctatttctgaaggagcaacctctttcctgttcaccatgtaccaatatgttggggtttttatggtcatatttgctattctaatctttgtattcctcgggtccgttgagggatttagcacaagtagtaaaatatgcacatacgacgccaccaagacgtgcaagcctgctctaatgacagctgtcttcagcactgtgtcattcttgcttggtgccatcacctcagttgtgtctggctttcttgggatgaaaattgccacatatgcgaatgccagaactacccttgaggctagaaggggtgtcagtaaggcttttattgtggcattccgatctggggcagttatggggttcctccttgctgcaaatggtcttcttgtattgtatattaccatcaatctctttaagatttactatggtgatgattgggaaggtctttttgagtccataactggttatggacttggtggttcatccatggccctttttggaagagttggtggtggtatatatacaaaagctgctgatgtgggagctgatcttgttggcaaggttgagaggaacatccctgaagatgaccccagaaatccagcagttattgctgacaatgttggtgataatgttggggatattgccggtatgggatcggatctgtttggttcatatgctgaatcatcttgtgcagcccttgttgttgcttcaatttcttcatttggaaacacccatgatttcaccccaatgatgtacccactaattgtgagctctgtgggcatccttgtatgcttgatcaccaccttattcgctactgatttctttgaagtcaaaactgtaaagcaaatcgagccttctttgaaaaaccaactcatcatttcaactgtgctgatgactattggtatagccattgttagttggatagctcttccttctagcttcaccatcttcaactttggagcccagaaagtagttaaaaactggcaattgttcttgtgtgttggtgttggtttgtgggctggtcttattattggattcgtaaccgagtactacactagcaatgcttacagccctgtgcaagatgttgctgattcgtgccgtactggagctgctacaaatgttatatttggtcttgctttgggatacaaatcagttatcatccccattttcgcaatcgcagcaagtatttttgttagttttagctttgccgccatgtatggtgttgctgtggcggcccttgggatgctgagcaccatagcaactggtttggccatcgatgcatatggtcccattagtgacaatgctggtggcattgctgaaatggctggaatgagccacagaattcgtgagaggactgatgcccttgatgctgctgggaacactactgcagctatcggcaagggttttgccattggttcagcagctcttgtatccttggctctattcggtgcatttgtgagccgggccgagattacaaccgtagatgtattgaccccaaaagttttcattggtttgctcgtgggtgccatgcttccatactggttctcagccatgacaatgaaaagtgtgggaaaagcagcacttaaaatggttgaagaagtccgtaggcaattcaacaccattccaggcctcatggaaggaactgctaagcccgattatgccacctgtgtgaaaatatcaaccgatgcctcaattaaagagatgattgctcctggtgctcttgtcatgctaactcccctcattgttgggattttctttggtgtcgaaacactttctggtgttcttgcaggatcccttgtttctggtgtgcagattgctatctctgcgtcgaacactggtggtgcttgggacaacgctaagaaatatatcgaggctggtgtttctgaccatgcaaaatcgctcggaccaaaagggtcagacccacacaaggcagctgtgatcggagacacgattggggatcctttaaaggacacttcaggaccatcactaaacatcctgatcaagctcatggctgttgaatctttggtgtttgcccccttcttcgccacccatggagggcttttgttcaagttcttctagattcatcataatgaaggtgatgccaattatccgtccttcgattagccaatcatttcatccgcttagttgtatcgcttgacgtatttcctttatttttcgactcatctagcgtatgttactctgtcttattttttgatattttgttcggcgattagcaaattttccattggggatttggatggtgttagacatgataagtagtccttctcatcaagagtttgaacatgtctgttattcccttttcctttctaaatgaatgaatcaggcttataattgtttgttagctgaagtgtgtgccaatgagtttgact

SEQ ID NO: 3735 - DNA, 2583 bp, Arnica chamissonis
ccacattctcattcgccaccatgaaatacgtgagatagattcaacacgagatctctctctctgttcttcgattttatattctccgatcttgttttccggccaatcgccgccgtcaacagaccccaaaaatcatggggacgacaacaattctctcagatctcggcactgaaatcatcatcccaatctgcgcagttgttggaattatcttctctctcttccaatggtatcttgtctcgcaagtcaaattgtcgctggaggaacctgccgccgacggtaagaacgggttcacggaagcgttgattgaagaggaagaaggaatcaacgaccatgccgtcgttcaaaaatgcgctgaaattcagaacgctatttctgaaggggcaacctccttcctattcaccgaataccaatatgttggtgtttttatggttatttttgctgttgtaatcttcgtattccttgggtccgttgagggatttagcaccagtagcaaaatatgcacatatgacaccaccaaaatgtgtaagccagctctaatgacagctctcttcagcactgtgtcattcttgcttggtgccatcacctcagttgtctctggctttcttggtatgaaaattgccacatatgcaaatgccagaactacccttgaggctagaaagggtgttggtaaggcttttattgttgcattcagatctggagcagttatgggttttctccttgctgcaaatgggcttcttgtattgtacattaccattaatcttttcaagatttattatggtgatgattgggaaggcctttttgagtccataactggttatgggcttggtggttcttccatggccctgtttggtagagttgctggcggtatttatacaaaagctgctgatgttggagctgatcttgttggcaaggtcgagagaaacatccctgaagatgaccccagaaatccagcggttattgctgacaatgttggtgacaacgttggggatattgctggtatgggatctgatttgtttgggtcatatgccgagtcgtcttgtgcagcccttgttgttgcttcaatttcctctttcgggaccactcatgatttcactccaatgatgtacccactaattgtgagctcagtgggcatccttgtatgcttaattaccactttgtttgctactgatttctttgaggtcaaaaccgtacagcaaatcgagccttctttgaaaaatcaactcattatttcaactgtgctgatgactatcggtatagctattgttagttggattgctcttccttctagtttcactatcttcaactttggagcccagaaagtagttaagaactggcaattgttcttgtgtgtttgtgttggtttgtgggctggacttattattggattcgttaccgagtactacactagcaatgcttacagccctgtgcaagacgttgctgattcatgccgcactggagctgctacaaatgttatttttggtcttgctttgggatataaatcagttattatcccaatttttgcgattgcagtcagtatttttgttagttttagctttgccgccatgtatggtgttgctgtggcggctcttggaatgctgagcaccatagccactggtttggctattgatgcatatggtcccattagtgacaatgctggtggcattgctgaaatggctggaatgagccacagaattcgtgagaggactgatgctcttgatgctgctggaaacaccactgcagctatcggcaagggtttcgccattggttcagcagctcttgtatccttggctctattcggtgcatttgtgagccgggccgagattacaaccgtagatgtattaactccaaaagttttcattggtttgctcgtgggtgccatgcttccatactggttctcagcaatgacaatgaaaagtgtggggaaagctgcacttaaaatggttgaagaagtccgcaggcaattcaacaccattccaggccttatggagggcactgctaagcccgattatgccacctgtgtgaaaatctccaccgatgcctcaattaaagagatgatcccgcctggtgctcttgtcatgctgactccccttattgttgggattttatttggtgttgaaacactttctggcgttcttgcaggatctcttgtctctggtgtccagattgctatttctgcatcgaacaccggtggtgcttgggacaatgctaagaaatacatcgaggctggtgtttctgatcatgcaaaatcgcttggaccaaaaggatcagacccacacaaggcggcagtgatcggagacacggttggggatcctttaaaggacacttctggaccatcactaaacattttgattaagctcatggctgttgaatctttggtgtttgctcctttctttgccacccatggaggacttctgtttaagatcttctagacccatatataacaaaggtgatgccagttatcatttcatctgtttagtttgtatcatcacttcatgtgttgctctgctttaaacttgtgggagtgtattatttttgacgttttgttcgacccttagtgattgtttcactcgggattttgatatgata

SEQ ID NO: 3736 - DNA, 2552 bp, Helianthus annuus
ccccaacaatttaaaccctctctcactcttcacttcccctctttctcctccgccatggttacgtccacaattctctcagatctcggcaccgaaatcctaattccggcatgtgcactcgtcggaatcgtcttctctctcctccagtggttcctcgtctccaaagtctccctctcgctcgataaaccggacgctaaacacgccttcaccgagtccttgatcgaggaagaagaaggtgttaatgatcataacgttgttcagaaatgtgccgagattcagaacgctatttccgaaggagcaacatctttcctatttaccgaataccaatatgtcggtatcttcatgatcgctttcgcggtattaatcttcgtcttcttgggatccgtcgagggattcagtaccagttaccagcaatgcacatacgacaccaccaaaatgtgcaaacctgccctattcaccgcagtcttcagcaccgtatcattcatcctcggggccataacttccgttatatccggttttctcgggatgaaaatcgccacatacgcaaatgccagaactacccttgaggcaagaaaaggtgtcggaaaggcgtttattgttgcgtttcgttccggagctgttatgggattcttgttggctgctaatggtcttcttgtgttgtatattactattaatgtttttaagatttattatggtgatgattgggaagggctttttgaagcgataacgggttatgggctcggtggatcttcgatggcactgttcggaagagttggtggtggtatttatacgaaagccgctgatgttggtgctgatcttgttggtaaggttgagcggaacattcctgaagatgatcccagaaatccagcggtgattgctgacaatgttggtgacaacgtcggtgttattgcaggtatgggatccgatctattcggctcatacgcggagtcatcatgtgcagcccttgttgttgcatcaatttcttcattcggaaacaaccacgatttcacagcaatgatgtatcctctcctcatcagctcagtgggcatccttgtttgtttgatcaccaccttgttcgccaccgacatttttgaagtcaaaaccgtaaaggaaatcgagccctctttaaaaaaccaacttattatttctactgttttgatgacgattggtatcgcactcgttagttggattgcgcttccttattctttcaccatcttcaattttggtgttcagaaagaagttaagaactggcaattgttcttatgtgttggtgttggtttatgggctggccttataataggatttgtaacggagtactacactagcaacgcttacagccctgtgaaagatgttgctgattcttgccgtactggagctgctacaaacgtcatttttggccttgcattgggatataaatcagttattatccctatttttgcaatagcaatcagtatttttgttagttttagctttgctgcgatgtatggtattgctgtagccgcgctcggaatgctgagcaccatagctaccggtctggccattgatgcatacggtcccatcagtgacaacgctggcggcatagctgaaatggcggggatgagtcaccggattcgtgaaagaactgatgcccttgatgctgctggaaacaccactgctgctatcggaaagggttttgctatagggtctgcagccctagtatccctggctctattcggcgcattcgtgagccgggccgaaatcacaaccgtagacgtattaacccccaaagtcttcatcggtttactcgtgggcgccatgcttccatactggttctcagccatgacaatgaagagtgtcggtaaagcggctcttagcatggtcgaagaagtacgaaggcaattcaacaccattccgggcctcatggaaggtacagctaagcccgattacgccacatgtgtcaagatctccaccgatgcatccattaaagagatgatcccgcctggcgcacttgtcatgcttactcctctcattgtcgggatcttctttggtgttgagacgctttcgggtgttcttgctggatctcttgtgtcgggtgtacagattgctatttccgcatcgaacactggtggtgcttgggataatgcgaagaaatacatcgaggctggtgcatctgagcatgcaaggacacttggtccgaaagggtcagacgcgcacaaggcagccgtgattggtgacactgttggggaccctctaaaggacacatcgggcccgtctctaaacatcctcatcaagctcatggctgtcgaatcgctcgtgtttgctccattttttgccacccatggaggccttctattcaagatcttctagatttcatcacaaaggaaggtataattcaactttactgcttttctagatctttggagccattgaacacctgttggtcctttatgtttctctaaatctgtactatttaaaggtttatgagaaattagaaaatttttgacatgggttgatgagtgatgaatcatttatggttaacacaaaaaaaaaaaaaaggccgcctcggcccattcgac

SEQ ID NO: 3737 - DNA, 2666 bp, Podocarpus macrophillus
ggatcgctaggtcaagggttcgaaacccagccgcggaaacccattggtttttgcaaaaagatctgtctctctctctatataagctttccaagggaggttttgcagaagcatagatcgatctgcagtgtcttgtttttcaattttatttctggtttctactagtcttggggaaaaaaaatgggtggagcgattctcagtggaatgcttacggagatcttgattcctgtagctgctgtaatcgggattgtgtttgctctggttcagtggtttgttgtctcgcgggtgaaggttcagcctagtcatgccaatggcgctagcaataatagtaacaagaatgggtattcggagtacttgatcgaggaggaagaagggatcaatgaccagaatgttgttgcgaagtgtgctgagatccagaacgccatttcggaaggagcaacctcctttctgtttactgaatatcagtacatgggcatcttcatgaccttctttgcggttattatatttttgtttctcggatcagtggagaaatttagtacaaaaagtcagccatgcacctacagcaaggaaacaatgtgcaagccagctcttgccaatgctattttcagtactgtatctttcttgcttggttctttgacatctgctgtatctggatatcttggaatgaagattgctacttacgcaaacgcaaggacaacattggaagcgaggaagggtgttggaaaagctttcatcactgccttcagatctggtgctgtcatgggctttttgcttgcagcaaatggattgctggtgctttatattactcttaacctcttcaagttgtattatggggacgattgggaaggactttttgaagccattactggctatggtcttggaggatcttctatggctctattcggtagagttggtggtggtatctacaccaaagcggccgatgtaggagcagatcttgtcggcaaggttgagaggaacattcctgaagatgacccacgtaacccagcggttattgctgataatgttggagacaatgttggtgatattgctggaatgggatcagatttgtttggttcatatgctgaatcttcttgcgcagctttggttgtggcctcaatttcgtcatttggaatcaatcatgatttaactgctatgtgctaccccttgctcataagttcaatgggtatcattgtttgtttaatcacaactttgtttgcaactgacctatttgagatcaaggctgtgaaggaaattgaacctgcattgaaaaaacagcttattatctccacagtattgatgaccattggcattgctgttgtaagctttattgcattgccttcatcgttcaccatcttcaattttggtgctcaaaaggttgttaagaactggcagcttttcttctgtgttgctgtcggtctgtgggctggccttgtcattgggtttgtcaccgagtactacacaagcaatgcttacagccccgtacaggatgttgctgactcatgcaagacaggagcagcaacaaatgttatttttgggttggctttgggctacaaatctgtaattattcccatatttgccattgcagtaagcatatttgtcagttttagtttggctgctatgtatggtattgcagtagctgcattgggaatgctcagtactattgcaactggactggccattgatgcatacggacccatcagtgacaacgctggtggaattgctgagatggctggcatgagtcacagaatccgtgaaaggaccgatgcgcttgatgcagctggcaacactactgctgccattggcaagggatttgctataggatcagctgcattggtgtcacttgccttgtttggagcctttgtgagccgtgcaggaatatcaactgtagatgtcttgacacctaaagtattcattggtttgattgtgggagcaatgcttccctattggttctctgccatgaccatgaaaagtgtcggtagtgctgcattgaaaatggttgaagaggttcgcagacaatttaacaccattcccggtctcatggaaggtcatgccaagccagattatgcaacttgcgtcaagatatcaacagatgcttccctcagggaaatgattcctcctggctgccttgtgatgctgacacctctcattgttggtacattgtttggtgtggagacactgtcaggtgttctggccggtgcccttgtctccggtgtgcaggttgctatatctgcttcaaacactggcggtgcctgggacaatgctaagaagtacattgaggctggagcatcagaacatgccagaacccttggtccaaagggatctgatccacacaaggctgctgtgattggtgacaccattggagacccattgaaggatacctctggaccatcgctcaacattttgatcaaactgatggctgttgagtctctggtgtttgctcccttctttgcagcccatggtggtttgctgtttaagctgctctagatatgttccttaagctgtacttaacggaatcaattttcaccccgagtaacttgttaagaatgcccgctatgtcagggcagtgtcaagtcttatttgcaggttgttagtttcttgggtagttgtcctaagaggatgatggttctagttaaggttatttggctactgtcctggtcaattttgttacc

SEQ ID NO: 3738 - DNA, 2641 bp, Pinus pinaster
cattccgcacagcgaacgtctggttcattcttattttatttttaggggcctctccccattcttctcctggtaacgtttcagcttcggctgccctgcgttttattttaggtctctaacaatggggggcgctcttctctctgaaaccctgacggagattttaattccggtggctgccgttattggtatcgggttcgctctgattcagtgggttctggtgtcccgcgttaaggtgtcacccgaccactcacacacgcctagcaataacaacaaaaatggctacagtgagtacttgatcgaagaagaggaagggctgaacgatcacaatgtcgtcaataaatgcgctgagatccagaacgccatctctgaaggagcgaactcatttttattcaccgagtaccagtacatgggtattttcatggtctgctttgctgcccttatatttctgttccttggttcagtggagaaattcagtacaaaaagtcagccatgcacgtacaacaaagaagtgatgtgcaagccagcccttgctaatgctattttcagcacaatagctttcttgcttggttctttgacatctatcctttctggctatcttggaatgaaaattgcaacttacgcaaatgcaagaacaacactagaagccaggaagggtgtcgggaaggctttcattactgcctttcgatctggtgctgttatgggctttctgcttgctgcaaatggactgttggtgcttttcattgccattacccttttcaagttgtactatggagatgactgggagggtctttttgaagccattaccggttatggtcttggtggttcttccatggctctgtttggcagagtaggtggtggtatttacaccaaagcagcagatgtaggtgctgatcttgttggcaaggttgagaggaacattcctgaagacgatccacgcaacccagctgtcattgctgataatgttggtgacaatgttggagatatagctggtatgggatcagatctatttgggtcctatgctgaatcttcctgtgcagctctggttgttgcatccatatcatcatttggaaactctcatgatcttactgccatgtgttatcccttgctcattagttcaatgggtatcattgcttgcttaatcacaactctgtttgcaactgacatatttgagatcaaggctgtgaaggaaattgagcctgcattgaaaaagcagcttattatctccacagtagtgatgactattggcattgctgttgtaagcctagttgcattgccttcgtccttcactattttcaattttggtacccagaaggttgtaaagaactgggagcttttcttctgtgttgctattggtttgtggtctggccttgttattggttttgtcactgagtactatactagtaatgcttacagccctgtccaagatgttgctgattcatgcaggactggagcagcaactaatgttatatttgggttggctttgggatacaaatctgttattattcccatatttgctattgcagtaagcatttttgtcagttttagtttggctgccatgtatggtattgcagtagctgctttgggcatgctcagcacaattgcaactggattggccatcgatgcatatggaccaatcagtgacaatgctggtggaattgctgagatggctggcatgagtcacaggatccgtgaaaggacagatgcccttgatgcagctggaaatactaccgccgccattggcaagggctttgctattggttcagctgcattggtgtcacttgcattgtttggagccttcgtcagccgtgctgcaattcaaactgtggatgtcttaacaccaaaagtgttcattggtttaattgttggggcaatgcttccttattggttctctgcaatgacaatgaaaagtgttggtagtgcagcactgaaaatggttgaagaggttaggaggcaattcaacaccatccctggtctgatggaaggtcatgcgaagccagattatggaacttgtgtgaagatatcaactgatgcctcgctaaaagagatgattcctcctggttgccttgtgatgcttacacctctcattgttggtactttctttggtgtggaaactctatcaggtgtccttgctggtgctcttgtatctggtgtgcaggttgctatttctgcttccaacactggtggtgcttgggacaatgctaagaagtatattgaggctggtgcatcagagcatgccaggacccttggtccaaaagggtccgatccccacaaagctgctgtcattggtgacaccattggagacccattgaaggacacctctggaccatctctaaatattttgataaagctcatggctgttgagtcactggtgtttgcacctttttttgcaacccacggtgggttgctgtttaaatttttctagttgcagaaatccttttcaagttgtactagtcggcatcatttttctctttgagtatgacgagcaaagcctgtccgaaacgttatgattctcggtggatattgccagtggcaggttctgttcagaatgttagttttttaggtaaatgcctgaaggaggtagtggttctggttactgtgttattgcaactattgggtcaaattttgtattgccaattttcatgaa

SEQ ID NO: 3739 - DNA, 2743 bp, Lactuca sativa
gaagcggcattcgccacccataaaatctgagagagatttaaaggccgaatctctctttctccttcaattctttcgatttctctctctgatcttgttattttggccaatcgctgccgtcctccgacacaaaagtcatggggacgtccacaattctctcagatctcggcactgaaatcattatcccaatctgcgcagttgtcggaattatcttctctctcttccaatggtatctagtctcccaagtcaaactctcgctggagaaaccctccgccgacgacaagaacggctacacggaagcgttgattgaggaagaagaaggaatcaacgaccacaccgttgttcagaaatgcgctgaaattcagaccgctatttccgaaggagcaacctcctttctaatgactgaataccaatatgttggtattttcatggtgatttttgctgttctaatctttgtatttctgggatctgttgagagtttcagcacaagtagcaaagtatgcacatacgacaccaccaaaatgtgcaaacctgctctaatgacagctgtcttcagcactgtctccttcatccttggagctgtgacttcagtgatttctgggtttcttggaatgaaaattgccacatatgcaaatgccagaactacccttgaggctagaaagggtgttgggaaggctttcattgttgcattcagatctggagcagttatggggttccttcttgctgcaaatggtcttcttgtgttgtatatcaccattaatcttttcaagatttattatggtgatgattgggaaggtctttttgagtctattactggttatggacttggtggttcttccatggctctttttggtagagttggtggtggtatttatacaaaagctgctgatgttggagctgatcttgttggaaaggttgaaagaaatattcccgaagatgaccctagaaatccagcggttattgctgacaatgtgggtgacaatgttggagacatagctggaatgggatctgatctttttgggtcatatgcagagtcttcatgtgcagcccttgttgttgcttccatttcctcatttggaattaaccatgagttcactgcaatgatgtaccctctgattgtgagctctgtaggcatccttgtatgcttaatcaccaccttgtttgcaaccgatttctttgaagtcaaaaccgtgaagcaaatcgaacctactttgaaaaaccaactcatcatttcaactattcttatgaccattggtgttgcacttgttagttgggttgctctcccttctagcttcaccatcttcaattttggaacacaaaaagtcgtcaagaactggcaattgttcttgtgtgtctgtgttggtttatgggctggacttattatcggattcgtaactgagtactacactagcaatgcttacagccccgtgcaagacgtcgccgattcctgccgtaccggagccgccacaaacgtaatcttcggcctcgccctcggatacaaatccgtgatcatcccaatcttcgcaatcgccgtcagcatcttcgtgagcttcacctttgccgccatgtacggagtcgcagtcgccgccctcggaatgctcagcaccatcgccactggtctcgccatcgacgcgtacggtcccatctccgacaacgcgggtggaatcgccgaaatggccggaatgagccaccgcattcgcgaacgcaccgacgccctcgacgccgccggaaacaccaccgccgccatcggaaaggggttcgcaatcggatccgccgcgttagtctccctcgcgctattcggcgcgttcgtcagccgcgccgagatcacaaccgttgacgttttaactcccaaggttttcatcggtttgatcgtgggcgcgatgcttccgtattggttctcggctatgactatgaagagtgtcgggaaggctgcgcttaagatggtggaggaagttaggagacagtttaatgagattcctgggttgatggagggaactgctaagcctgattatgccacgtgtgttaagatttctactgatgcttctattaaggagatgatcccacctggtgctcttgttatgttgactcctcttattgttgggattttgtttggtgttgagacgctttctggtgttcttgctggatctcttgtttctggtgtacagattgctatctctgcatccaacactggtggtgcttgggacaatgctaagaaatatatcgaggcgggtgtttctgaccatgcaaagtcacttggaccaaaagggtctgacgcacacaaggcagctgtgattggagacactgttggggatcctttaaaggacacatcaggaccatcactaaacatcctcatcaaactcatggctgttgagtctcttgtgtttgctccattcttcgccacccatggaggacttctcttcaagatctttgagtaaggatacgaattataatccctccccctcttgtcttactattagccttttgagtaggcctattgtgttgtgtcgtgtcatatgtttctttagttatattacttcaagtgtttgtttatttttggagtcgtttagcatctttaaaacttgtcatgtgtctatttttgatgttttgtttcggcacttagcaaattttccatttgggattcgatgatgtattgctgctactatgacatgattgatgatgataagtagtcgatctcatgatgagtttgagcccgcatgcataaacaatgctcaaataaaaacttgtc

SEQ ID NO: 3740 - DNA, 2875 bp, Sequoia sempervirens
gatttgttggtcaagggatcgaaatccacgagtctctttgctgctggtttttcctttttctttggggattgttttactgtttatgctacaggagtagttttcaggcccctatttaagctccgagagggctttttgagtctttgaagtgaaataaattgaagcaaaaattgttttgtagttttcagttaatatgggggaagctctgcttagttcaatgcttactgagattctgatacctgtggctgctgttattgggatagtgtatgctctaattcaatggtttgttgtgtcaaaagttaaggtggtgcctggttacgccaatgggtccaacaatggcgccaacagcaaaaatggctttactgaatatttgattgaagaggaggagggtggtaatgaccacagtgttgttaccaaatgcgctgatattcagaatgctatctctgaaggtgcaacctcatttttgttcactgagtatcagtacatgggcgttttcatgatctgctttgcagttatcatctttttgttccttggttcagtggaaaaattcagcacaaaagatcagccatgcacctacaacaaggaattgatgtgcaagcctgctcttgctaatgccgttttcagtactgtatctttcttgcttggttcattgacatctgttttatctggatttctcggaatgaagatcgcaacttatgcaaacgcaagaacaacattagaagctaggaaaggtgttggaaaagctttcatcaccgcctttaggtctggtgctgttatgggatttttgcttgctgcaaatggactgttggtgctttatattaccattaatcttttcaagctatactatggagatgactgggagggtctttttgaagctattactggttatggtcttggaggttcctctatggctctatttggcagagttggtggtggtatttacactaaagcagcagatgttggtgcagatcttgttggaaaggttgagagaaacattcctgaagatgacccacgaaaccctgcggttattgctgataatgttggtgacaatgttggagatattgctggcatgggatcagatctgtttggttcctatgctgaatcctcatgtgcagcactggttgtagcatcaatctcatcatttggaacctcgcatgattttactgcaatgtgctttcccttgctcataagttcaatgggtatcattgtttgcttaatcacaacttcgtttgcaactgacatatctgagatcaaggctgtgaaggaaattgagcctgctttgaaaaagcagcttattatttctactgtattgatgaccattggcattgctgttgtaagttttgttgcattgccatcatccttcaccatattcaattttggtgaacaaaaggttgtcaaaaactggcaccttttcttctgtgttgctgttggtctatgggctggccttgtaattggttttgtcaccgaatactacaccagtaatgcttacagccctgtccaggatgttgctgattcgtgcaggactggagcagcaacaaatgttatctttgggctggctttaggatacaaatctgtcattattcccatttttgccattgcgataagcatatttgtcagttttagtttggccgccatgtatggtattgcagtagctgcattgggaatgctcagtactattgcaactggattagctattgatgcatatggacccatcagtgacaatgctggaggaattgctgagatggctggaatgagtcacaggatccgtgaaaggactgatgctcttgatgcagctggcaataccactgctgccattggcaagggctttgcaattggatcagctgcattggtgtcgcttgcattgtttggagcctttgttagccgtgcagcaattcccactgttgatgttttgaccccaaaagtgttcattggtttaattgtgggagcaatgcttccctattggttctctgcaatgacaatgaaaagtgtgggcagtgcagcattaaagatggttgaagaagttcgcagacaattcaatactatcccgggtctcatggaaggaactgccaaaccagactatgcaacttgtgtgaaaatatcaactgatgcttcgctaaaggaaatgattcctcctggttgccttgtgatgcttacacctctgattgttggtactttatttggtgtggagacactgtcaggtgtcttagctggtgcccttgtgtctggtgtgcaggtagcaatatctgcttcgaacaccggtggtgcttgggacaatgcaaagaagtacattgaggctggagcatcggaacatgccaggacacttggtccaaagggttctgatccccataaggctgctgtcattggtgacaccattggagaccctctgaaggacacatctggaccatctcttaacattttgatcaaactcatggctgtcgagtccttggtgtttgctccattctttgcaacccatggtggtttgttgtttaagctttagaaatcttcctcaagctgtatttagcggaatcaattttctcatcaagtatgatgttgaaagctcgtcaagatgttgtgattgctctcttgtgatcggtagtggcaactggcaagtttatttagatactgttaggttcctggataaaagcccctatagggtgatggttctagttaactgtgatttggctacctgtccgttcaattttgttaccatttttcatgaaaatataaactactttgaattattccacatccagttgtctggcacaagtttctacagctttatcaagcatgttttggattgggtcattgtgtatattagtataattactttctagcactgtgcaacttgtaaaatggatagatgaattaaagatatata

SEQ ID NO: 3741 - DNA, 2646 bp, Taraxacum officinale
tcccgggatgcggcattcgccacccataattacattatttatctgatagagatttctctctttctccttcaattccttcgatttctctcttcgatccttgtgtttttggccaatcgccgccgtcctccgacacaaaagtcatggggacgcccactattctttcagatctcggcacagaaatcattatcccaatatgcgcagttgtcggaattatcttctctctgttccagtggtaccttgtctccaaagtgaaactctcgttggagaaacccgccgccgacggcaagaacggcttcaccgaagcgttgattgaggaagaagaaggaatcaacgaccacaccgtggttcaaaaatgcgctgaaattcagaccgctatttctgaaggagcaacctcgtttctatatacggaataccaatatgtgggtattttcatggtgattttcgctgttctaatcttcgtcttcctggggtccgttgagggattcagcaccagcagccaagtatgcacctacgacaccaccaagatgtgcaaacccgctctcgccacagctggcttcagcgccgtcgccttcgtcctcggcgccgtcacctccgtcatttccggtttcctcggaatgaaaatcgccacatacgcaaacgccagaactaccctcgaggctagaaagggcgtcggaaaggctttcattgtcgctttcagatctggcgcagtcatggggttccttctcgctgccaacggtcttcttgtgttgtacatcaccatcaatctgttcaagatctattacggcgatgactgggaagggcttttcgagtccatcactggttatggactcggtggttcttccatggctcttttcggtagagtcgccggtggtatttacaccaaagctgccgacgtcggcgctgatctcgtcggaaaggtcgaacgaaatatccccgaagacgaccctagaaacccagcggttattgctgacaacgtcggtgacaatgtcggtgacatagccggaatgggatctgatcttttcggatcatacgccgagtcatcatgtgcggctcttgtggtcgcttccatttcctcatttggaatcaaccatgaattcaccgcaatgatgtaccctctaatcgtgagctccatcggcatcctcgtatgcttaatcaccaccctatttgccaccgatttcttcgaagtcaaaaccgttaagcaaatcgagcccgctctgaaaaaccaactcatcatctcaaccgtcctcatgaccatcggtgtagcactcgttagctggatcgctcttccttcttccttcaccatcttcaatttcggcgcccaaaaagtcgtcaaaaactggcaattgtttttgtgcgtttgcgttggtttgtgggccgggcttattatcggatttgttaccgagtactacactagcaatgcttacagtcctgtgcaagatgtggcggattcctgccgtacaggagcggccacaaacgtgatcttcggcctagcccttggctacaaatcggtgatcatcccaatctttgcaatcgcagtcagcatctttgtcagcttcacctttgccgccatgtacggggtggcggtggcggctctcggaatgctgagcaccatcgcgaccgggctggccatcgacgcgtacggtcccatctccgacaacgcgggcggcatagccgaaatggccgggatgagccaccgcatccgggaacgcaccgacgcgcttgacgccgccggaaacaccaccgccgccatcggaaaagggttcgcgatcgggtccgccgccctcgtgtccctcgcgctgttcggcgcgtttgtcagccgggctgaaatcacaaccgttgatgttctaacaccgaaggttttcatcgggttgcttgtgggggccatgcttccgtactggttttctgctatgactatgaagagtgtgggaaaggcggcgcttaagatggtggaggaagttaggaggcagtttaatgagatccctgggttaatggagggaactgctaaaccagattatgccacgtgtgttaagatctctactgatgcttccattaaggagatgattccacctggcgctcttgttatgctgaccccacttattgttgggattctgtttggtgtggagacgctttcgggtgtccttgctggatctctcgtttcgggtgtacaaattgctatctctgcatctaacaccggtggtgcttgggacaacgctaagaaatatatcgaggccggtgtttctgaccatgccaagtcactggggccaaaagggtctgacgcacataaggcggctgtgattggagacactgttggggatcctttaaaggacacatctgggccgtcgctaaacatcttgattaagctaatggctgctgagtctttggtgtttgctccgttctttgcggctcatggaggcgttctgttcaagttcttctaagtgatgaagggtgaaatgggtttcgagtctgtttagttttatatcatttatagtgtgtttgtgtttttggagtcgtttagtatgtttaaaactcaacttgtggggaagtgtctcgctatttttgatgttttgttcggcatttagcaatttttccgtttgagattgatgatgtactatgacatgttaatgatgataagttgtcgatctcacg

SEQ ID NO: 3742 - DNA, 2641 bp, Arnica chamissonis
cttcctcctttcgccggctggtttttttcactttccggctagattctaggtttccggtaccatggctccggctgtactgtcaagttttgcgacggaaataattattccggtttgttcggttattggtatcattttctcattactccaatggtttttagtctctagggttaaggttacacctgaccgtaacggtcctccgtcgagcaacaataaaaatggatacgatgactacttgattgaagaagaggagggggttaacgatcataacgtcgtcattaaatgcgccgagattcagaatgcaatctccgaaggttcaacctccttcttgtttaccatgtatcagtatgttggtattttcatggtggtttttgcaatcttgatctttcttttcctgggttctgttgagggcttcagcaccaaaagcaagaagtgtacatatgatgttaccatgatgtgcaaacctgcacttgcaactgctgccttcagtacaattgcctttctgcttggggctattacctcaatcatttcgggttttcttgggatgaaaatagctacttatgctaatgcaaggacaacactagaagctagaaaaggtgttggtaaagctttcgttactgcatttaggtctggtgctgtaatgggctttcttcttgctgcaaacggattattggttctatacattactattaatgtctttaagttgtattatggagatgattgggaaggactttttgaggctataactggttatggacttggtggttcttcaatggccctgtttggaagagttggtggaggtatatatactaaggctgctgatgttggtgctgatcttgttgggaaggttgaaaggaacattccagaagatgaccctagaaatccagctgtgattgctgataacgttggggataatgttggggacattgctggaatgggatctgatctttttggctcatatgctgaatcatcatgtgctgcacttgttgttgcttccatttcttcttttggaattgaacatgactttactgcaatgtgttatccattgcttgtgagttctgttggaattcttgtatgcttgataacgacactatttgcaactgatttctttgaaatcaaagttgttgatgaaatccaatcagcattgaagaaacagcttatcatctccactgttcttatgactgtcggtattgcaatcgtcagtttcattgggctcccaacatccttcacaatatataattttggtgttcagaaggtcgtttataactggcaacttttcttgtgtgtatgtgttggtctgtgggcaggacttatcattggttttgtgactgagtactacaccagcaatgcttacagcccggtgcaagatgttgctgattcctgcaggactggagctgcaacaaatgttattttcggtctcgcattgggatataaatctgtcattattcctatttttgctatagcagtcagcatctttgttagtttcagctttgctgccatgtatggtattgcggttgctgctcttggaatgcttagcaccattgcaactggtctagctatagatgcttatgggcccatcagtgacaatgctggcggcattgctgagatggcgggtatgagtcatagaatccgtgagaggactgatgcccttgatgctgccgggaacaccactgccgccattggaaagggatttgctatcggatcagctgcactggtatcattagcactatttggagcctttgtgagccgtgcaggcatccaaacggttgatgttttaacaccaaaagtcttcataggtctaattgttggtgctatgcttccatactggttttcagccatgaccatgaagagtgtgggcagtgccgcattgaaaatggtggaggaagtcagacggcagtttaacaccatcccgggactcatggaaggccttgcaaagcccgattataccacatgtgtgaaaatttcaactgatgcatctcttaaggaaatgattccacctggcgcccttgtgatgctgacccctttaattgtcggcacgttttttggagtcgaaactctttccggtgtccttgctggcgcgctagtttctggtgtccaggtggcaatttcggcatcaaacactggtggtgcatgggacaatgccaagaagtatattgaggctggcgcatcagaacacgcaaggagccttggaccgaagggatctgacccacacaaagctgctgtgatcggtgacacaattggtgacccactgaaggacacctcaggtccatcacttaacattctcatcaaactcatggctgtggaatcacttgtattcgcacccttctttgctgctcatggtggtttgctcttcaaactttagtcctcacccagcttttagcacccaagttagcccatcttttttttcttctaagtgttaggtcatagatagtcagatgatgatgatcatgatgatgttggattgttggaacatgtgttagttttttaaggttagaccagttagatcttattgtcttttacttttatgggccacctttgccttacttgccatttggatgaaacttaaaaaacatatttttgatgagctttctcatttggtgaaattgccgcgtgtaggcgtgtacttcgcaattcgcataatatc

SEQ ID NO: 3743 - DNA, 2511 bp, Theobroma cacao
ttgttcttaaatgtgctgaaattcaaaacgccatctctgaaggggcaacctcatttcttttcactgagtaccagtatgttggcattttcatggttgcttttgcaatcttgattttccttttccttggctcggtcgagggtttcagcactaagagccagccttgcatgtatgaccaatctaagatgtgcaagcctgctcttgccactgctgcattcagcaccatatctttcttgcttggtgctgtcacttcagttgtttctggctttcttgggatgaaaattgctacctatgcaaatgctagaaccactctggaggcaagaaagggagttggaaaggcatttatcactgcattcagatctggtgctgtcatgggttttcttcttgctgcaaatggccttttggtgctttacattgccatcaacttattcaaactctactatggtgatgattggggtggtctttttgaggcgatcactggttatgggcttgggggatcatctatggctctttttggcagagttggtggaggaatctataccaaagctgctgatgtaggtgctgatcttgtgggcaaggtggaaaggaacattcctgaggatgaccctagaaatccagctgtgattgctgacaatgttggtgataatgttggtgatatagctggaatgggatctgatctttttggctcttatgctgaatcatcttgtgctgcacttgttgttgcttccatctcttcttttggcatcaatcatgagttgactccaatgttatatcctctaatcatcagttccgttggtatccttgtttgtttaatcaccactttatttgcaacagacttctttgagattaaggctgtaaaggaaattgagccatcattgaagcgtcaacttatcatctccactgttctcatgactgttggaattggcattgttagttggatagctcttccatcttcctttaccattttcaattttggagaccagaaagctgtgaaaaactggcaactattcttatgcgtttctgttggtctttgggctggcctaattattggatttgtaactgagtactatactagcaacgcatacagccctgtgcaagacgttgctgattcctgccggactggagctgctactaatgttatttttggccttgcattgggttacaagtcttgcattattcctatttttgctattgcagtcagtatttttgttagttttagctttgctgctatgtatggcattgctgttgctgcccttggaatgttgagcaccatagctactggattggctattgatgcctatggtcccatcagtgataatgctggaggcattgctgagatggctggcatgagccacagaatacgagagagaactgatgctcttgatgctgcaggaaataccactgctgctattggaaagggtttcgccattggatcagcagcccttgtgtctcttgccctctttggtgcctttgtgagccgtgctgctatttcaacagttgatgtgttgacccctaaagtttttattggtttgcttgtgggtgcaatgcttccttactggttctctgctatgaccatgaagagtgtgggaagtgctgctttgaagatggttgaggaagtgcgcaggcaattcaatacgatcccaggtctcatggagggcagtgctaagcctgactatgctacctgtgttaagatttctacggatgcttccatcaaagaaatgatccctcctggagcccttgttatgctcacaccccttcttgttggaatcttttttggtgtggaaactctctctggtgtccttgctggatcccttgtctctggtgtgcagattgctatctctgcatcgaacacagggggtgcttgggataatgccaagaagtatattgaggctggtgcttcagaacatgcaagatctcttgggcccaaaggatcagatccacataaggcagctgttattggtgacaccattggggaccctctgaaggatacatctgggccatcattgaacatcctcatcaagctaatggctgtcgaatcacttgtcttcgctcccttctttgctacacatggtgggcttctttttaagatattttaagagaagacaaaagatgggctaatggtccaccgattccagcttttacgggttcttctcttctagttctccttttgaagtaaatttagtttgtagcacattttgactctagagaccatatcctctttaaggtcaaatcggcagtgagaattttcccttgcaaagggttgacaatgacattgatgatgatgatgatgattctggtcaatctagaaaagagttaaagccccattgttactattattactttttgtttttgtgaagaatgtttttgttgccctcgcgcaactttgttttcttgctctgatatccattgtcatgcctggttgttgttggcataaatcttggactctaaatgattcaaagcatggattattgaaaattgcaggaaaaaaaaaaaggtgctcttttgatttgttat

SEQ ID NO: 3744 - DNA, 2760 bp, Pseudotsuga menziesii
gcattttgcacagcgatcgtctggttcatttcttacttcatttttctgggggtgtctcccagttatcttctttttgtagtggcgcttcagctttagttgccctgcgtttgatttttggtcttaaacaatggggggcgctcttctttctgaaaccctgacggaggtcttgatcccggtggccgccgttgtgggtatcgtgtttgctctgattcagtggtttctggtgtcccgcgttaaggtggcgcctgatcactcacacacacctagcaataacaacaagaatggcttttctgagtacttgatcgaagaagaggagggaattaacgaccacaatgtcgtcaataaatgcgcagagatccagaacgctatctctgaaggagcaaactcgtttttattcactgagtaccagtacatgggtgttttcatggtttgctttgcaatcctcatatttctgttccttggctcagtggagaaattcagtacaaaaagtcagccttgcacgtacaacaaagaagtgatgtgcaagccagcccttgctaatgccatttttagcacaatatctttcttgcttggttctttgacatcttgtttctctggctatctcggaatgaaaattgcaacttatgcaaatgcaagaacaacactagaagccaggaaaggagttgggaaagctttcattactgcttttcgatctggtgctgtgatgggctttttgcttgcagcaaatggactgttggtcctttatgttaccattaatcttttcaagttgtactatggcaatgactgggagggtctttttgaagcaattactggttatggtcttgggggttcttccatggctctgtttggcagagtaggtggtggtatttacaccaaagcagcagatgtaggtgcagatcttgttggcaaggttgagcggaacattcccgaagatgatccacgcaacccagctgtcattgctgataatgtcggtgacaatgttggagatattgctggtatgggatcagatttatttgggtcctatgctgaagcttcctgtgcagctctggttgttgcatccatatcatcatttggaaacactcatgactttactgccatgtgctatcccttgctcattagttcaatgggtatcattgcttgcttaatcacaaccctctttgcgactgacatatttgagattaaggctgtgaaggaaattgagcctgcattgaaaaagcagcttattatctccacagtattgatgaccattggcattgctgttgtaagtttagttgcattgccttcatccttcaccatcttcaattttggtgcccagaaggttgtaaagaactgggagcttttcttctgcgttgctattggtttgtgggctggccttgtcattggttttgtcacagagtattacacaagtaatgcttacagccctgtccaagatgttgccgattcatgcaggactggagcagcaactaatgttatatttgggttggctttgggatacaaatctgttattattcccatatttgcaattgcagtaggcatttttgtcagttttagtttggctgccatgtatggtattgcagtagcggctttgggcatgctcagtacgatagcaactggattggccattgatgcatatggacctatcagtgacaatgccggtggaattgctgagatggctggcatgagtcacaggatccgtgaaaggactgatgcccttgatgcagctggaaacactactgcagctattggcaagggttttgctattggttcagctgcattggtatcacttgcattgtttggagcctttgtcagccgtgctgcaattcaaactgtcgatgtcttgactccgaaagtgttcattggtttaattgttggggcaatgcttccttattggttctctgccatgacaatgaaaagtgtgggtagtgcagccttgaaaatggttgaagaggttaggaggcaatttaacaccatcccaggtctgatggaaggtcatgctaagccagattatgcaacttgtgtgaagatatcaactgatgcctccttgagggagatgattccacctggttgccttgtgatgcttacacctctcattgttggtacattatttggcgtggaaacactatcaggtgttcttgctggtgctcttgtatctggcgtgcaggttgcaatttctgcttccaacactggaggtgcttgggacaatgccaagaagtacattgaggctggtgcatcagagcatgccaggtcacttggtccaaaagggtctgatccccacaaggctgctgtcattggtgacacaattggagacccattgaaggatacctctggaccatctctgaacattttgataaagcttatggctgtcgagtcactggtgtttgcacctttttttgcaacccacggtggattgctgtttaaactttagaatttggtagcagaaatccttctcaagttgtactagtcggcatcatttttctctttcgagtatggcaagcagaatcctctccaaaacgttatgattcttgttagacatggacagtggcagcttaaattcagaatgttagtttctaggtaaatgcccaaaggaggtcatggttctggttcctgtgattttgctactattggttcaattttgtattgccatttttcatgaaaaatgaagtatttgaaatttctccataatcagtgctttgagatgctttgagataatgtatgcaatcattttttattagaattctctttatggacgaggttttaagt

SEQ ID NO: 3745 - DNA, 2624 bp, Silene vulgaris
cccccttttgtctcctacattgccggaaaatcggcgaattaggttcccggcgataaaaatgataccagatctagctactcaaatcataattccgacgtgcgccgtcgtcggaatcatattctctctcttccaatggttcatcgtcgctaaagttaaggtcacacctgaaaaacaacacatcaacaatggcggaagctctaaaaacgggtttcatgatcgtttaattgatgaagaagaagaaggtgttgatggtgatgaggccgtacttaagtgcgctgaaatccaaaacgccatttctgaaggtgcaacatcctttttgttcacggaataccagtatgtcggggtttttatggttgcattcgctgctctcatcttcctcttcttgggatctgtggaaggatttagtacagaaactcgacgatgcacgtacaaccctttcaagacgtgtaagccagcattggccacagctgtcttcagtactgtggcttttatgcttggtgccatcacttctgtgatctctggtttcttgggaatgaaaattgcaacttatgcaaatgcaaggacaaccttggaagctaggaagggtgtcggcaaggctttcattactgcattcagatctggtgctgtgatgggtttccttctggcagcaaatggcctacttgttctctatatcaccattaatttattcaagttgtactatggtgacgattgggagggtctttttgaggctattactggctatggtcttggtggatcatctatggctctctttggtagagttggaggaggtatttataccaaggccgctgatgttggtgctgatctcgttggaaaggttgaaaggaacatcccagaggatgatcccaggaacccagctgtgattgctgacaatgtgggtgacaatgtgggtgatattgccgggatgggttccgatctttttggctcatatgctgaatcatcttgtgctgctcttgtcgttgcttcaatatcatcctttggtatcaatcacgagtacactgccatgtgttatcccctgctcatcagttccgtgggaatcatagtttgcttaatcacaactctctttgctactgatttctttgaaattaaagctgtcaaagaaattgagccagcgctaaaaatgcaactaattatttctactgcacttatgactgttggagttgccgttatctcttggattgctcttccgtcttctttcaccatttttaattttggcactcaaaaggtcgtccaaaactggcaacttttcttgtgcgtgtgtgttggcctttgggcagggctcattattggtttcgtgactgagtactacacaagcaatgcatacagtcctgtacaagatgttgctgattcctgtcgaactggagctgccacaaatgtaatctttggtttggccttaggttacaagtctgtcattattcctattttcgccatagctgtcagtatcttcatcagtttcagtttcgctgctatgtatggtgttgctgtggctgcccttggaatgttgagcactattgctactggtcttgctattgatgcctatggccctattagtgacaacgctggtggtattgctgagatggccggcatgagccataaaattcgtgaaaggactgatgcccttgatgctgctggtaacacaactgctgccattggcaagggatttgctataggctcagctgcactggtatctttggccctctttggtgcctttgtcagccgcgcttctattgcaactgttgatgtgctcacccctaaagtattcatcggattaattgttggtgccatgcttccttactggttttctgcaatgaccatgaagagtgtcggtagtgctgctttgaagatggttgaggaggtccgaagacagttcaacacaatcccaggattgatggaaggaactgcaaagcccgactatgccacttgtgttaagatctccactgatgcatctatcaaggagatgatcccacctggtgcattggttatgctcaccccactcattgtcggaactctcttcggcgtggagaccctttctggtgttttggcaggctcgcttgtttctggtgtccaggttgccatatctgcctcaaacactggtggagcatgggacaatgccaagaagtacattgaggctggtgtctccgagcatgcaaagtctctcggaccaaagggttcagaaccacacaaggcagctgtcatcggtgacaccatcggtgaccctcttaaggatacatctggcccttcgctaaacatactgatcaagctcatggcagttgagtcccttgtttttgctccctttttcgccactcacggtggccttctcttcaagatcttctcgtaatggtaacagcaactccaacttgaaggaatcctcgggattttcttgtgttctcatctgtaatacccaagttttctgccgatttatgggtctgtgagtgtacttttgataggaaacagtacaattatcgtcgattattatgaaattagtattgaggatccatttgtaagtctagagaaagaaatctgtgtttttggttacatttgttgtaggaaagtttctgttatacaagactgtatggttttaggatccaaatgaatgagttgatttt

SEQ ID NO: 3746 - DNA, 3205 bp, Sorghum bicolor
cccgctatataagaacacgcgccccgagcacaggggagagagcgtgcagagcgagacgcatccgtccgtcgcctcccccaccccgccgccgccgcgcgtccgtgcgttcgttcgttcgttcgttcaccgcgtagggttagggtttgcggtcgacgccgcgccgccatggcgatcctctcgccgctcgccaccgaggtgttcatccccgtcgccgccgtcatcggcatcgtcttcgccgtcgtgcagtgggtgctcgtgtcgcgggtgaagctctccccgaccgcggccgccgcgtccggcggagggaagaacggctacggcgactacctcatcgaggaggaggaggggctcaacgaccacaacgtcgtcgtcaagtgcgccgagatccagaacgctatctccgaaggagcaacatcgtttcttttcactgagtaccaatatgttggtatcttcatgtctatcttcgccgttgtgatcttcctcttccttggttcggttgagggattcagcacgaagagccagccctgcacctatagcaaggacaagtactgcaagcctgcactgttcactgccctcttcagcactgtgtccttcttgcttggagccatcacctctctggtatctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcaccattaatgtatttaagttgtattatggtgatgactgggagggtctttttgagtctatcactggctatggccttggtgggtcgtccatggctctcttcggaagagttggtggaggtatctacacgaaggctgctgatgttggtgccgatcttgttgggaaggttgagaggaacattcctgaggatgatcctaggaacccagctgtgattgctgataatgttggtgacaatgttggtgacattgctggaatgggatctgatctctttgggtcatatgctgagtcttcctgtgctgcccttgttgttgcgtctatttcatctttcggaattgaccatgacttcactgggatgtgctacccactccttgttagctctgttggtatcatcgtctgcttgatcaccaccctttttgctactgatttctttgaagtcaaggctgtgaaagaaattgagcctgcacttaagaagcagctcatcatctccaccgccctgatgactgttggtattgctgtaatcagctggttagcccttccagctaagttcaccatctacaacttcggtactcagaaggatgtctccaactggggcttgttcttctgtgttgcaattggtctgtgggctggtctgattattggttttgtcacagaatactacactagcaatgcatacagtcctgtgcaagatgtcgcggattcgtgcagaaccggtgctgccactaatgtcatttttggtctcgctcttggatacaagtcagttatcatcccgatttttgctatcgctgttagcatctatgtcagtttctccattgctgcaatgtacggcatcgctgttgccgctcttggtatgctgagcacaatcgcaactggtcttgccattgatgcttatggtcccatcagtgacaatgctggtggtattgctgagatggctggaatgagccacagaatccgtgagagaactgatgctcttgatgctgctggcaacacaactgccgctattggaaaggggtttgccattggttcagctgctcttgtgtccctggcgctttttggcgccttcgtcagcagagctggagtgacggttgtcgatgtcctctcccccaaggttttcattggtttgattgttggagccatgcttccctactggttctctgccatgaccatgaagagtgttggaagtgctgccctgaagatggtggaggaggtccgcaggcagttcaacaccattcctgggttgatggagggaactgccaagcctgactatgcaacctgtgtgaagatctccaccgatgcttccatcaaggagatgattcccccgggtgctctggtcatgctcactcccctcattgttggaaccctcttcggtgttgagactctctctggcgttcttgctggtgccctggtttctggagtgcagattgccatctctgcttccaacaccggtggtgcatgggacaatgccaagaagtacattgaggctggtgccagcgagcatgcaaggacccttggccccaagggatctgactgccacaaggctgctgtgatcggtgacaccattggtgaccccctgaaggacacctcgggcccgtccctcaacatcctcatcaagctcatggccgtggagtcccttgtgtttgcccccttcttcgccacccaaggtggcattctgttcaagtacctgtaagggccacaccaagcacaggagaagtatatgatcgaccgaccatggacatctcgaataactcctgccgaattgccagttcttgtgtattgtgcgctagttgtctagctgcactgctgtttttttggtctcattgtttcaggattgctgctgctgttcgtattttctctttgggcctcctggaggcgttactgttagccttactcttactccctgtagctccacgtagaagagagcagatgtcctgcgtctggcaaattttcccagtcccttgatgatggcgatgatgttgaaatctttgaacaatgatacatgattgttgcattgtactgttggtaactccgtatctgttgatgcccatccggccactccaatcatccaatgttatgctctgctccagtcacccaatgttatgctctggttatagcggaatacgaatgctgcttgtactgtcatggctgctgccgacaagttcataagataacctaaggcctgtttggattgtaggaatttcaaaggaatctaattcctttgttttgcttgcattacatagtgtttggaatggaggaataaagttttcctttcctatgaaaatgctttcttttcaagaaataaagggaataaagtatccactctaaactcttggaaacttttcctatatgtgaatggagtgatgagcaagtccttgtttagtgcagtagaatggaggaataaacatgtcttatgttcccatgttcaaaacacaaattcc

SEQ ID NO: 3747 - DNA, 2591 bp, Brassica napus
ctctctctctctgtgttgtgttttgtgtgttgtctcgcgcgagatggtggcgttagcttttctcccggagctctggacggagatcctaatccctgtctgtgcggtggtcggcatcgttttctctctcttccaatggttcatcgtctctcgagttagagtcagcgctgaccaaggcgcatcgtcgtcttccggtggtgccaacaatggtaagaacggctacggagattacctcatcgaggaagaggaaggcgttaacgaccagagcgtcgtcgccaagtgcgctgagattcagaccgctatatccgaaggtgcaacttcgttcctgttcactgagtacagatacgtcggtgtcttcatggtcatcttcgccgcgatcatcttcgttttcctcggctccgtcgaaggattcagcacagagaacaagccttgcacttacgacgacaccaagacctgcaagcctgcgttagccaccgcagctttcagcaccatcgctttcatcctcggcgcggtcacctctgttctctctggcttcctagggatgaagatcgccacgtacgccaacgctagaaccaccttggaggcgaggaaaggtgtcggaaaggcctttattgtggccttcaggtccggggccgtgatggggttccttcttgctgcgagtggtctcttggtgctttacattactatcaatgtgtttaagatctattacggtgaggattgggaaggtctctttgaggctattactggttacggtcttggtggttcttccatggctctctttggacgtgttggtggtgggatctacactaaagcggctgatgtcggtgctgatcttgtcggtaaaatcgagaggaacattccagaagatgatccaagaaacccagctgtcattgctgataatgtgggtgacaatgttggtgacattgctggtatgggatctgatctctttggttcatacgctgaagcatcgtgtgctgcacttgttgttgcttccatctcttcctttggaatcaaccatgacttcactgcaatgtgctacccgttgctcatcagttcgatgggaatcttggtttgtttgatcacaactctcttcgccaccgacttcttcgagatcaaggctgttaaggagattgagcctgcgttgaagaatcagctcatcatctcaactgttatcatgaccgttggaatcgctattgtttcatatgttggcttgccttcttccttcaccatcttcaactttggagcacaaaaggtcgtcaagaactggcaactattcttatgtgtctgtgttggtctatgggctggactcattattggttttgtcactgagtactacactagcaacgcctacagccctgtgcaagacgttgcagactcatgcagaactggtgcagccaccaatgttatattcggattagctcttggttacaaatccgtcattataccaatctttgctattgctatcagtatattcgttagcttcagcttcgctgctatgtacggtgtcgccgttgctgctctaggcatgctcagcaccatcgccactggtttggcgattgatgcttacggtcccatcagtgacaatgctggtggtattgctgagatggttggaatgagccaccgcatccgtgaaagaaccgatgctcttgatgcagctggtaacaccactgccgctattggaaagggatttgctattggctcagctgctctagtctccttggctctgttcggtgcctttgtgagccgtgcaggagtccacaccgtagatgttttgaccccaaaggttatcattgggcttcttgttggtgccatgcttccttactggttctcagccatgacgatgaagagtgtgggaagtgcagcgcttaagatggttgaagaagttcgcaggcagttcaacaccatccctggactcatggaaggtaccgcaaaaccagactacgccacttgcgtcaagatctccaccgacgcttccatcaaggagatgattcctcctggttgccttgtcatgctcacacctctcattgttggtttcttctttggtgttgagactctctctggtgttctcgctggctcccttgtttccggtgttcagattgctatttctgcttctaacactggtggtgcctgggacaacgccaagaaatacattgaggcgggtgtatcagagcatgcaaagagcctaggaccaaagggttcagagccacacaaggcagctgtgattggtgacaccattggagacccattgaaggatacttcaggaccttctttgaacatcttgatcaagctcatggctgtcgagtctcttgtatttgctcccttctttgccactcatggtggtatccttttcaagtacctctaaactcaacccggagtgaagaaagaaagatgatgatgaagaagaagatattggctatcgattcaaaactctcttttttttagcattcttgttttcgttttgagtaggtggtcaaaagttaaaacatgtttttgttaatggggagctcatttaaagaaccaaacgaaatgatgactctctctctctctttctttatatctttttgtgctgtctagaatttagaaaaccaccaagt

SEQ ID NO: 3748 - DNA, 2924 bp, Sciadopitys verticillata
aacgtgtctgaagaaatattttttaggtcaagggttcgaaacccattgtctcctcttctggaagaaatttttctccagagggaaaaagtcgtggaaggaattatcgaaggagaaaaaagtgtcattttcatcaaactctggttttgttagctgctgtttttgagtgtagaaacgcaaaaccactgcgtttttccacggaaaattgcactcgaaaaccgccgctgtgtaattgtttgtttgaacgttatttaagccccttcgagggcttcaaagttcctgagagaacccaaaacaaaaaattgtgtgatagagtcttaattcaagtctgagatcttctggtcttgtttagtttttgtttttccttttaaggatttgaagatgggagaagctatgctgagcgaaatgctcactcagattgttatacctgtggctgctgtcgtgggtattgtgtttgctctgattcagtggcttcttgtttcaaaagttaagatggtggccggccacgccaatggatctagcaacaatagcagcagcaaaaatgggccgagtgagtatttgattgaagaggaggaagggatcaatgaccagagtgtcgttgccaagtgtgccgagatccagaacgctatttctgaaggagcaaactcgtttctgttcactgagtatcagtacacgggcattttcatggtctgctttgcagttatcatatttttgttccttggttcggtggagaagttcagtacaaaaagtcagccatgcaactacaacccggaattgatgtgcaagccagctcttgccaatgccgtttttagcactgtatctttcgtgcttggttctttgacatctgttttatccggttaccttggaatgactattgcaacttatgcaaatgcaagaacaacattagaagccaggaaaggtgttggaaaagctttcatcactgcctttaggtctggtgctgttatgggatttttgcttgctgcaaatggactgttggtgctttacattaccattaatctattcaagttgtactatggagatgattgggagggtctttttgaagctattactggttatggtcttggtggttcctccatggctctatttggtagagttggtggcggtatttacacgaaagcagcagatgtaggtgcagatcttgttggcaaggttgagaggaatattcctgaagatgacccacgtaatccagcggttattgctgacaatgttggtgataatgttggagatattgctggaatgggatcagatctgtttggttcctatgccgaagcttcttgtgcagctcttgttgtagcatcaatttcatcatttggaacctcacatgattttactgcaatgtgctacccattgctcataagttcaatgggtatcattgtttgtctgatcacaactttgtttgcaactgacatattcgagatcaaggttgtgaaggaaatcgagcctgcattgaaaaagcagcttattatctctacagttttaatgactattggaattgctgttgtaagttgggttgcattgccatcatccttcaccatcttcaattttggtgcccaaaaggttgtcaaaaactgggagcttttcttctgtgttgctgttggtttatgggctggccttgtcattggttttgttaccgaatactacacaagcaatgcttacagccctgtccaggatgtggctgattcatgcaggacgggagcagcaacaaatgttatctttggtttggctttgggatacaaatccgttattattccgatatttgctattgcaattggcatctttgttagttttagtttggctgcaatgtatggtatagcagtagctgcattggggatgctcagtaccattgcgactggattggccatcgatgcatatggacccatcagtgacaatgctggtggaattgctgagatggctggcatgagtcacagaatccgtgaaaggactgatgcccttgatgcagctggcaacaccactgctgccattggcaagggctttgctattggatcagctgcattggtgtcacttgcattgtttggtgcctttgttagccgtgcagcaatttcaactgtggatgtcttgacgcccaaagtgttcatcggtttaattgtgggagcaatgcttccctattggttctctgcaatgacaatgaaaagtgtgggcagtgctgccttgaaaatggttgaagaggttcgcagacaattcaacactatccctggtctcatggaagggcatgccaaaccagactatgcaacttgtgtgaagatatcaactgatgcttccctgaaggaaatgattcctcccggttgccttgtgatgctcacacctctcattgttggtactttgtttggtgtggagacattggcaggtattctggctggtgcccttgtgtctggtgtacaggttgctatttctgcttcaaacactggtggtgcttgggacaatgccaagaaatacattgaggctggagcatcagaacacgccaggtcacttggtccaaaaggttccgattgtcacaaagctgctgttattggtgataccattggagacccattgaaggatacctctggaccatctcttaacattttgatcaaactcatggctgttgaatccctggtgtttgcacccttctttgcagcccatggtggtttgctcttcaaaatttagaaagtgttcctgaagatgtaccaaacggaattaattttctcgagtatgttattgaaagctagtcaaaaatgtcacaattgcccccctagggattgggcattggcaagttttttaaatcgtgttaggttcctggataaatgcccttacagcaagggtgattgttctagttaaatgtgatctgtgtactgtccgttcaattttgttaccatttttcatgaaaatataaactattttgaattaat

SEQ ID NO: 3749 - DNA, 2898 bp, Sorghum bicolor
cctggttagggttagcccaagagacgcatccgtccgtcgcctcccccaccccgccgccgccgcgcgtccgtgcgttcgttcgttcaccgcgtagggttagggtttgcggtcgacgccgcgccgccatggcgatcctctcgccgctcgccaccaaggtgttcatccccgtcgccgccgtcatcggcatcgtcttcgccgtcgtgcagtgggtgctcgtgtcgcgggtgaagctctccccgaccgcggccgccgcgtccggcggagggaagaacggctacggcgactacctcatcgaggaggaggaggggctcaacgaccacaacgtcgtcgtcaagtgcgccgagatccagaacgctatctccgaaggagcaacatcgtttcttttcactgagtaccaatatgttggtatcttcatgtctatcttcgccgttgtgatcttcctcttccttggttcggttgagggattcagcacgaagagccagccctgcacctataacaaggacaagtactgcaagcctgcactgttcactgccctcttcagcactgtgtccttcttgcttggagccatcacctctctggtatctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcaccattaatgtatttaagttgtattatggtgatgactgggagggtctttttgagtctatcactggctatggccttggtgggtcgtccatggctctcttcggaagagttggtggaggtatctacacgaaggctgctgatgttggtgccgatcttgttggaaaggtcgagaggaacattcctgaggatgatcctaggaacccagctgtgattgctgataatgttggtgacaatgttggtgacattgctggaatgggatctgatctctttgggtcatatgctgagtcttcctgtgctgcccttgttgttgcgtctatttcatctttcggaattgaccatgacttcactgggatgtgctacccactccttgttagctctgttggtatcatcgtctgcttgatcaccaccctttttgctactgatttctttgaagtcaaggctgtgaaagaaattgagcctgcacttaagaagcagctcatcatctccaccgccctaatgactgttggtattgctgtaatcagctggttggcccttccagctaagttcaccatctacaacttcggtactcagaaggatgtctccaactggggcttgttcttctgtgttgcaattggtctgtgggctggtctgattattggttttgtcacagaatactacactagcaatgcatacagtcctgtgcaagatgtcgcggattcgtgcagaaccggtgctgccactaatgtcatttttggtctcgctcttggatacaagtcagttatcatcccgatttttgctatcgctgttagcatctatgtcagtttctccattgctgcaatgtacggcatcgctgttgccgctcttggtatgctgagcacaatcgcaactggtcttgccattgatgcttatggtcccatcagtgacaatgctggtggtattgctgagatggctggaatgagccacagaatccgtgagagaactgatgctcttgatgctgctggcaacacaactgccgctattggaaaggggtttgccattggttcagctgctcttgtgtccctggcgctttttggcgccttcgtcagcagagctggagtgacggttgtcgatgtcctctcccccaaggttttcattggtttgattgttggagccatgcttccctactggttctctgccatgaccatgaagagtgttggaagtgctgccctgaagatggtggaggaggtccgcaggcaggtcaacaccattcctgggttgatggagggaactgccaagcctgactatgcaacctgtgtgaagatctccaccgatgcttccatcaaggagatgattcccccgggtgctctggtcatgctcactcccctcattgttggaaccctcttcggtgttgagactctctctggcgttcttgctggtgccctggtttctggagtgcagattgccatctctgcttccaacaccggtggtgcatgggacaatgccaagaagtacattgaggctggtgccagcgagcatgcaaggaccctgggccccaagggatctgactgccacaaggctgctgtgatcggtgacaccattggtgaccccctgaaggacacctcgggcccgtccctcaacatcctcatcaagctcatggccgtggagtcccttgtgtttgcccccttcttcgccacccaaggtggcattctgttcaagtacctgtaagggccacaccaagcacaggagaagtatatgatcgaccgaccatggacatctcgaataactcctgccgaattgccagttcttgtgtattgtgcgctagttgtctagctgcactgctgtttttttggtctcattgtttcaggattgctgctgctgttcgtattttctctttgggcctcctggaggcgttactgttgagcctcaccctgctggattactccttcaccagcggcagtacactcttgacatcctggagagagctgggatgactgactgcaagccctgctccactccggttgacacacagggcaagctatcggaggctgagggtacaccagtgacagatcccactgcatatcagagtcttgccggggcacttcagtacctcaccttcacccggccggatatcacctatgcagttcagcagatctgtcttcatatgcatgatccccgggagccacacctcaccgctctcaagcggatc

SEQ ID NO: 3750 - DNA, 4039 bp, Cedrus atlantica
aacacggcctgccctcttcgaatcccgtgattatcaagacgccatgaacaccgtctgcaggcgtcttggggttcaagacaggtgctcaaaagagagcttccagaatagcgttttgagagcggggtgctccaacttagggtttcatttcgagagagttccccgaaattcaacggaggatcacttctgcggctcctgctgtttcggttgtaggacaggaaataaaaaaggggcggaagagacgtggctggttgatgctgtggattccggctcgctaattttagcgggatgtagagcggagaaggtcttgttcgaagaaattgcaacaagcgggaagcaaaaggctaccggtgtcgtggctacttttgggccgaagcggcggagcatattcgtgcaaggcaaggtgaccgtgtccgcctgcggttcccttctcacgccactgcttctccgctcaagcggcctccggaaccctaacataggtagaaatctccaccttcatcctgtccagatggcttggggtttcttcccggaaaatcatgaaccggcgggtaaaccccatgagggcggtatcatcactggcatctgtaaggaaggcgccaaatgggagcagtcaggctatggcaccattatccagaccccggcaatccctcccgggtgcttcgccgcattgaatccctggacctccggcctggatatgaaagagcgaatgcgaaaatatcatcggacagcccacgtgttctgtttggctcgtgaccgcggcagcggaagcgtattcagcgaaaaggaaatcgattacaggcttgccgagtcggataaagataatttgaaggaggggctgaggagatgcttgaggatcttgatcgctgcaggtgccaccgaggtggggacgcatcgtagcgacggggaacggcttgctgttaagggtgccaccgatgatgaaatcgagaaattcttgagcaatcaggtgaagagaaggagaggagtgtggtcgcctttgtgctctgctcatcagatggggagctgcagaatgggcaaagcgaaaagtctggtggcgtggactggaagggcgaaagctgggaagtggaaggactgttcgtctgcgatggaagcttgttgccaactgccgtgggggtgaatcccatgatcaccattcaatcccttgctttttgcatagctaaccatatactgcaattgctgcatacaaattcgtctcagcctttcacttgtggctcctgaacatgtgtaatgtgacgtggaaaacatgcatggagcctctagttttatttttctgggggtttctccctgatcttttcttcttctactaacgcttcagcttcggctgccctgcgttttattatagttagggctcctgatctctttctatgatcgaaaagccgtcgttcaggccagtaaaggttcccactgacctcggagagaagaattataactaatattcagttctctgtttgtttatttttgaattcctggataggtcgctcagacaatgggggccgctcttctctctgaaaccctgacagaggtcttgatcccggtggccgctgttgtgggcatcggtttcgctctgattcagtggtttctggtgtcccgcgttaaggtggcgcccggccacttacatgcccctagcaataacaagaatggctacaccgactacttaatcgaagaagaggaggggattaacgaccagaatgtcgtcattaaatgcgcagaaatccagaatgccatctctgaaggagcgaactcgtttctattcactgagtaccagtacatgggtgttttcatggtctgctttgcagtcctcatatttttgttccttggttcagtggagaaattcagtacaaaaaatcagccttgcacgtacaacaaagaagtgatgtgcaagccagcgcttgctaatgccatttttagcacgatagctttcttgcttggttctttgacatctatcttttctggctatcttggaatgaaaattgcaacttatgcaaatgcaagaacaacactagaagccaggaagggtgttgggaaagcttttattactgcctttagatctggtgctgttatgggctttctgcttgctgcaaatggactgttggtgctctatgctgctattaatcttttcaggttgtactatggaaatgactgggagggtctttttgaagccattactggttatggtcttggaggttcgtccatggctctgtttggcagagtaggtggtggtatttacaccaaagcagcagatgtaggtgcagatcttgttggcaaggttgagaggaacattcctgaagatgatccacgcaacccagctgtcatcgcggataatgttggtgacaatgttggagatattgctggtatgggatcagatctatttgggtcctatgctgaatcttcctgtgcagctctggttgttgcatcgatatcatcatttggaaactcccatgattttactgccatgtgctaccccttactcattagttcaatgggtatcgttgtttgcttaatcacaactctgtttgcaactgacatatttgagatcaagggtgtgaagcaaattgagcctgcattgaaaaagcagcttgttatctccacagtattgatgactattggcattgctgttgtaagtttagttgcattgccttcatctttcaccatcttcaattttggtgcccagaaggttgttaagaactgggagcttttcttctgtgttgcaattggtttgtgggctggccttgttattggttttgtcacagagtactacacaagtaatgcgtacagccctgtccaagatgttgctgattcatgcaggactggggcagcaactaatgttatatttgggttggctttgggatacaaatctgttatcattcccatatttgctattgcagtaagcatttttgtcagttttagcttggctgccatgtatggtattgcagtagctgctttgggcatgctcagtacaattgctactggattggccattgatgcatatggacctatcagtgacaatgctggtggaattgctgagatggctggcatgagtcacaggatccgtgaaaggactgatgcccttgatgcagctggaaacaccaccgctgctatcggcaagggttttgctattggttcagctgcgttggtatcacttgcattgtttggagcctttgtcagtcgtgctgcaattcaaactgtggatgtattgacaccaaaagtgttcattggtttaattgttggagcaatgctcccttattggttctctgccatgaccatgaaaagcgtgggtagtgcagccttgaaaatggttgaagaggttaggaggcaattcaacaccatcccaggtctgatggaaggtcatgctaagccagattatggaacttgtgtgaaaatatcaactgatgcctccctgagggagatgattcctcctggttgccttgtgatgcttacacccctcattgtcggtactttatttggagtggaaacactatcaggtgtcctcgctggtgctcttatatccggtgtgcaggttgcaatttctgcttccaacactggcggtgcttgggacaatgccaagaagtacattgaggctggtgcatcagagcatgccaggacacttggtccaaaaggttctgatccccacaaggctgctgtcattggggacaccattggagatccattgaaggacacgtctggaccatctctgaacattttgataaagcttatggctgttgagtcactggtgtttgcacccttttttgcaacccatggtgggttgctgtttaaaatttagaatctgggagctgaagctgtactagtcggcatcatttttctctttgagtatgatgagcaaagcctgtccaaaacgttatgattcttcgtagacatgggcagtgacaggctcttttcagaatgttagttttaggtataaatgcccaaaggaggttgtggttctggttactgtgattttgctacaattggttcaattttgtattgccatttttcatgaaatatgaactattttaaatttccccac

SEQ ID NO: 3751 - DNA, 2876 bp, Oryza sativa
atataataacgcgactcccgagctcacaggagagtgtgcagagcgagagacgcgtcacctcctccccgccgccgccgccgccgcctcgcctccgttgcaaccgtagtagggttagggttttcgtggtgggcgccgccgccatggcgatcctctcggcgctcgggaccgaggtgttcatccccgtcgcggccgccgtcggcgtcgcgttcgccgtcgcgcagtggctgctcgtcgcgcgggtgaaggtcaacccggcgcacgcggcggcggccgcggcgtcgggggggagcaagaacggcgggtacggggactacctcatcgaggaggaggaggggctcaacgaccacaacgtcgtcgtcaagtgccacgagatccagaccgccatctccgaaggagcaacatcatttctcttcacggagtaccaatatgttggtatcttcatgtcaatcttcgctgtcgtgatcttcctcttccttggttcagtcgagggattcagtacaaagagccagccttgcacatacagcaaggacaagtactgcaagcctgcccttttcaacgcgctctttagcactgcatctttcttgctgggagcgatcacctctttggtctctggttaccttggaatgaagatcgccacatttgccaatgccagaactaccctggaagcaaggaagggtgttgggaaggcatttatcattgctttccgctctggtgctgttatgggcttcttgctggcatcaagtggtcttgtggttctttacatcgccattaatgtatttaagttgtattatggtgatgactgggaaggtctttttgagtctatcactggttatggtcttggtggatcttccatggctctcttcggaagggttggtggaggtatttacactaaggctgctgatgtgggtgctgatcttgttggcaaggttgagaggaacatccctgaagatgatcccaggaacccagctgtgattgctgacaatgtcggtgacaatgttggtgatattgctggaatgggatcagatctctttgggtcatacgccgaatcatcctgtgctgctcttgttgttgcatctatctcatcttttggaatcaaccatgatttcactgggatgtgctacccactgcttgtcagctctgttggcatcattgtttgtttgatcaccacactctttgcaactgatttctttgagatcaaggcagtgaaagaaattgaacctgctctgaagaagcagctcatcatctccactgctttgatgactgttggtattgcaataatcagctggttggcccttccagcaaagttcaccatcttcaattttggtgctcagaaggaagttaccaactggggcttgttcttctgcgttgcaattggtctgtgggctggtctgatcattggttttgtgacagagtactacactagcaatgcatacagccctgtgcaagatgttgcagattcctgcagaactggtgctgccactaatgtcatatttggtcttgctctgggatacaaatcagttatcatcccaatttttgctattgctgtcagcatatatgttagtttctctattgctgcaatgtacggcatagccgttgccgctcttggcatgctaagcaccattgcaacaggccttgccattgatgcttatggtcctatcagtgacaatgctggtggtattgccgagatggctggtatgagccacagaatccgtgagagaactgatgcccttgatgctgctggcaacacaactgctgctattgggaagggttttgccattggatcagctgctctggtgtcccttgcactttttggtgccttcgtcagcagagctggagtgaaggttgttgatgtcctgtctccaaaggtcttcatcggtttgattgttggagccatgctcccgtactggttctctgccatgaccatgaagagtgttggaagtgccgccctcaagatggttgaggaggttcggaggcaattcaactccattcctgggctaatggagggaactggcaagcctgactatgccacctgcgtcaagatctccactgatgcttccatcaaggagatgattccccctggtgctttggtgatgctcacccccctcatcgtcggaactctctttggtgtggagaccctgtctggtgttctggctggtgctcttgtttccggagttcagatcgccatctcggcctccaacactggtggcgcatgggataacgcaaagaagtacattgaggctggtgccagtgagcatgctcggacccttggtcccaagggatcagactgccacaaggccgccgtgatcggtgacaccattggagaccccctcaaggacacatcaggcccgtcgctcaacatcctcatcaagctcatggccgtcgagtcccttgtgtttgcgcctttcttcgccacacacggtggtctgctgttcaagtggttctaagaacataataccattggcagcagcgctgaaatcttcgacggacatcacgaataacgactgccagtgtacgttgtgcttgggaatcgcccgcaccgtttctttttgggtctcatgttgtttcaggattgctgttgtcttatctttggcctcttgggagttgttaccttagccttactgttagcttcacttagaagagaccagagtccagatgttctcccatctctggtgcgtgtctggcaaattttcctcgtcccatgatgacgacgataatgtttgaactcttgaacaatgagatgatgattgttgcatgttagttactggtggtaaatctcttcatctgatcaaaatctggtttgcaataatgtactccctccgtttcatactataagactttctagcattgcccacgtacatataaatgccattttctcc

SEQ ID NO: 3752 - DNA, 2775 bp, Hordeum vulgare
tagggcacagagagagcgagagacccgtccgtcccccctcatcccaccccgcccgccgccgtccggtccgtcgttagggtttcgtcggcctgccagcctgacagccatggcgatcctcggggagctcgggacggagatcctcatccccgtctgcggggtcatcggcatcgtcttcgccgtcgcgcagtggttcatcgtctccaaggtcaaggtcaccccaggcgccgcctccgccgccgccggcgccaagaacggctacggcgactacctcatcgaggaggaggagggcctcaacgaccacaacgtcgtcgtcaagtgcgccgagatccagaccgccatctctgaaggggcaacatcattccttttcaccatgtaccagtacgttggtatgttcatggttgtctttgctgcgattatcttcctcttccttggatcgatcgagggattcagcacaaagggccagccctgcacctacagcaagggcacctgcaagccagccctatacactgctctctttagcactgcatctttcttgcttggagccatcacatctctggtgtctggtttccttggaatgaagatcgccacatatgccaatgccaggacgacccttgaagcaaggaagggtgttgggaaggcatttatcaccgctttccgctctggtgcagtcatgggcttcttgttgtcatcaagtggtcttgtggttctttacatcaccatcaacgtgtttaagatgtactacggtgatgactgggaaggtcttttcgagtccatcactggttatggtcttggtgggtcttccatggctctattcggaagagttggtggaggtatctacactaaggctgctgacgtgggtgctgaccttgttggcaaagttgagaggaacattcctgaagatgacccaaggaacccagctgtgattgctgacaacgtcggtgacaacgttggtgatattgctggaatgggatcagatctctttggttcatacgcagaatcttcctgcgctgctcttgttgttgcttccatctcatcttttggaatcaaccatgatttcactgcgatgtgctacccactgctcgtgagctctgtaggcatcattgtttgcttgctcaccacactctttgcaactgatttctttgagattaaggctgcaaacgaaattgaacctgctctgaagaagcagctcatcatctccactgctctaatgactgttggtgttgcggtcatcagctggttggctcttccagctaagttcaccatcttcaacttcggtgctcagaaggaagtgtccaactggggcctgttcttctgcgtggcagttggtctgtgggctggtctgattattggatttgtgactgaatactacactagcaacgcctacagccctgtgcaagatgttgccgattcctgcagaactggtgctgccaccaacgtcatcttcggtcttgctctggggtacaagtctgttatcatcccaattttcgctattgctgtcagcatctacgtcagcttctccattgctgcaatgtacggcattgcaatggctgctcttggcatgctaagcacaatggcaactggtcttgccatcgatgcttatggtcccattagtgacaatgctggtggaattgctgagatggctggcatgagccacagaatccgtgagaggactgatgctcttgatgctgctggcaacacaaccgctgctattgggaagggtttcgccattggatcagctgctctcgtgtccctggcacttttcggtgcctttgtcagcagagctggtgtgaaggtcgttgatgtcctatctcccaaggtgttcattggtctgattgtcggagccatgcttccgtactggttctctgccatgaccatgaagagtgttggaagtgctgccctcaagatggttgaggaggtccgcaggcagttcaacaccattcctggactgatggagggaactgccaagcctgactatgccacctgtgtcaagatctccactgatgcttccatcaaggagatgatccctccgggtgctttggtcatgctcacccccctcattgttggaaccctctttggcgtggaaaccctgtctggtgttctggctggtgccctcgtttctggagtgcagatcgccatctctgcttccaacaccggtggtgcatgggacaacgcaaagaagtacatcgaggccggcaacagcgagcatgcgaggtcccttggtcccaagggttcagactgccacaaggccgccgtgatcggtgacaccatcggagaccccctcaaggacacctcaggcccgtcgctcaacatcctcatcaagctcatggccgttgagtccctcgtgttcgcgcccttcttcgccacgtacggaggtctgctgttcaagtacatctagaggactcgtgatgagtcgagcgatgatctacagacactgtcacgaataactcccccgcctgcctgcccgccgttcgtacgttgtgcgctgctgttatttttggttgtcaatgtcattccaggattgccgcggttacctacccccctttcccctggcctcttgaaggcgttatgttagtctcaccattacattaccggcttgtagctccatgtagtagaagagagagaccagatgtcctccctcgttggtatgtgtctggcaaattttcctcgtcccatgatgacgacgataatgtttgaacccacccttgaacaatgatatcatgatgattgctgtatcactcacctgtgctaaattctcatcttagttcttgcttgttc

SEQ ID NO: 3753 - DNA, 2945 bp, Hordeum vulgare
cagagagcgagagacccgtccgtcccccctcatcccaccccgcccgccgccgtccggtccgtcgttagggtttcgtcggcctgccagcctgacagccatggcgatcctcggggagctcgggacggagatcctcatccccgtctgcggggtcatcggcatcgtcttcgccgtcgcgcagtggttcatcgtctccaaggtcaaggtcaccccaggcgccgcctccgccgccgccggcgccaagaacggctacggcgactacctcatcgaggaggaggagggcctcaacgaccacaacgtcgtcgtcaagtgcgccgagatccagaccgccatctctgaaggggcaacatcattccttttcaccatgtaccagtacgttggtatgttcatggttgtctttgctgcgattatcttcctcttccttggatcgatcgagggattcagcacaaagggccagccctgcacctacagcaagggcacctgcaagccagccctatacactgctctctttagcactgcatctttcttgcttggagccatcacatctctggtgtctggtttccttggaatgaagatcgccacatatgccaatgccaggacgacccttgaagcaaggaagggtgttgggaaggcatttatcaccgctttccgctctggtgcagtcatgggcttcttgttgtcatcaagtggtcttgtggttctttacatcaccatcaacgtgtttaagatgtactacggtgatgactgggaaggtcttttcgagtccatcactggttatggtcttggtgggtcttccatggctctattcggaagagttggtggaggtatctacactaaggctgctgacgtgggtgctgaccttgttggcaaagttgagaggaacattcctgaagatgacccaaggaacccagctgtgattgctgacaacgtcggtgacaacgttggtgatattgctggaatgggatcagatctctttggttcatacgcagaatcttcctgcgctgctcttgttgttgcttccatctcatcttttggaatcaaccatgatttcactgcgatgtgctacccactgctcgtgagctctgtaggcatcattgtttgcttgctcaccacactctttgcaactgatttctttgagattaaggctgcaaacgaaattgaacctgctctgaagaagcagctcatcatctccactgctctaatgactgttggtgttgcggtcatcagctggttggctcttccagctaagttcaccatcttcaacttcggtgctcagaaggaagtgtccaactggggcctgttcttctgcgtggcagttggtctgtgggctggtctgattattggatttgtgactgaatactacactagcaacgcctacagccctgtgcaagatgttgccgattcctgcagaactggtgctgccaccaacgtcatcttcggtcttgctctggggtacaagtctgttatcatcccaattttcgctattgctgtcagcatctacgtcagcttctccattgctgcaatgtacggcattgcaatggctgctcttggcatgctaagcacaatggcaactggtcttgccatcgatgcttatggtcccattagtgacaatgctggtggaattgctgagatggctggcatgagccacagaatccgtgagaggactgatgctcttgatgctgctggcaacacaaccgctgctattgggaagggtttcgccattggatcagctgctctcgtgtccctggcacttttcggtgcctttgtcagcagagctggtgtgaaggtcgttgatgtcctatctcccaaggtgttcattggtctgattgtcggagccatgcttccgtactggttctctgccatgaccatgaagagtgttggaagtgctgccctcaagatggttgaggaggtccgcaggcagttcaacaccattcctggactgatggagggaactgccaagcctgactatgccacctgtgtcaagatctccactgatgcttccatcaaggagatgatccctccgggtgctttggtcatgctcacccccctcattgttggaaccctctttggcgtggaaaccctgtctggtgttctggctggtgccctcgtttctggagtgcagatcgccatctctgcttccaacaccggtggtgcatgggacaacgcaaagaagtacatcgaggccggcaacagcgagcatgcgaggtcccttggtcccaagggttcagactgccacaaggccgccgtgatcggtgacaccatcggagaccccctcaaggacacctcaggcccgtcgctcaacatcctcatcaagctcatggccgttgagtccctcgtgttcgcgcccttcttcgccacgtacggaggtctgctgttcaagtacatctagaggactcgtgatgagtcgagcgatgatctacagacactgtcacgaataactcccccgcctgcctgcccgcccgccttcgtacgttgtgcgctgctgttatttttggttgtcaatgtcattccaggattgccgcggttacctacccccctttcccctggcctcttgaaggcgttatgttagtctcaccattacattaccggcttgtagctccatgtagtagaagagagagaccagatgtcctccctcgttggtatgtgtctggcaaattttcctcgtcccatgatgacgacgataatgtttgaacccacccttgaacaatgatatcatgatgattgctgtatcactcacctgtgctaaattctcatcttagttcttgcttgttcatctagtctctgtgcaccatgtagcataatttggtctgctctgcctccttcggcaccaaaacttggtctacgtacataagatcaattgttacatgtagtgcagtgcaagcaacagagctgctttgcttctatcggcacaaaatttgatctatgtaagataatcacatgagaatgat

SEQ ID NO: 3754 - DNA, 2742 bp, Abies balsamea
gaacatttggttcattgtaactttctctttcctggggatttctccccgttatattcttctcctagcaacgcttcagcttcggccgcccggcgatttcttttagttaggtctcctgatctcgttctatgttcgaggaaccatcgtttacgccattaaaggaccccctgacctctagggaagaataataactgagattcagttctctgtgtttttgttgaatccttggttaggtctctctgacaatgggggccactatgctctctgaaaccctgacggaggtcttgatcccggtggccgctgtcgtgggtatcgtgttcgctctggttcagtggtatctggtgtcccgcgttaaggtagtgcctgaccagtcacacgcctctaacgataataacaagaatggctactccgagtacttgatcgaagaagaggaggggattaacgatcaaaatgtcgtcactaaatgcgcagagatccagaacgccatctctgaaggagcaaactcatttttgttcaccgagtatcagtacatgggtgtttttatggtctgctttgcactcctcatctttttattccttggttcagtggagaaattcagtacatcaagtcagccttgcatgtacaacaaagaagtgatgtgcaagccagcacttgctaatgccattttcagcacaatatctttcctgcttggttctttgacatctatcttttctggctaccttggaatgaaaattgcaacttatgcaaatgcaagaacaacactagaagccaggaagggtgttggtaaagctttcattactgccttccgatctggtgctgttatgggctttctgcttgctgcaaatgggctgttggtgctttatgctaccattaatctgttcaggttgtactatggaaatgactgggagggtctttttgaagccatcaccggatatgggcttggaggctcttccatggctctgtttggcagagtaggtggtggtatttacaccaaagcagctgatgtaggtgcagatcttgttggcaaggttgagaggaacattcctgaagatgatccacgcaacccagctgtcattgctgataatgttggtgacaatgttggagatattgctggtatgggatcagatctctttgggtcctatgctgaatcttcctgtgcagctctggttgttgcatccatatcatcatttggaaacactcacgattttactgccatgtgctaccccttgctcattagttcgatgggtatcattgcttgcttactcacaactctgtttgcaactgacatatttgagatcaaggctgtcaaggaaattgagcctgcattgaaaaagcagcttattatctccacagtatttatgactgttggcattgctgttgtaagttttgttgcattgccttcatccttcaccatcttcaattttggtgcccagaaggttgtaaagaactgggagcttttcttctgtgttgctattggtttgtgggctggccttgttattggttttgtcacagagtactacacaagtaatgcttacagccctgtccaagatgttgctgattcatgcagaacgggagcagcaactaatgttatatttgggttggctctgggatacaaatctgttattattcccatatttgctattgcagtaagcatttttgtcagttttagtttggctgccatgtatggtattgcagtagctgctttgggcatgctcagtacaattgcaaccggattagccattgatgcatatggacctatcagtgacaatgctggtggaattgctgagatggctggcatgagtcacagaatccgtgaaaggactgatgcccttgatgcagctggaaacactactgctgccattggcaagggttttgctattggttcagctgcactggtatcacttgcattgtttggagcctttgtcagccgtgctgcaattcaaactgtggatgtcttgactccaaaggtcttcattggtttaattgttggggcaatgcttccttattggttctctgccatgacaatgaaaagtgtgggtagtgcagccttgaaaatggttgaagaggttaggaggcaattcaacaccatcccaggcctgattgaaggtcatgctaagccagattatggaacttgtgtgaagatatccactgatgcctcccttagggagatgattcctcccggttgccttgtgatgcttacacctctcattgttggtactttatttggagttgaaacactatcaggtgtcctcgctggtgctcttgtctctggcgtgcaggttgcaatttctgcttccaacactggcggtgcttgggacaatgctaagaagtacatcgaggctggtgcatcagatcatgctaggtcacttggtccgaaagggtctgatcctcacaaggctgctgtcattggtgacaccattggagacccattgaaggacacctctggaccatcactgaacattttgataaagcttatggctgtcgagtcactggtgtttgcacccttttttgcaacccatggtgggttgctgtttaaactttagaatctaggatccaaaatccttctcaagctgtacttgtcggcatcatttttctctgagtttgacaagcaaagcctgtccaaaacgttaaaattcttggtggacatgggcagtggcaggttcatttcaaaatgttagttttctagataaatgcccaaaggaggtcgtgattctggttactgtgatgttgctactattggttcaa

SEQ ID NO: 3755 - DNA, 2708 bp, Triticum aestivum
ccacgcgtccggacccgttcccccctcaccccccgccgcctcgtccgtaccgtccgttcggtccgttagggtttcgtcagccatggcgatcctcggggagctcgggaccgagatcctcatccccgtctgcggggtcgtcggcatcgtcttcgccgtcgcgcagtggttcatcgtctccaaggtcaaggtcacccccggcgccgcctccgccgccgccggtagcaagaacggctacggcgactacctcatcgaggaggaggagggcctcaacgaccacaacgtcgtcgtcaagtgcgccgagatccagaccgccatctcagaaggagcaacatcgtttcttttcaccatgtaccagtatgttggtatgttcatggtcgtctttgctgcgataatcttcctcttccttgggtcgattgagggattcagcaccaagggccagccctgcacctacagcacgggcacctgcaagccagctctctacaccgccctcttcagcactgcatctttcttgcttggagccatcacatctttggtgtctggtttccttggaatgaagatcgccacatatgccaatgccaggacgaccctggaagcaaggaagggtgttgggaaggcattcatcaccgctttccgctctggtgcagtcatgggcttcttgttgtcatcaagtgggcttgtggttctttacatcaccatcaacgtgtttaagatgtactacggtgatgactgggaaggtctttttgagtccatcactggttatggtcttggtgggtcttccatggctctgttcggaagagttggtggaggtatctacaccaaggctgctgacgtgggtgctgatcttgttggcaaagttgagaggaacattcctgaggatgacccaaggaacccagctgtgattgctgacaacgttggtgacaatgttggtgatattgctggaatgggatcagatctctttggttcatacgcagaatcttcctgcgctgctcttgttgttgcttctatctcatcttttggaatcaaccatgatttcactgcgatgtgctatccactgctcgtgagctctgtcggcatcattgtttgcttgctcaccacactctttgcaactgatttctttgagatcaaggctgcaagcgaaattgaacctgctctgaagaagcagctcatcatctccactgctttgatgactatcggtgttgcggtaatcagctggttggctctcccagctaagttcaccatcttcaacttcggtgctcagaaggatgtgtccaactggggcctgttcttctgtgtggcagttggtctgtgggctggtctgattattgggtttgtgaccgagtctacactagcaatgcctacagccctgtgcaagatgttgccgattcctgcagaactggtgctgccaccaacgtcatcttcggtcttgccctgggttacaagtcagtcatcatcccaattttcgctattgctgtcagcatctacgtcagcttctctattgctgcaatgtacggcattgcaatggctgctcttggcatgcttagcacaatggcaactggtcttgctatcgatgcttatggtcccattagtgacaatgctggtggaattgctgagatggctggcatgagccacagaatccgtgagaggactgatgctcttgatgctgctggcaacacaaccgctgctattggaaagggttttgccattggatcagctgctcttgtgtccctggcacttttcggtgcctttgtcagcagagctggtgtgaaggtcgttgatgtcctatctcccaaggtgttcattggcctgattgtcggagccatgcttccgtactggttctctgccatgaccatgaagagtgttggaagtgctgctctcaagatggttgaggaggtccgcaggcagttcaacaccattcctggactgatggagggaactgccaagcccgactatgccacctgtgtcaagatctccactgatgcttccatcaaggagatgatccctccgggtgctttggtcatgctcacccccctcattgtcggaaccctcttcggcgtggaaaccctgtctggtgttctggctggtgcccttgtttctggagtacagatcgccatctctgcttccaacaccggcggtgcatgggacaacgcaaagaagtacattgaggccggcaacagcgagcacgcgaggtcccttggccccaagggttcagactgccacaaggccgctgtgatcggcgacaccatcggagaccccctcaaggacacctcaggcccgtcgctcaacatcctcatcaagctcatggccgtcgagtccctcgtgttcgcgccctttttcgccacgtacggaggtgtgctgttcaagtacatctagaagactcgttgagcggacttagaatctacggacaccatcaccatcacgaataactctgccccgcccgcccgccgttcgtatgttgtgcgctgctgttatttttggttctcgtgtcattattccaggattgccgcagtttaccccccactttccctttggcctcttgggtgtgttacgttagtctcaccattaccggcttgtagctctatgtagtagaagagagagaccggatgtcctcggtcattattggtatgtgtctggcaaattttcctcgtcccatgatgacgacgataatgtttgaacccttgaacgatgatatcatgacgattgttgcatca

SEQ ID NO: 3756 - DNA, 2698 bp, Triticum aestivum
ccgtccgttcggtccgttaaggtttcggccgtccccatggcgatcctcggggagctcgggaccgagatcctcatccccgtctgcggggtcgtcggcatcgtcttcgccgtcgcgcagtggttcatcgtctccaaggtcaaggtcacccccggcgccgcctccgccgccggcggcggcaagaacggctacggcgactacctcatcgaggaggaggagggcctcaacgaccacaacgtcgtcgtcaagtgcgccgagatccagaccgccatctctgaaggagcaacctcatttcttttcaccatgtaccagtatgttggtatgttcatggtcgtctttgctgcggttatcttcgtcttccttgggtcgattgagggattcagcacaaagggccagccctgcacctacagcacgggcacctgcaagccagctctctacaccgctctcttcagcactgcgtctttcttgcttggagccatcacatctctggtgtctggtttccttgggatgaagatcgccacatacgccaatgccaggacgaccctggaagcaaggaaaggtgttgggaaggcatttatcaccgctttccgctctggtgcagtcatgggcttcttgttgtcatcaagtgggcttggggttctttacatcaccatcaacgtgttcaagatgtactacggtgatgactgggaaggtctttttgagtccatcactggttatggtctcggtgggtcttccatggctctattcggaagagttggtggaggtatctacaccaaggctgctgacgtgggtgctgaccttgttggcaaagttgagaggaacattcctgaagatgacccaaggaacccagctgtgattgctgacaacgtcggtgacaatgttggtgatattgctgggatgggatcagatctctttggttcatacgcagaatcgtcctgcgctgctcttgttgttgcttctatctcatcttttggaatcaaccatgatttcactgcgatgtgctacccactgctcgtgagctctgttggcatcattgtttgcttgctcaccaccctgtttgcgactgatttctttgagatcaaggctgcaagcgaaattgaacctgctctgaagaagcagctcatcatctccactgctttaatgactatcggtgttgcggtgatcagctggttggctctcccagctaagttcaccatcttcaacttcggtgctcagaaggacgtgtccaactggggcctgttcttctgtgtggcagttggtctgtgggctggtctgattattgggtttgtgaccgaatactacactagcaatgcctacagccctgtgcaagatgttgccgattcctgcagaactggtgctgccaccaacgtcatcttcggtcttgcccttggttacaagtcagtcatcatcccaattttcgctattgctgtcagcatctacgtcagcttctctattgctgcaatgtacggcattgcaatggctgctcttggcatgcttagcacaatggcaactggtcttgctatcgatgcttatggtcccattagtgacaatgctggtggaattgctgagatggctggcatgagccacagaatccgtgagaggactgatgctcttgatgctgctggcaacacaaccgctgctattggaaagggtttcgccattggatcagctgctcttgtgtccctggcacttttcggtgcctttgtcagcagagctggtgtgaaggtcgttgatgtcctatctcccaaggtgttcattggcctgattgtcggagccatgcttccgtactggttctctgccatgaccatgaagagtgttggaagtgctgctctcaagatggttgaggaggtccgcaggcagttcaataccatccctggactgatggagggaactgccaagcccgactatgccacctgtgtcaagatctccactgatgcttccatcagggagatgattcctccgggtgctttggtcatgctcacccccctcattgtcggaaccctcttcggcgtggaaaccctgtctggtgttcttgctggtgcccttgtttctggagtacagatcgccatctctgcttccaacaccggcggtgcatgggacaacgcaaagaagtacattgaggccggcaacagcgagcacgcgaggtcccttggccccaagggttcagactgccacaaggcggccgtgatcggcgacaccatcggagaccccctcaaggacacctcaggcccgtcgctcaacatcctcatcaagctgatggccgtcgagtccctcgtgttcgcgcccttcttcgccacgtacggaggtgtgctgttcaagtacatctagaagactcgtcgagcggacttagaatctacggacaccatcacgaataactctgccccgcccgcccgccgttcgtatgttgtgcgctgctgttatttttggttcttgtgtcattattccaggattgccgcagtttacccccactttccctttggcctcttgggtgtgttacgttagtctcaccattaccggcttgtagctccatgtagtagaagagagagaccagatgtcctcggtcattattggtatgtgtctggcaaattttcctcgtcccgtgatgacgacgataatgtttgaacccttgaacaatgatatcatgacgattgttgcatcataaaaaaaaaaaaaaagcccacctgcccgggcggccgctcga

SEQ ID NO: 3757 - DNA, 2705 bp, Triticum aestivum
cctcacccgccgccgccccgtgcgtcccgtccgttcggtccgttagggcttcggccgtccgccatggcgatcctcggggagctcgggaccgagatcctcatccccgtctgcggggtcgtcggcatcgtcttcgccgtcgcgcagtggttcatcgtctccaaggtcaaggtcacccccggcgccgcctccgccgccggcggcggcaagaacggctacggcgactacctcatcgaggaggaggagggcctcaacgaccacaacgtcgtcgtcaagtgcgccgagatccagaccgccatctctgaaggagcaacctcatttcttttcaccatgtaccagtatgttggtatgttcatggtcgtctttgctgcggttatcttcgtcttccttgggtcgattgagggattcagcacaaagggccagccctgcacctacagcacgggcacctgcaagccagctctctacaccgctctcttcagcactgcgtctttcttgcttggagccatcacatctctggtgtctggtttccttgggatgaagatcgccacatacgccaatgccaggacgaccctggaagcaaggaagggtgttgggaaggcatttatcaccgctttccgctctggtgcagtcatgggcttcttgttgtcatcaagtgggcttgtggttctttacatcaccatcaacgtgttcaagatgtactacggtgatgactgggaaggtctttttgagtccatcactggttatggtctcggtgggtcttccatggctctattcggaagagttggtggaggtatctacaccaaggctgctgacgtgggtgctgaccttgttggcaaagttgagaggaacattcctgaagatgacccaaggaacccagctgtgattgctgacaacgtcggtgacaatgttggtgatattgctgggatgggatcagatctctttggttcatacgcagaatcgtcctgcgctgctcttgttgttgcttctatctcatcttttggaatcaaccatgatttcactgcgatgtgctacccactgctcgtgagctctgttggcatcattgtttgcttgctcaccaccctgtttgcgactgatttctttgagatcaaggctgcaagcgaaattgaacctgctctgaagaagcagctcatcatctccactgctttaatgactatcggtgttgcggtgatcagctggttggctctcccagctaagttcaccatcttcaacttcggtgctcagaaggacgtgtccaactggggcctgttcttctgtgtggcagttggtctgtgggctggtctgattattgggtttgtgaccgaatactacactagcaatgcctacagccctgtgcaagatgttgccgattcctgcagaactggtgctgccaccaacgtcatcttcggtcttgcccttggttacaagtcagtcatcatcccaattttcgctattgctgtcagcatctacgtcagcttctctattgctgcaatgtacggcattgcaatggctgctcttggcatgcttagcacaatggcaactggtcttgctatcgatgcttatggtcccattagtgacaatgctggtggaattgctgagatggctggcatgagccacagaatccgtgagaggactgatgctcttgatgctgctggcaacacaaccgctgctattggaaagggtttcgccattggatcagctgctcttgtgtccctggcacttttcggtgcctttgtcagcagagctggtgtgaaggtcgttgatgtcctatctcccaaggtgttcattggcctgattgtcggagccatgcttccgtactggttctctgccatgaccatgaagagtgttggaagtgctgctctcaagatggttgaggaggtccgcaggcagttcaataccatccctggactgatggagggaactgccaagcccgactatgccacctgtgtcaagatctccactgatgcttccatcagggagatgattcctccgggtgctttggtcatgctcacccccctcattgtcggaaccctcttcggcgtggaaaccctgtctggtgttcttgctggtgcccttgtttctggagtacagatcgccatctctgcttccaacaccggcggtgcatgggacaacgcaaagaagtacattgaggccggcaacagcgagcacgcgaggtcccttggccccaagggttcagactgccacaaggcggccgtgatcggcgacaccatcggagaccccctcaaggacacctcaggcccgtcgctcaacatcctcatcaagctgatggccgtcgagtccctcgtgttcgcgcccttcttcgccacgtacggaggtgtgctgttcaagtacatctagaagactcgtcgagcggacttagaatctacggacaccatcacgaataactctgccccgcccgcccgccgttcgtatgttgtgcgctgctgttatttttggttcttgtgtcattattccaggattgccgcagtttacccccactttccctttggcctcttgggtgtgttacgttagtctcaccattaccggcttgtagctccatgtagtagaagagagagaccagatgtcctcggtcattattggtatgtgtctggcaaattttcctcgtcccgtgatgacgacgataatgtttgaacccttgaacaatgatatcatgacgattgttgcatcatctcacctatgccgagtcttta

SEQ ID NO: 3758 - DNA, 2598 bp, Fragaria vesca
cctatctcttcgctacttcactctctccagcctcctcctcgtgttttcaatttttgaattctccggcgtacggattccggcgaggatggcggtgctgctctcgtaccttgccacggagattgtgattcccgtctgcgccgtggtcgggatcttgttctcgctgttgcagtggtacttggtgtcgcgcgtgagagtgacgcccgaccgtaacgctcccgccccaggaaccaacgcaaagaagaacggcttcaatgactacctcattgaggaggaggaaggcgtcaccgaccaaaacgtcgtcgctaagtgcgccgagattcagaatgctatctccgaaggggccacatccttccttttcaccgaataccagtatgttggggtcttcatggttgtttttgcagtcttgatcttcctcttcctcggatctgtgaagggcttcagcacagagagccagccatgcacttatgatgtgacaagcacctgcaagccagcacttgccactgcactcttcagtactgttgcattcttacttggtggtatcacctcactcctgtctggttttcttggtatgaaaatcgccacttatgccaatgccaggacaacattggaagcaagaaaaggtgtggggaaggcctttatcgtggcctttaggtctggtgcagtcatgggttttctccttgcagccaatggtcttttggtactttacattaccatcaatctctttcagctgtactatggtgatgactgggaaggcctttttgaggcaattactggctatggtcttggtggatcagcaatggctctttttgggagagtaggtggtggtatctataccaaggctgctgatgtcggtgctgaccttgttggaaaaattgaaagaaacattcctgaagatgacccgagaaacccagctgtgattgctgacaatgttggtgataatgttggggatattgctggtatgggatctgatctttttggctcctatgctgaatcatcttgtgctgcgctagttgttgcttccatttcctcatttggaatcaaccatgagttcactgccatgctgtatccccttcttgtcagttctatgggcattcttatttgtttaatcacaaccttgtttgccactgatttctttgagatcaaggctgtcaaggacattgaaccagctttgaaaaatcagcttattatctccactgttcttatgactattggaattgcaattgttagctgggttgctctgccatcatctttcacaatttacaactttggagttcagaaagttgtaaagaactggcaattgttcttgtgtgtatctgttggtctttgggccggacttatcattggatttgtcactgagtattatactagcaatgcatatagccctgtgcaagatgttgctgattcctgtaggactggtgctgccaccaatgttatctttgggcttgctctgggatacaaatcagtcatcattccaattttcgccatcgcagtcagcatttttgttagttttagtttcgctgctatgtatggcattgcagtggctgctcttgggatgctgagcaccatcgctacagggttggcaattgatgcctacgggcccatcagtgacaatgctggaggcattgctgagatggctggcatgagccatcgtattcgtgagagaaccgatgctcttgatgccgctgggaataccactgctgcaattggaaagggatttgctattggatctgctgctctagtttctttggctctatttggtgcctttgtcagtcgtgcagcgatttcaacagttgatgtcctaaccccaaaggtctttatcggactgatcgtgggtgcaatgcttccttactggttctctgccatgaccatgaagagtgtgggaagtgcagctttgaaaatggttgaggaagttcgcaggcagttcaataccatcccaggactcatggagggtcttgccaagcccgactatgctacctgtgtcaagatctccactgatgcatccatcaaggagatgattccacctggtgcccttgtcatccttacacctctcattgtcggaacattgttcggtgtggagaccctctctggtgtccttgctggttcccttgtttctggtgtgcaggtagcaatatctgcctctaacactggtggtgcatgggacaatgccaagaagtacattgaggctggtgcttcggagcatgcaaggactcttggcccaaaggggtctgacccccacaaggctgcagtcatcggtgacaccattggagatccactgaaggacacttcaggcccatcactcaacatcctcattaagctcatggctgttgagtcccttgtgtttgctcccttctttgccactcatggtggcctgctctttaagatcttttaaaggaaaggaggctatgccactttcacaagtattgggcaaagtggtctatatttctttttgttctatttttgttcggcaaggcagagtttatcaacatttcttctgttgtaccagtatctctatcctccccctcctagttagtatttcaatttgatatgaactctgagaatcaatgatgaaaattagttttctcgaaatgaattttctcc

SEQ ID NO: 3759 - DNA, 2698 bp, Triticum aestivum
cccgtcccacccctcacccgccgccgtcccgtccgttcggtccgttagggtttcgtcggccatggcgatcctcggggagctcggcaccgagatcctcatccccgtctgcggggtcgtcggcatcgtcttcgccatcgcgcagtggttcatcgtctccaaggtcaaggtcacccccggcgccgccgccgccggcggctccaagaacggctacggcgactacctcatcgaggaggaggagggcctcaacgaccacaacgtcgtcgtcaagtgcgccgagatccagaccgccatctcagaaggagcaacatcattccttttcaccatgtaccagtatgttggtatgttcatggtcgtctttgctgcggttatcttcgtcttccttgggtcaattgagggattcagcacaaagggccagccctgcacctacagcacgggcacctgcaagccagctctctacaccgccctcttcagcactgcatctttcttgcttggagccatcacatctttggtgtctggtttccttgggatgaagatcgccacatacgccaatgctaggacgaccctggaggcaaggaagggtgttgggaaggcatttatcactgctttccgctctggtgcagtcatgggcttcttgttgtcatcaagtgggcttgtggttctttacatcaccatcaacgtgttcaagatgtactacggtgatgactgggaaggtctttttgagtccatcactggttatggtcttggtgggtcttccatggctctattcggaagagttggtggaggtatctacaccaaggctgctgacgtgggtgctgatcttgttggcaaagttgaaaggaacattcctgaagatgacccaaggaacccagctgtgattgctgacaatgtcggtgacaatgttggtgatattgctggaatgggatcagatctctttggttcatacgcagaatcttcctgtgctgctcttgttgttgcttctatctcatcttttggaatcaaccatgatttcactgcgatgtgctacccactgctcgtgagctctgtcggcatcattgtttgcttgctcaccacgctctttgcaactgatttcttcgagatcaaggctgcaagcgaaattgaacctgctctgaagaagcagctcatcatctccactgctttaatgaccatcggtgttgcggtaatcagctggttggctcttccagctaagttcaccatcttcaacttcggtgctcagaaggacgtgtccaactggggcctgttcttctgcgtggcagttggtctgtgggctggtctgattattgggtttgtgaccgagtactacactagcaatgcctacagccctgtgcaagatgttgccgattcctgcagaactggtgctgccaccaacgtcatcttcggtcttgccctgggttacaagtccgtcatcatcccaattttcgctattgctgtcagcatctacgtcagcttctctattgctgcgatgtacggcattgcaatggctgctcttggcatgcttagcacaatggcaactggtcttgcgatcgatgcttatggtcccattagtgacaatgctggtggaattgctgagatggctggcatgagccacagaatccgtgagaggactgatgctcttgatgctgctggcaacacaaccgctgctattggaaagggtttcgccattggatcagctgctcttgtgtccctggcacttttcggtgcttttgtcagcagagccggcgtgaaggtcgtcgatgtcctatctcccaaggtgttcattggcctgattgttggagccatgcttccgtactggttctctgccatgaccatgaagagtgttggaagtgctgctctcaagatggttgaggaggtccgcaggcagttcaacaccatccccggactgatggagggaactgccaagcccgactatgccacctgtgtcaagatctccactgatgcttccatcaaggagatgatccctccgggtgctttggtcatgctcacccccctcattgtcggaaccctcttcggcgtggaaaccctgtctggtgttctggctggtgcccttgtttctggagtgcagatcgccatctctgcttccaacaccggcggtgcatgggacaacgcaaagaagtacattgaggctggcaacagcgagcacgcgaggtcccttggccccaagggttcagactgccacaaggcggccgtgatcggcgacaccatcggagaccccctcaaggacacctcaggcccgtcgctcaacatcctcatcaagctcatggccgtcgagtccctcgtgtttgcgcccttcttcgccacgtacggaggcgtgctgttcaggtacatctagaagactcacgacgagtcgagcggacttcgaatctacggacagcatcacgaataacttccccgccccgcccgtcgtccaccgttcgtatgttgtgcgctgctgttatttttggttcttgtgtcattattccaggattgccgcagtttaccccccactttccctttggcctcttgggtgtgttacgttagtctcaccattacctaccggcttgtagctccatgtagtagaagagagagaccagatgtcctcggtcattattggtatgtgtctggcaaattttcctcgtcccatgatgacgacgataatgtttgaacccttgaacgatgatatcatgacgattgttgcatcaaa

SEQ ID NO: 3760 - DNA, 2859 bp, Oryza sativa
atagaattgcaaaacaacccacgcactccctctccgctgctcgtcttctacctctcgcccaaaccaggcagctccacctccacccacccagctatataagagacctcacctccaagaatctccagagagagaaagaggagagagagagtacagcggtatagagagagagacacagagagagagagagagagagcagcagcaggtagcaggtcgaggagggtttgtggccatggcgatcctgtcggatgtggccaccgaggtgctgatcccgatcgccgccatcatcgggatcgggttctccatcgcgcagtgggtgctggtcgcccgggtcaagctggcgccgtcgcagccgggagcgtcgaggagcaaggacgggtacggcgactcgctgatcgaggaggaggaagggctcaacgaccacaacgtcgtcgccaagtgcgccgagatacagaacgccatcgctgaaggagcaacatcgttccttttcaccgaataccaatacgttggcgttttcatgtcgatattcgcggtggtgatcttcctcttcctcggctccgtcgagggattcagcacaaagacccacccctgcacatacagcaaggacaaggagtgtaagcctgctctgttcaatgccctgttcagcaccgtctccttcctgcttggagccatcacctcagtggtttctggcttcctcgggatgaagattgcgacttacgcaaatgcgcggaccaccctggaggcgaggaagggtgttggcaaggccttcatcaccgcgttccgttcgggagcggtgatgggattcttgctggcatcaaatgggcttctggtgctttacattgccataaacttgttcaagatgtactatggcgatgattgggagggtctctttgagtccatcactggctatggccttggtggatcctcaatggctctgtttggaagggtgggtggaggtatctacaccaaggcggctgacgtcggtgctgatcttgttggcaaagttgaaaggaacatccctgaagatgatcctcggaaccctgctgtgattgctgacaatgttggagacaacgttggtgatattgctggaatgggatcagatctgttcgggtcgtacgctgaatcttcctgtgctgcccttgttgttgcttccatttcttcctttgggatcaaccatgatttcactgggatgtgctacccgctgctggtcagctccatgggcatcattgtctgcttgatcaccactctctttgccactgacttcttcgagatcaaggccgtgaaagaaatcgaaccgtcactaaagaagcagctcatcatttctacggctctgatgactgttggtattgcactggtcagttggttggcgctcccatacaaattcaccatcttcaattttggtgaacagaaggaagtcactaactgggggttgttcttgtgtgtttcgatcggtctatgggctggtctgatcatcggatacgtgacagagtactacactagcaatgcatacagccctgttcaggatgtcgcagatgcttgcagaactggtgctgccaccaatgtcatatttgggcttgctctaggatacaagtctgttattatcccaattttcgctatcgcgcttggtatctacgtcagcttcaccattgctgcgatgtacggcatagcagtggctgcccttggcatgctgagcacaattgccactggactgtccattgatgcttatggtccgatcagcgacaacgccggtggtattgctgagatggcagggatgagccacagaatccgcgagagaaccgacgctcttgacgctgctggaaacacaaccgctgctattggaaagggttttgccattgggtcagcagcactggtgtcccttgcactgttcggcgccttcgtcagcagagccggggtgaaggtggtcgacgtcctgtcccccaaggtgatcatcggattgatcgtcggagcaatgctcccgtactggttctccgccatgacgatgaagagcgtcggcagcgcggcgctgaagatggtggaggaggtccggcggcagttcaacaccatccccgggctgatggagggcacaggcaagccggactacgccaactgcgtcaagatctccaccgacgcctccatcaagcagatgatccctcccggcgccctcgtcatgctcacgccgctcatcgtcggcaccctcttcggcgtccagaccctctccggcgtcctcgccggcgccctcgtctccggcgtacaggtcgccatctctgcgtcgaacaccggtggcgcatgggacaacgcaaagaaatacatcgaggctggggcgagtgagcacgcgaggtcgctggggcccaagggatcggactgccacaaggcggcggtgatcggcgacaccattggcgacccgctcaaggacacgtcgggcccgtcgctgaacatcctcatcaagctcatggccgtcgagtcgctggtgttcgcgccattcttcgccacgcacggaggaattctattcaagctcttctaggagagagagatttaaaattcgatcgaatttgaggacggacggagattttcgaataataactagaccacgggatcatgtgggctgaaaaaaaggaacctctgcaaataatgttgctttggtggtagtgggacactatctctacgatttaattttgtctcatgtaggttttgtaatttgtttttaacttgctgcgtcgttttcagtttctgtctgcctgagccctgaggcatcgtgaacttcttttagctgatgtacggcttgtataaagtgaccagatggttttcatctgcagtttatgtgcatatttttgtcatcttaacattgtcgcgcacgatgataga

SEQ ID NO: 3761 - DNA, 2710 bp, Triticum aestivum
ccgtccgttcggtccgttagggtttcgtcggccatggcgatcctcggggagctcggcaccgagatcctcatccccgtctgcggggtcgtcggcatcgtcttcgccatcgcgcagtggttcatcgtctccaaggtcaaggtcacccccggcgccgccgccgccggcggctccaagaacggctacggcgactacctcatcgaggaggaggagggcctcaacgaccacaacgtcgtcgtcaagtgcgccgagatccagaccgccatctcagaaggagcaacatcattccttttcaccatgtaccagtatgttggtatgttcatggtcgtctttgctgcggttatcttcgtcttccttgggtcaattgagggattcagcacaaagggccagccctgcacctacagcacgggcacctgcaagccagctctctacaccgccctcttcagcactgcatctttcttgcttggagccatcacatctttggtgtctggtttccttgggatgaagatcgccacatacgccaatgctaggacgaccctggaggcaaggaagggtgttgggaaggcatttatcactgctttccgctctggtgcagtcatgggcttcttgttgtcatcaagtgggcttgtggttctttacatcaccatcaacgggttcaagaagtactacggtgatgactgggaaggtctttttgagtccatcactggttatggtcttggtgggtcttccatggctctattcggaagagttggtggaggtatctacaccaaggctgctgacgtgggtgctgatcttgttggcaaagttgaaaggaacattcctgaagatgacccaaggaacccagctgtgattgctgacaatgtcggtgacaatgttggtgatattgctggaatgggatcagatctctttggttcatacgcagaatcttcctgtgctgctcttattgttgcttctatctcatcttttggaatcaaccatgatttcactgcgatgtgctacccactgctcgtgagctctgtcggcatcattgtttgcttgctcaccacgctctttgcaactgatttcttcgagatcaaggctgcaagcgaaattgaacctgctctgaagaagcagctcatcatctccactgctttaatgaccatcggtgttgcggtaatcagctggttggctcttccagctaagttcaccatcttcaacttcggtgctcagaaggacgtgtccaactggggcctgttcttctgcgtggcagttggtctgtgggctggtctgattattgggtttgtgaccgagtactacactagcaatgcctacagccctgtgcaagatgttgccgattcctgcagaactggtgctgccaccaacgtcatcttcggtcttgccctgggttacaagtccgtcatcatcccaattttcgctattgctgtcagcatctacgtcagcttctctattgctgcgatgtacggcattgcaatggctgctcttggcatgcttagcacaatggcaactggtcttgcgatcgatgcttatggtcccattagtgacaatgctggtggaattgctgagatggctggcatgagccacagaatccgtgagaggactgatgctcttgatgctgctggcaacacaaccgctgctattggaaagggtttcgccattggatcagctgctcttgtgtccctggcacttttcggtgcttttgtcagcagagccggcgtgaaggtcgtcgatgtcctatctcccaaggtgttcattggcctgattgttggagccatgcttccgtactggttctctgccatgaccatgaagagtgttggaagtgctgctctcaagatggttgaggaggtccgcaggcagttcaacaccatccccggactgatggagggaactgccaagcccgactatgccacctgtgtcaagatctccactgatgcttccatcaaggagatgatccctccgggtgctttggtcatgctcacccccctcattgtcggaaccctcttcggcgtggaaaccctgtctggtgttctggctggtgcccttgtttctggagtgcagatcgccatctctgcttccaacaccggcggtgcatgggacaacgcaaagaagtacattgaggctggcaacagcgagcacgcgaggtcccttggccccaagggttcagactgccacaaggcggccgtgatcggcgacaccatcggagaccccctcaaggacacctcaggcccgtcgctcaacatcctcatcaagctcatggccgtcgagtccctcgtgtttgcgcccttcttcgccacgtacggaggcgtgctgttcaggtacatctagaagactcacgacgagtcgagcggacttcgaatctacggacagcatcacgaataacttccccgccccgcccgtcgtccaccgttcgtatgttgtgcgctgctgttatttttggttcttgtgtcattattccaggattgccgcagtttaccccccactttccctttggcctcttgggtgtgttacgttagtctcaccattacctaccggcttgtagctccatgtagtagaagagagagaccagatgtcctcggtcattattggtatgtgtctggcaaattttcctcgtcccatgatgacgacgataatgtttgaacccttgaacgatgatatcatgacgattgttgcatcatcaaaaaaaaaaaaaagcccacctgcccgggcggccgctcga

SEQ ID NO: 3762 - DNA, 2647 bp, Avena sativa
gccgccgccttcccctcgcgtccgtccgttctagggtttcccatggcgatcctcggggagctcggcacccaggtgctcatccccgtcgccggcgtcatcggcatcgtcttcgccgtcgcgcagtgggtcatcgtatccaaggtcaaggtcacgccgggcgccgccaacgcctcgggggcaggcaagaacggctacggggactacctcatcgaggaggaggagggactcaacgaccacaacgtcgtcgtcaagtgcgccgagatccagaccgcaatctccgaaggagcaacatcattccttttcaccatgtaccagtatgttggattcttcatggttatatttgctggcttgatctttgtcttcctcggatcgatcgagggattcagcacaaagggccagccctgcacctatagccagggaaagacctgcaagccagctctttacactgctctctttagcactgctgctttcttgcttggagccatcacatctctggtgtctggtttccttggaatgaagatcgccacatatgccaatgccagaacgaccctggaagcaaggaagggtgttggaaaggcatttatcactgctttccgctctggtgcagttatgggcttcttgttgtcatcaagtggtcttgtggttctttacattaccatcaacgtattcaagctgtactatggtgatgactgggagggtctttttgagtctatcactgggtatggacttggtggctcttccatggctctgtttggaagagttggtggaggtatttacacaaaggctgctgatgtgggtgctgatcttgttggcaaagttgaaaggaacattcctgaagatgatcccaggaacccggctgtgattgctgacaatgttggtgacaatgttggcgatattgctggaatgggatcagatctctttggttcgtacgcagaatcttcctgcgctgctcttgttgttgcatctatctcatcttttggaatcaaccatgatttcactgcgatgtgctacccactgcttgtgagctctgttggcatcattgtctgcttgcttaccacactctttgcaactgatttctttgagataaaggctgcaaatgaaattgaacctgctctaaagaagcagctcatcatctccactgctttgatgactgttggtgttgcgataatcagctggttggcccttccagctagttcaccatcttcaatttcggtgctcagaaggaagttgccaactggggcttgttcttctgtgtgggaattggactctgggctggtctcattattgggtttgtgacagaatactacacgagcaatgcctacagccctgtgcaagatgttgcagattcctgcagaactggtgctgccactaatgtcattttcgggcttgctctgggttacaagtcagttatcatcccaattttcgctattgctgtcagcatttatgtcagcttctctattgctgccatgtacggcattgcaatggctgctcttggcatgctaagcacaatggcaactggtcttgccatcgatgcttatggccccattagtgacaatgctggtggaattgctgagatggctggcatgagccacagaatccgtgagaggactgatgctcttgatgctgctggcaacacaaccgctgctattgggaagggttttgctattggatcagctgctctggtgtccctggccctttttggcgcttttgtcagcagagccggtgtgcaggtcgttgatgtcctttctccaaaggtgttcattggcttgcttgttggagccatgcttccctactggttctctgccatgaccatgaagagtgttggaagtgctgctctcaagatggttgaggaggttcgcaggcagttcaacaccattcctggactgatggagggtactgccaagcctgactatgccacctgtgtcaagatctccactgatgcttctatcaaggagatgatccctcctggtgctttggtgatgctcacaccactcattgttggaaccctctttggtgtggaaactctctctggtgttctggctggtgctcttgtttctggagtacagattgccatctccgcttccaacaccggtggtgcatgggacaacgcaaagaagtacattgaggctggcaacagtgatcacgccaggtcccttggccccaaggggtcagactgccacaaggccgccgtcatcggtgacaccattggagaccccctcaaggacacatcaggcccgtccctcaacatcctcatcaagctcatggctgtcgagtcccttgtgtttgcacccttctttgccacgtacggaggcgtgctgttcaagtacctctagagagcacacatggcaagttaagcagaactatgatctacggaccccatcatgaataactcactgcctgttcgtatgttgtgcgctgttattttggttcccatgtcattccaggattgctgttaccttttctttggcctcttggaggtgttacgttagtctcacccttagggcctgtagctccatgtagaagagaacaacaaatgagagaccagatgtccgctccctttggtatgtgcctggcaaattttcctcgtcccttgatgacgacgataatgttgaatccttgaacaatgatatccatgattgttgcatgt

SEQ ID NO: 3763 - DNA, 2938 bp, Brachypodium distachyon
tcaacgcagagccagagaggttgtacgcgtcacacccttccctcgcccgccgccgccttcccctcgcgtccgtccgttcggtttggttagggtttcggccgacgccaccgccgccatggcgatcctctcggcgctcggcaccgaggtgttcatcccggtcgccgccgtcatcggcatcgtcttcgccgtcgtgcagtgggtgctcgtcgcgcgggtcaaggtcacccccggcgcggccggcgctaccggcgccaagaacggctacggcgactacctcatcgaggaggaggagggcctcaacgaccacaacgtcgtcgtcaagtgcgccgagatccagaccgccatctccgaaggagcaacatcatttcttttcactatgtaccagtatgttggtatcttcatgatcatcttcgcggtcttgatcttcttattccttgggtcgatcgagggattcagcacaaagggcaagccctgcacctatagcaaggacaagatctgcaagccagctctttacactgctctctttagcactgcatctttcttgcttggagccatcacatctttggtgtctggtttccttggaatgaagattgccacgtatgcaaatgccagaacaaccctcgaagcaaggaagggtgttgggaaggcatttatcaccgctttccgctctggtgcagttatgggcttcttattgtcatcaagtggtcttgtggttctttacattaccatcaacgtatttaaggtgtattacggtgatgactgggaaggtctttttgagtccatcactggttatggtcttggtgggtcttccatggctctctttggaagagttggtggaggtatttacacaaaggctgctgacgtgggtgctgatctcgttggcaaggttgaaaggaacattcctgaagatgacccgaggaatccagctgtgattgctgacaacgttggtgacaatgttggtgatattgctggaatgggatcagatctctttggttcatatgcagaatcttcttgtgctgctcttgttgttgcatctatctcatcttttggaatcaaccatgatttcactgggatgtgctacccactgcttgtgagctctgttggcatcattgtctgcttgttgaccacattctttgcaactgatttctttgagattaaggctgcaaatgaaattgaacccgctctaaagaagcagctcattatctcaactgctttgatgactgttggtgtcgcgataatcagctggttggctcttccagccaagttcaccatcttcaactttggtacacagaaggaagtggccaactggggcttgttcttctgtgtgtcaattggtctgtgggctggtctcattattgggtttgtcacagaatactacactagcaatgcatacagccctgtgcaagatgttgcagattcctgcagaactggtgctgctactaatgtcatcttcggtcttgctctgggatacaagtcagttatcatcccaattttcgctattgctgtcagcatctatgtcagcttctctattgctgcgatgtatggcattgcaatggccgctcttggcatgctaagcacaatggcaactggtcttgccattgatgcttatggtcccattagtgacaatgctggtggaattgctgagatggccggcatgagccacagaatccgtgagagaactgatgctcttgatgccgctggcaacacgactgctgctattgggaagggtttcgccattggttcagctgcactggtgtccttggcgctttttggtgcttttgtcagcagggctggagtgaaggttgttgatgtcctttctcccaaggtattcattgggttgattgttggagctatgctcccatactggttctctgccatgaccatgaagagtgttggaagtgctgctctcaagatggttgaggaggttcgcaggcagttcaataccattcctgggctgatggagggaacagctaagccagactatgcaacctgcgtcaagatctctaccgatgcttccatcaaggagatgattcctcctggtgctttggttatgctcactcccctcgttgtcggaaccttctttggtgtggaaactctttctggtgttctggctggcgctcttgtttctggagtacagatcgccatctctgcttccaacactggcggtgcatgggacaatgcaaagaagtacatcgaggctggtaacagcgagcacgccagatcccttggtcccaagggatcagactgccacaaggctgccgtgattggtgacaccattggagaccccctcaaggacacctcaggcccgtcgctcaacatccttatcaagctcatggccgtcgagtccctcgtgtttgcgccattcttcgcgacatacggaggcgttctgttcaactacctctaaaggactcacattaagcggacctatgatctacggacatccatcacgaataattccttgccagtcagttcgtatgttgcgctgttgcttttggttctctcatatgtcgtttcgggatattattattgcattacctaccgtttcggtctcttggggccttgagggtgttaccttagtcttactcacggcttgtagtagctccatgtagaagagaccagattgtgcactctcccgtggtgtatgtctggcaaattttcctcgtctcctgatgacgacgatgacgataatgttgaacccttgaacaatgatatgattattattgcatgtcaatggtggttgcaagtctatttttttctgaaactaatctgcctgtgtcattagctggatatatgctgctatcttacgcccaaaatttgtctttgatctacataagatcaatacaccctgaagtgctgaggatgtagtaagggtgtggagtgttgttttgttcttccccaatcataagatatgaaatataagttctatgaagttcctgtt

SEQ ID NO: 3764 - DNA, 2708 bp, Triticum aestivum
cccacgcgtccggacccgtccccccctcaccccccggcgcctcgtccgtaccgtccgttcggtccgttagggtttcgtcagccatggcgatcctcggggagctcgggaccgagatcctcatccccgtctgcggggtcgtcggcatcgtcttcgccgtcgcgcagtggttcatcgtctccaaggtcaaggtcacccccggcgccgcctccgccgccgccggcagcaagaacggctacggcgactacctcatcgaggaggaggagggcctcaacgaccacaacgtcgtcgtcaagtgcgccgagatccagaccgccatctcagaaggagcaacatcgtttcttttcaccatgtaccagtatgttggtatgttcatggtcgtctttgctgcgataatcttcctcttccttgggtcgattgagggattcagcaccaagggccagccctgcacctacagcacgggcacctgcaagccagctctctacaccgccctcttcagcactgcatctttcttgcttggagccatcacatctttggtgtctggtttccttggaatgaagatcgccacatatgccaatgccaggacgaccctggaagcaaggaagggtgttgggaaggcattcatcaccgctttccgctctggtgcagtcatgggcttcttgttgtcatcaagtgggcttgtggttctttacatcaccatcaacgtgtttaagatgtactacggtgatgactgggaaggtctttttgagtccatcactggttatggtcctggtgggtcttccatggctctgttcggaagagttggtggaggtatctacaccaaggctgctgacgtgggtgctgatcttgttggcaaagttgagaggaacattcctgaggatgacccaaggaacccagctgtgattgctgacaacgttggtgacaatgttggtgatattgctggaatgggatcagatctctttggttcatacgcagaatcgtcctgcgctgctcttgttgttgcttctatctcatcttttggaatcaaccatgatttcactgcgatgtgctacccactgctcgtgagctctgttggcatcattgtttgcttgctcaccaccctgtttgcgactgatttctttgagatcaaggctgcaagcgaaattgaacctgctctgaagaagcagctcatcatctccactgctttaatgactatcggtgttgcggtaatcagctggttggctctcccagctaagttcaccatcttcaacttcggtgctcagaaggacgtgtccaactggggcctgttcttctgtgtggcagttggtctgtgggctggtctgattattgggtttgtgaccgaatactacactagcaatgcctacagccctgtgcaagatgttgccgattcctgcagaactggtgctgccaccaacgtcatcttcggtcttgccctgggttacaagtcagtcatcatcccaattttcgctattgctgtcagcatctacgtcagcttctctattgctgcaatgtacggcattgcaatggctgctcttggcatgcttagcacaatggcaactggtcttgctatcgatgcttatggtcccattagtgacaatgctggtggaattgctgagatggctggcatgagccacagaatccgtgagaggactgatgctcttgatgctgctggcaacacaaccgctgctattggaaagggttttgccattggatcagctgctcttgtgtccctggcactttttggtgcttttgtcaacaaagctggtgtgaaggtcgtgatgtcctatctcccaaggggttcattggtctgattggcggagccaagcttccgtactggttctctgccatgaccatgaagagtgttggaagtgccgctctcaagatggttgaggaggtccgcagcagttcaacaccatccctggactgatggagggaactgccaagcccgactatgccacctgtgtaaagatctccactgatgcttccatcaaggagatgatccctccgggtgctttggtcatgctcacccccctcattgttggaaccctcttcggcgtggaaaccctgtctggtgttcttgctggtgcccttgtttctggagtgcagatcgccatctctgcttccaacaccggcggtgcatgggacaacgcaaagaagtacattgaggccggcaacagcgagcacgcgaggtcccttggccccaagggttcagactgccacaaggccgccgtgatcggcgacaccatcggagaccccctcaaggacacctcaggcccgtcgctcaacatcctcatcaagctcatgcccgtcgagtccctcgtgttcgcgccctttttcgccacgtatggaggtgtgctgttcaagtacatctagaagactcgttgagcggacttggaatctacggacaccatcaccatcacgaataactctgccccgcccgcccgccgttcgtatgttgtgcgctgctgttatttttggttctcgtgtcattattccaggattgccgcagtttaccccccactttccctttggcctcttgggtgtgttacgttagtctcaccattaccggcttgtagctctatgtagtagaagagagagaccggatgtcctcggtcattattggtatgtgtctggcaaattttcctcgtcccatgatgacgacgataatgtttgaacccttgaacgatgatatcatgacgattgttgcatca

SEQ ID NO: 3765 - DNA, 2190 bp, Panicum virgatum
gcgggcggcagcaagaacggctacggcgactacctcatcgaggaggaggaggggctcaacgaccacaacgtcgtcgtcaagtgcgccgagatccagaacgccatctccgaaggagcaacatcgtttctcttcacggagtaccaatatgttggtattttcatgtcgatctttgctgttgtcatctttctcttccttggctctgttgagggattcagcacaaagagccagccctgcacctatagcgtgggcaagtactgcaagcctgccctgttcactgcactcttcagcactgcatccttcttgcttggagccatcacctctttggtctctggtttccttgggatgaagattgccacatatgccaatgccagaaccaccctggaagctaggaagggtgttggaaaggcattcatcaccgcgttccgctctggtgctgttatgggctttttgctcgcatcaagtggtcttgtggttctctacatcaccattaatgtatttaagttgtactatggtgatgactgggagggtcttttcgagtctatcactgggtatggtcttggtggatcttccatggctctctttggaagagttggtggaggtatctacacaaaggcagctgatgtgggtgctgatcttgttggcaaagttgaaaggaacatccccgaggatgatcctaggaacccagctgtgattgctgacaatgtcggtgacaatgttggtgacattgctggaatgggatccgatctctttgggtcatacgcggaatcttcctgtgctgcccttgttgttgcatctatttcatcttttggaattaaccatgatttcactgggatgtgctacccattgcttgtgagctctgttgggatcattgtctgcttgatcaccacactctttgccactgacttctttgagatcaaggccgtgaaagaaatcgaacctgcacttaagaagcagctcatcatctccactgctttgatgactgttggtattgcgataatcagctggttggcccttccagctaagttcaccatcttcaactttggcactcagaaggaagtatccaactggggcttgttcttctgtgttgcaatcggtctgtgggctggtcttattattggttttgtcacagaatactacactagcaatgcatacagtcctgtgcaagatgttgcagattcctgcagaactggtgctgccaccaatgtcatttttggtcttgctctaggatacaagtcagttatcattccaattttcgccattgctgtcagcatctatgtcagtttctctattgccgcaatgtatggcattgccgttgctgcccttggtatgctaagcacaatcgcaactggccttgctattgatgcttatggtcccatcagtgacaatgctggtggcattgctgagatggctggaatgagccacagaattcgtgagagaactgatgctcttgatgctgctggtaacacaactgctgctattggaaagggatttgccattggatcagctgctcttgtctccctggccctttttggtgcctttgtcagcagggctggagtgcaggttgtcgatgtcctctcccccaaggtcttcattggcttgattgttggagccatgcttccgtactggttctctgccatgaccatgaagagtgttggaagtgctgctctgaagatggttgaggaggtccgcaggcagttcaacaccattcctgggctgatggagggaactggcaaacctgactatgctacctgcgttaagatttctactgatgcttccatcaaggagatgatccccccgggtgctctggtcatgctcacacccctcattgttggaaccttctttggtgtggagaccctctctggtgttcttgctggtgccctggtttctggagtgcagattgccatctctgcttccaacactggtggcgcatgggacaatgccaagaagtacattgaggctggtgccagcgagcacgcaaggaccctgggccctaagggatcagactgccataaggctgctgtgattggtgacaccatcggtgaccccctgaaggacacctccggcccatccctcaacatcctcatcaagctcatggccgtggagtctcttgtgttcgcccccttctttgctacccacggtggcctgctcttcaagtacctgtaagagccacatcaagcgcagaagaagtat

SEQ ID NO: 3766 - DNA, 2508 bp, Panicum virgatum
gcgggcggcagcaagaacggctacggcgactacctcatcgaggaggaggagggcctcaacgaccacaacgtcgtcgtcaagtgcgccgagatccagaacgctatctccgaaggagcaacatcgtttctcttcacagagtaccaatatgttggtattttcatgtcgatctttgctgttgtcatctttctcttccttggctctgttgagggattcagtacaaagagccagccctgcacctatagcgagggcaagttctgcaagcctgccctgttcaccgcactcttcagcactgcatccttcttgcttggagccatcacctctttggtctctggtttccttggaatgaagatcgccacatatgccaatgccagaaccaccctggaagctaggaagggtgttgggaaggcattcatcactgctttccgctctggtgctgttatgggctttttgctcgcatcaagtggtcttgtggttctctacatcaccattaatgtatttaagttgtactatggtgatgactgggagggtcttttcgagtctatcactgggtatggtcttggtggatcttccatggctctcttcggaagagttggtgggggtatctacacaaaggcagctgatgtgggtgctgatcttgttggcaaagttgaaaggaacatccctgaggatgatcctaggaacccagctgtgattgctgacaatgttggtgacaatgttggtgacattgctggaatgggatctgatctctttgggtcatacgcagaatcttcctgtgctgcccttgttgttgcatctatttcatcttttggaattaatcatgatttcactgggatgtgctacccattgcttgtgagctctgttgggatcattgtctgcttgatcaccacactctttgccactgacttctttgagatcaaggccgtgaaagaaatcgaacctgcacttaagaagcagctcatcatctccactgctttgatgactgttggtattgcgataatcagctggttggcccttccagctaagttcaccatcttcaactttggcactcagaaggaagtatccaactggggcttgttcttctgtgttgcaatcggtctgtgggctggtcttattattggttttgtcacagaatactacactagcaatgcatacagtcctgtgcaagatgttgcagattcctgcagaactggtgctgccaccaatgtcatttttggtcttgctctaggatacaagtcagttatcattccaattttcgccattgctgtcagcatctatgtcagtttctctattgccgcaatgtatggcattgccgttgctgcccttggtatgctaagcacaatcgcaactggccttgctattgatgcttatggtcccatcagtgacaatgctggtggcattgctgagatggctggaatgagccacagaatccgtgagagaactgatgctcttgatgctgctggtaacacaactgctgctattggaaagggatttgccattggatcagctgctcttgtctccctggccctttttggtgccttcgtgagcagggctggagtgaaggttgtcgatgtcctctcccccaaggtattcattggcttgattgttggagccatgcttccgtactggttctctgccatgaccatgaagagtgttggaagtgctgctctgaagatggttgaggaggtccgcaggcagttcaacaccattcctgggctgatggagggaactggcaaacctgactatgctacctgcgttaagatttctactgatgcttccatcaaggagatgatccccccgggtgctctggtcatgctcacacccctcattgttggaaccttctttggtgtggagaccctctctggtgttcttgctggtgccctggtttctggagtgcagattgccatctctgcttccaacactggtggcgcatgggacaatgccaagaagtacattgaggctggtgccagcgagcacgcaaggaccctgggccctaagggatcagactgccataaggctgctgtgattggtgacaccatcggtgaccccctgaaggacacctccggcccatccctcaacatcctcatcaagctcatggccgtggagtctcttgtgttcgcccccttctttgctacccacggtggcctgctcttcaagtacctgtaagagccacatcaagcgcagaagaagtatacattcaatcgatccatgggcatcttgaataactcctgccagatcaccagttcgcgtgtcgcaccccgcattgtgcggccgtttttttggtctcattatttcaggattgctgctactgttggtctttctctttgggcctcctggaggcgttaccgttagccttactcttactgcttgtagctccacgtagaagagatgccctgcatctggcaaattttctcagtcccttgatgatggcgatgatgttgaaatctttgaacaatgatacatgattgttgcagtgtactggtgatgaatcatatggtctgttaatggtta

SEQ ID NO: 3767 - DNA, 2812 bp, Saccharum officinarum
gtccggcggcggcaagaacggctacggcgactacctcatcgaggaggaggagggcctcaacgaccacaacgtcgtcgtcaagtgcgccgagatccagaacgccatctccgaaggagcaacatcgtttcttttcactgagtaccaatatgttggtatcttcatgtctatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtatctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcaccattaatgtatttaagttgtattacggtgatgactgggagggtctttttgagtctatcactggctatggccttggtgggtcgtccatggctctcttcggaagagttggtggaggtatctacacgaaggctgctgatgttggtgccgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgctcttgttgttgcatctatttcatcttttggaattgaccatgatttcactgggatgtgctacccactccttgttagctctgttggtatcatcgtctgcttgatcaccaccctttttgctactgatttctttgaagtcaaggctgtgaaagaaattgagcctgcacttaagaagcagctcatcatctccaccgtcctgatgactgttggtattgctgtaatcagctggttggcccttccagctaagttcaccatctacaacttcggtattcagaaggctgtctccaactggggcttgttcttctgtgttgcaattggtctgtgggctggtctgattattggttttgtcacagaatactacactagcaatgcatacagtcctgtgcaagatgtcgcggattcgtgcagaactggtgctgccactaatgtcatttttggtcttgcccttggatacaagtcagttatcatcccgattttcgctattgctgttagcatctatgtcagtttctccattgctgcaatgtacggcatcgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgccgctattggaaagggatttgccattggttcagctgctcttgtgtccctggcgctttttggcgccttcgtcagcagagctggagtgacagttgttgatgtcctctcccccaaggttttcattggtttgattgttggagccatgcttccctactggttctctgccatgaccatgaagagtgttggaagtgccgccctgaagatggtggaggaggtccgccggcagttcaacaccattcctgggttgatggagggaactgccaagcctgactatgcaacctgtgtgaagatctccactgatgcttccatcaaggagatgattcctccgggtgctctagtcatgctcactcccctcattgttggaaccctcttcggtgttgagactctttctggtgttcttgctggtgccctggtttctggagtgcagattgccatctctgcatccaacaccggtggtgcatgggacaatgccaagaagtacattgaggctggtgccagcgagcacgcaaggaccctcggccccaagggatctgactgccacaaggctgctgtgatcggtgacaccattggtgaccccctgaaggacacctcgggcccgtccctcaacatcctcatcaagctcatggccgtggagtccctcgtgtttgcccccttcttcgccacccaaggtggcattctgttcaagtacctgtaagggccacaccaagcacatcagaagtatacgatcgaccgaccgtggacatctcgaataactcctgccaaatcgccagttcttgtgtattgtgcgctagccgcctagctgcactgctgtttttttggtctcattgtttcaggattgctgctgctgtttgtattttctctttgggcctcctggaggcgttactgttagccttactcttactccctgtagctccacgtagatgagaacagatgtcctgcgtctggcaaattttcccagtcccttgatgatggcgatgatgttgaaatctttgaacaatgatacatgattgttgcattgtactggtggtaaatcatactccgtattgctctgttgatgcccactccaatcatccaatgttatgatctgagttatagtggaataccccacaacaaccaccactatccaacccaccatctcccaccatctcccatccaccgcatcacgatcgacgctcgctcgcctgccgcccggatcttcttcgaggggcggccgttttataggatcacagtttatcgcccggtgggtgcgaaggtttaatgttttttttgggggaccaaaatacaatgcaggggcgggggattaaacgaacggaggggggaaaacctcggggtacccaaatac

SEQ ID NO: 3768 - DNA, 2586 bp, Sequoia sempervirens
gtttgtggatcggatagaccttggttggaaccggagtaggagctgtgagaacctctgaagggctttcagcaatggagggtccgctgctcagcgaaatgctaacagaaatactgattccagttgcggcggttgttggaatagggtttgcattgctgcaatggctgctggtttctcaagttaaagtgaagccctccacggcgtcaaatggttacaacgaacgtttgctggaggaggtcgacgaggatggaattgacggtcgccaggctgtcttgaaatgtgcagagatccagaacgccatctctgaaggggctacatcattcctgtttacagagtacaagtatctggggatatttactgtgtgttttggggctatcatatttttgtttctcggttctgtggagaattttagcaccaaatctcaagcctgtacttatcaaaggaaaaaatgtgcaagcctgctcttgcaaatgctatattcagtgctatagcttttctgcttggtgctttgacatcagtgttatctggttttctgggaatgaagattgcaacttatgcaaatgcacgaactactttggaggccaggaagggtgttgggaaggctttcattactgcatttagatctggtgctgtgatggggtttttgcttgctgcaaatggacttctcgtgctttacatcaccattaatgttttcaagatatattatggagatgattgggagggtctctttgaagccattactggctatggtcttggtgggtctgcgatggcgctttttggaagagttggtggtggaatttacaccaaggctgctgatgttggtgccgaccttgttggtaaagttgagcagaacattcctgaagatgacccacggaacccagcagttatagctgataatgttggtgacaatgttggagacattgctggtatgggctcagatttgtttgggtcctatgctgaatcctcctgtgctgctcttgttgtggcatccatttcatcattcggcaacaatcatgatttcacttcaatgtgctatcccttgctaatcagttcaatgggtatcgtgatttgcttaatcacaacactgtttgcaactgatttctttgagatcaaggcagtcaaggaaattgaaccttctctgaagaggcagcttatcatctctactgtactgatgacaattggcattgctattgtaagctttgttgctttgccatcaaccttcacaatcttcaactttggtgctgccaaaacagtcaaaaactggcatctgttcttctgtgtttcaattggattatgggctggactcgtgattggttatgttactgagtactatactagtaatgcttacagccctgttcaagaagtggctgagtcctgtaaaactggagctgcaacaaatgtcatattcggccttgctttgggatataagtcggtcattattcccatttttgctattgcagttgccatatttgtgagcttcagtttggctgccatgtatggaattgcagtagctgctcttggaatgctaagtaccattgcaactggactggctatagatgcttatggtccaattagtgacaatgctggtggtattgctgagatggctggcatgaatcataagattcgagagaggactgatgcccttgatgcagcaggaaacactacagctgcaattggcaaggggtttgccattggttctgctgcacttgtgtctcttgcactgtttggagcatttgtaagccgagctgcaattacatcagtggatgtccttaccccaaaagtatttatcggtttaattgttggggcaatgctgccttactggttttctgccatgacaatgaaaagtgtgggtagcgctgcattgaaaatggttgaagaggttcgcagacagttcaaaaacatacctggtctgatggaaggaacagcaaagccagactatgctacttgtgttaaaatatcaacagatgcatccctgaaggagatgattcctcctggggcccttgtgatgctcacacctctcattgttggtatcttatttggagtagagaccttgtctggagtactggctggtgctcttgtctcaggggttcaggttgctatatcggcttctaacactggtggtgcttgggacaatgccaagaaatacatagaggccggggcatcagcagctgcgagagaattaggcccgaaggggtctgatgcccacaaggctgctgtaattggtgataccataggagatcctctgaaagacacatctggaccatcacttaacattctgatcaaacttatggctgttgaatcacttgtatttgcgcccttttttgccgctcatggaggaatcctgttcaaaatctaaaagctaatttgcaagcctatatttagcggcagataaattaacactgagaaaggcttgtccaatgtattaatgtttgctctgtagcttgtaggtatgcctggcgtagggcagttttttattttcaaatcgtacggtgcataggtatatttccagtcttgtgtagaactggctaatggctaatggttaaagatctgattcagttttgtatcccaattttcaaaaaggcgaaaaat

SEQ ID NO: 3769 - DNA, 3887 bp, Sciadopitys verticillata
ctgaaaagtgcttaatctggggaaatgtttaagtgggtagttctgtagaagcacagagactgcagaaggagaaggagaattcattgggcgtgtggagggagcctggatgccaacaatgttcaaccttggatgaaaagaaattccaactcaggttgattaaattatgccacgttgaccattcttcctcaattgtactttggctgaaagagcagttgcaaccactattgccaagtctgtggagaaggttttctttcagaaaggaaagattagtctcaactccagattcacatttcactcctctgaaaacgcaacaggtgcttaacttggcttgaggtctcttactgctgccgcaaaaatcctagatgaagaagctctagattcagttagatttgactcaggcctgccaacttggtttctcctgtaagtcgcagatcgatttgaatctggcctgctatcctcttcgtgcatcatctgtcttggcactggtaccttggtctttctgactattatacttggctcgacttgattcacccctaacaacttggccttttctcgtgaactgtgttgcagctgctcgtgctcctgcaattgctgcatccaaaccaggtgtcttgaccagattgtctgctgatgaactaatgtgagaagtgagagctccaggctttaaggagaagggatttgatggatctggaagtgaaaattttactggtagtgggctctggactggcctgaggcctcttactgctgatgcaaaaatctttctttctaggttatatacaccttgaaatcctcgcatttcaaatggaaccactaatttctgtggatcctcacacagccagcaaaaagtctgtttgtccttccattcgtacaccattagaaaggtcttcccagcagactagttcttcacatttcacacatccaaccacattaacacaacctagaagttgagaaactggataattctcaggaaactttatgtccgtcactccatcgaccctatagatttccttgtaaaactcctccatagcttgaactgtttcaggatctggaacttttgcagctgcatgaatccacagacgacctcgcactggtgaaggccaggagcggccttcaattcgcttgatcccgtgcactagcaacgacgcccatggttggtgcattgtaagacatggatttctaagattgtcggacattttcgtaagtcctgaatattctacagctctgattttcagtgtggttgggatctgagaggccacggttcgatccgcaggagctgcataagaaaggcctagtggagcctcttccttagtttttcttagcaatggggcttcctatgctgagcgaaatgctaacggaaatactgattccgttagctgctgttataggaatactgtttgcgttgctgcaatggctgttggtttctcgcgtgaaagtaacgccaggagtgagggcgtcgggcaccagcaataatgggtataatgataatttgcttgacgaggacgacgaagagggagttgacggccgtctcgtcgtcacgaaatgtgcagagatccagaacgccatctctgaaggggctacttcgttcctgtttactgagtacaagtatctggggatatttatggtgtgtttcggggctattatatttttgtttctcggttctgtggagagttttagcaccaaatctcaaccatgtacttatcaaacggaaaagatgtgcaaacctgctcttgcaaatgctatattcagcactatagccttccttctcggtgctttgacttcagtgttatctggatttctgggaatgaagattgcaacttatgcaaacgcaagaactactttggaagctaggaagggtgttgggaaggcatttattactgcatttaggtctggagctgtgatggggtttttgcttgctgccaatggacttcttgtgctttacatctccattaatgttttcaagatctactatggagaagattgggagggtctctttgaagccattactggctatggtcttggtgggtctgcaatggctttatttggaagagttggtggagggatttacaccaaggctgctgatgttggtgctgaccttgttggtaagattgagcagaacataccagaagatgaccctcgtaaccctgcggttatagctgataatgttggcgacaatgttggagatattgctggaatgggatcggatttgtttgggtcctatgctgaagcctcttgcgcagctcttgttgtggcatccatttcatcttttggcaacactcacgatttcacgtccatgtgctatcccctactaatcagctcaatgggtattctgatttgcttaatcacaacactgtttgcaaccgacttctttgagatcaaggtggttaaggaaattgaaccttctctgaagaggcagctcatcatctctactgtgctgatgacaattggcattgctattgtaagcttcgttggattgccttcaacgtttaccatctacaattttggttctgtcaaagttgtcaagaactggcatctgtttttctgtgttgctattgggttgtgggctggacttgtgattggttacactactgagtactatactagtaatgcttacagccctgttcaagaagtggcccaatcctgcagaactggagctgcaacaaatgttatttttggccttgctttgggatacaagtctgtcattatccccatctttgctattgcagtagctatatttgtgagcttcagtttggctgccatgtatggaattgcagtagctgctttggggatgctaagtaccatagcaactggattggctatagatgcatatggccctattagtgacaatgctggtggtattgctgaaatggctggtatgaatcataagattcgggagaggactgatgcccttgatgcagcaggaaacacaactgctgcaattgggaaggggtttgcaattggttctgctgctctggtgtctcttgcattgtttggagcatttgtaagtcgagctgcaattacaaaagtggatgttctcaccccgaaagtgtttattggtctaattgttggggcaatgctgccgtattggttttctgccatgacaatgaaaagtgtgggtagtgctgcattgaaaatggttgaagaggttcgcaggcagttcagaaccataccaggtttaatggaaggaactacgaaaccagactacgcaacttgcgttaagatatcaactgatgcatcacttaaagagatgattcctcctggagcccttgtgatgctcacacctctcattgttggtactctatttggagtagagaccttgtcaggagttctggctggtgcccttgtctctggggttcaggttgccatatcagcttctaacactggtggggcctgggataatgccaagaaatacatagaggctggggcatcagcggctgctaaggagcttggcccaaaggggtctgatgcccacaaggctgctgtaattggtgataccattggagaccctctgaaagacacatctggaccatcgctcaacattctgatcaagcttatggctgttgaatcactcgtctttgcacccttttttgctaaacatggaggaatcctgttcaaactttagaggcgaatttacaaaattatatttagcggcagataaattttcactgaggaaagcttgttcaataggcaatgggcatagcctgtaggttatgcctggtatagggcaggtttatttttaaattgaatggtccataagtaggtataattccagtctcttggagaactgggttaatgtttaaagatctgattcagttttgtactccaatttttcgaaaaggtgaagaataatgtaaaagtctaacaattattgctgtctgtacggtattgca

SEQ ID NO: 3770 - DNA, 2803 bp, Pinus taeda
gttccgcatacgaacggctggttcactcttattttatttttgaggggcctctccctattctgctgctggtaacgtttcagcttcggctgccctacgttttattttaggtctctaacaatggggggcgctcttctctctgaaaccctgacggagattttaattccggtggctgccgttattggtatcggcttcgctctgattcagtgggttctggtgtcccgcgttaaggtgtcacccgaccactcacacacgcctagcaataacaacaagaatggctacagtgagtacttgatcgaagaagaggaagggctgaacgatcacaatgtcgtcaataaatgcgctgagatccagaacgccatctctgaaggagcgaactcatttttattcaccgagtaccagtacatgggtattttcatggtctgctttgctgcccttatatttctgttccttggttcagtggagaaattcagtacaaaaagtcagccatgcacgtacaacaaagaagtgatgtgcaagccagcccttgctaatgctattttcagcacaatagctttcttgcttggttctttgacatctatcctttctggctatcttggaatgaaaattgcaacttacgcaaatgcaagaacaacactagaagccaggaagggtgtcgggaaggctttcatcactgcctttcgatctggtgctgttatgggctttctgcttgctgcaaatggactgttggtgcttttcattgccattatccttttcaagttgtactatggaaatgactgggagggtctttttgaagccattaccggttatggtcttggtggttcttccatggctctgtttggcagagtaggtggtggtatttacaccaaagcagcagatgtaggtgctgatcttgttggcaaggttgagaggaacattcctgaagacgatccacgcaacccagctgtcattgctgataatgttggtgacaatgttggagatatcgctggtatgggatcagatctatttgggtcctatgctgaatcttcctgtgcagctctggttgttgcatccatatcatcatttggaaactctcatgatcttactgccatgtgttaccccttgctcattagttcaatgggtatcattgcttgcttaatcacaactctttttgcaactgacatatttgagatcaaggctgtgaaggaaattgagcctgcattgaaaaagcagcttattatctccacagtagtgatgactattggcattgctgctgtaagcctagttgcattgccttcgtccttcactatcttcaattttggtgcccagaaggttgtaaagaactgggagcttttcttctgtgttgctattggtttgtggtctggccttgttattggttttgtcactgagtactacactagtaatgcttacagccctgtccaagatgttgctgattcatgcaggactggagcagcaactaatgttatatttgggttggctttgggatacaaatctgttattattcccatatttgctattgcagtaagcatttttgtcagttttagtttggctgccatgtatggtattgcagtagctgctttgggcatgctcagcacaattgcaactggattggccatcgatgcatatggacccatcagtgacaatgctggtggaattgctgaaatggctggcatgagtcacaggatccgtgaaaggacagatgcccttgatgcagctggaaacactactgccgccattggcaagggctttgccattggttcagctgcattggtgtcacttgcattgtttggagcctttgtcagccgtgctgcaattcaaactgtggatgtcttaacaccaaaagtgttcattggtttaattgttggggcaatgcttccttattggttctctgcaatgacaatgaaaagtgttggtagtgcagcactgaaaatggttgaagaggttaggaggcaattcaacaccatccctggtctgatggaaggtcatgggaagccagattatggaacttgtgtgaagatatcaactgatgcctcgctaaaagagatgattcctcctggttgccttgtgatgcttacacctctcattgttggtactttatttggtgtggaaactctatcaggtgtccttgctggtgctcttgtatctggtgtgcaggttgctatttctgcttccaacactggtggtgcttgggacaatgctaagaagtatattgaggctggtgcatcaaggactcttggtccaaaagggtccgatccccacaaagctgctgtcaccattggagacccattgaaggacacctctggaccatctctaaatattttgataaagctcatggctgttgagtcactggtgtttgcacctttttttgcaacccacggctgtttaaatttttctagttgcagaaatccttttcaagctgtactagtcggcatcatttttctctttgagtatgacgagcaaagcctgtccgaaacgttatgattcttggtggatattgccagtggcaggttctgttcagaatgttagttttttaggtaaatgcctgaaggaggtagtggttctggttactgtgttattgcaactattgggtcaaattttgtattgccatttttcatgaaatataaactatttgaaatttccctttaaaaaaaaaaataatccccaaaaaaaagaacaaataatccccaaattgatggaaaataaatcattaaaattgtataataaaatctttttcggccgccccggccaattcaactcaaaacccaacacaccttatgcaggccgccgcaattcaaccccatccccc

SEQ ID NO: 3771 - DNA, 3155 bp, Picea glauca
attttctttaatttatttttaattattcgagattcgtgcccccactcaacgaggggaacaaagagagcgatctcctttccagctcccctcaacgagggcctggtgtaagtggtgggaacttggaaggtaaggaggccaagttctacgataaccataaatactgaaacgtgggcgtccaagaaattccatctccaactgttttcattcttggtcatctgggtagtgtcggtttgaatccgcagaggctcgtttttctggcagttttggtttcaagaaggctcatttttcgccatgggtggtgctctgctgagcgagactctatcggaaatactgatacctgttgctgctgttattggaattgggttctccctgcttcaatggctgttggtatcgcgcgttaaagtgggtcctgagaaggcctcgtcgcgcaataatggagtgtataacgagtttttgctcgacgaagccgatgaagaaggcaccgatgtaagaaacgctgtccccaagtgtgccgagattcagaacgccatttccctcggggctacttcatttctgtttacacagtacaaatatctggggattttcactgtatgttttgggcttctcatatttttgttccttggttctgtggagggtttcagcaccaaccaacagccatgtaactatgatacggcaaagatgtgcaaacctgctcttgcgaatgcattgttcagcaccatagccttcgtgcttggtgctttcacgtctgttctgtctggttatcttggaatgaaaattgcaacatatgctaatgcaagaaccactttggaagccaggaaaagtgttgggaaggccttcattacagcatttaggtctggggctgtgatgggattcttacttgctgctaatgggcttttggtcctgtacatcaccattaacattttcaagctctattatggagatgactgggagggcctctttgaagccattaccggttatggtcttggtgggtcttcaatggctcttttcggaagagtcggtggaggaatttacactaaagctgctgatgttggtgctgatcttgttgggaagattgagcagaacatacccgaagatgaccctcgtaacccagctgttatagcggataatgttggtgataatgttggagacatagctggcatgggctcagatttgtttggatcctatgctgaagcttcctgtgccgctcttgtcgtggcatccatctcatcatttggcaataatcatgatttcactgcaatgtgttatccccttctcatcagttcaatgggtattgtgatctgcttaattacaacattgtttgctacggacttatttgagatcaaggctgttaaggacattgaacctactctgaagagacagctgataatatctactgtgcttatgacggttggcattgctattgtaagctctgttggattaccatcaaccttcaccatctacaattttggtgctgagaaagtagtgaagagctggcatctatttttctgtgttgctgttggattgtgggctggacttgtgattggttacactactgagtattacacaagcaatgcctatagtcctgtccaggaagtagcccagtcctgcaaaactggagctgcaacaaatgtcatatttgggctggctttaggatacaagtctgtaattattcctatcttcgctattgcagcggccatattcgtgagttttagtctggctgcaatgtatgggattgcagtggctgctttggggatgctcagtaccattgcgactggactggcgatagatgcttatggtcctattagtgacaatgctggcggtattgccgagatggctggctttagccataagattcgtgaaaggactgatgctctagacgcagcagggaatactactgctgcaattggcaagggctttgccattggctcagctgcgttggtgtctcttgcattatttggagcatttgtaagccgggccgcaatttcaaaagtggatgtccttacacccaaagtattcattggtttacttgttggggccatgttgccttactggttttcagctatgacaatgaaaagtgtgggaagtgcagcattgaaaatggttgaagaggtccgcagacagttcagagatattcctggtctgatggaaggaactgccaaaccggattatgcaacctgtgtgaagatatcaacagatgcctcacttagagaaatgattcctcccggtgcccttgtaatgctcacacccctcattgttggaacgttgtttggagttgagactctgtctggagttctggctggagcccttgtctcaggagtacaggttgcaatatcagcttccaacactggcggtgcttgggacaatgccaagaaatacatagaggcaggggcatcaaaagctgcaagggaacttggtcctaaaggatctgatgcccacaaggctgctgttatcggtgataccataggggatccattgaaagatacatcagggccatctctgaacattcttatcaaactgatggctgttgagtcacttgtgtttgcaccatttttcgctactcatggaggattgctttttaaaatctaaaaagtaaatgccatcccaacccaaggatatttagcagcataagaatataggtggaccaatatcctaatgcttgccctgtggtctgtaggctatgcctggccaagggcagctttattttcaaacactatggttaataggtataagtcctgccctggtgaactgatcaatgttttgaatttctgagtcagttttgtatcataatttttcataactgtaaagaataataacagtcgagaatagatgtcaaggtcagtggtatttgataggcttatggtatggtatcatgcactgtttaataggcttatggtatgatatcatcaacctttttcactaggccaacaatcgatacaagtggcttccggactattgttgggactttcattttggtgaataatgctatgcttcaatgttcagattagtactatggtttccagctgtgttcaactgtgttcaaatgttcagattagtactatggtttccagattagtacacagtactaatctggcagaactgttttgaaactttaatatattcctctccagagagaggaaggcatatgctgttttctt

SEQ ID NO: 3772 - DNA, 2525 bp, Setaria italica
tacctcatcgaggaggaggaggggctcaacgagcacaacgtcgtcgtcaagtgcgccgagatccagaacgccatctccgaaggagcaacttctttccttttcactgaatacaagtatgttggactattcatgggcatttttgctgtcctgatcttcctcttccttggctctgttgaggggttcagcaccaagagtcaaccttgccactacagcaagggcaagatgtgcaagcctgcccttgctaatgctctcttcagcaccatcgcctttgtgcttggtgcagtcacctcacttgtttctgggtttcttggaatgaagattgcaacatatgcaaatgccagaacaactcttgaggcaaggaagggtgtcggaaaggcattcattactgccttccgctctggggctgtgatgggcttcctgcttgctgctagtggcctttttgtcctttatattgcaatcaacttgtttggaatttattatggtgatgactgggagggcctttatgaggctatcactggttatggtctcggtggttcttctatggctctttttggccgtgttggtggtggaatatacaccaaagctgctgatgttggtgcagatcttgttgggaaagttgaaaggaatatccctgaagacgatccgagaaacccagctgtcattgcggacaatgttggtgacaacgttggagatattgctggaatgggatcagatctctttggctcctatgctgagtcttcatgcgctgctcttgtcgttgcctcgatctcttcttttgggatcaatcatgaattcactcctatgttgtacccactcctcgttagctctgtgggtatcatagcttgcttgataaccactctttttgcaactgatttcttcgagatcaaggctgtagatgaaatagagccagctctcaagaagcaacttataatttccactgctgtgatgaccgttggcattgcacttgtcagttggttagggctcccatatacattcacaatcttcaactttggtgtgcagaagacggtgtataactggcaattattcctatgcgtggcagttggtctgtgggctggactagttattggatttgttacggagtattacacgagcaatgcatacagtcctgtgcaggatgttgctgactcctgcagaactggagctgctactaatgtcatctttggccttgctctgggatacaaatcagtcattatccctatttttgctattgctttcagtattttcctcagcttcagccttgctgcaatgtacggtgttgctgtggctgctcttggaatgctcagcacaatcgctactggccttgccattgatgcctatggtcctatcagtgataatgctggaggaattgctgaaatggctggcatgagccacagaatccgtgagagaacagatgctctcgatgctgctggaaacactactgctgccattgggaatgccattggttcagctgccttggtgtctcttgccctctttggtgcttttgtcagccgtgctgagatctcaactgttgatgttttgtcgcctaaagttttcattggactgattgtcggtgccatgcttccatactggttctcagcaatgaccatgaagagtgttggcagtgcagcactcaagatggttgaggaagtccgcaggcagttcaacaccatccctgggctcatggagggcaccaccaagcctgactatgcgacatgtgtgaagatctccactgatgcgtccatcaaggagatgatccccccaggcgcacttgtcatgctcaccccgcttattgttgggatcttgtttggtgttgagaccctctctggtgttcttgctggtgctcttgtttctggtgtccagattgcaatctctgcatccaacactggaggtgcctgggacaatgcaaagaaatacatcgaggctggtgcatctgagcacgcaagaactctgggccccaaaggctccgatccacacaaagctgctgtcattggtgacaccatcggtgatccgctcaaggacacctcaggcccatcactgaatatcctcatcaagctcatggccgttgagtccctggtctttgcccccttcttcgccacccatggaggcatcctcttcaaatggctttagaggaagaagatcgatggaccggttactttaattttgccggggagagcactagatttatctatgccatagagagaagtttcagttccccatacagtgcctttcttccattttctgtgttgcaatcaagttgaacttatcactatcagccatggtgtcacctaagtttttgggtctagttgcagtagccgtgtggagcaaatctctggccattctacaggtttggagtttggcatttggtgtattgggaagtttgtattgactgtagatatttcgatgatgatgatgatgaaggaacgcacaattcggattcttgtctttgtgaaacactggagtttttgttgtatatgcggatgattggatgcccgtttcctgtgtcctgcctcttttttctgtcagag

SEQ ID NO: 3773 - DNA, 3155 bp, Ricinus communis
tgtggtttatggctttaataggtgccacatcttttctgttcacggaatatcagtatgttggtattttcatggttgcttttgcaatcttgatattccttttcttgggttctgttgagggctttagcacaaagagccgaccatgtacttttgattcacagaagacttgcaaaccagcacttgctactgcaatattcagtactgtctcatttttacttggtgccgtcacttcagtcctctctggtttcctggggatgaagattgctacctatgccaatgcaagaactaccttggaagcaagaaagggagttggaaaggcttttattactgcatttaggtctggtgcagtaatgggttttctgcttgctgcaaatggtctattgtttctttatattgctataaatctcttcaagctgtactatggggatgactgggaaggtctctttgaatcaattactggctatggtcttgggggatcttctatggctctctttgggagggttggtggtggtatctacaccaaagctgccgatgttggtgctgatcttgtgggaaaggttgaaagaaacattccagaagatgacccaagaaacccagctgtcattgctgacaatgttggggacaatgttggagacattgctggtatgggatctgatctttttggctcttatgctgaatcatcttgtgctgcccttgtcgttgcttccatctcctcttttggaatcaaccatgagttcactgccatgctatatcctctgcttattagttctgtgggtatcctggtttgtttgattactaccctctttgccactgatttcttcgaaatcaaggctgtgaaggaaattgaaccggcactaaagaagcagcttgttatctccactattcttatgaccgtgggcattgcaattgtaacttggattggcttgccttcatctttcacaattttcaattttggtactcagaaggttgttaagaactggcaattgttcttgtgtgtggctgttggtctttgggctggacttattattggatttgttaccgagtactacaccagcaatgcttatagccctgtgcaagatgttgccgactcctgcaggactggagctgccactaatgtcatctttggtcttgccttgggatacaaatctgtcattattccaatttttgccattgcagctagcatttttgttagttttagttttgcggctatgtatggcattgctgtggctgctcttggaatgttaagcacaattgccactggattggctattgatgcttatggccccattagtgacaatgctggaggcattgctgagatggctggcatgagtcaccgcattcgagaaaggactgatgctcttgatgcagctggcaacactactgctgccattggaaagggatttgccattgggtctgctgctttggtgtctttggctttatttggtgcttttgtgagccgtgcagcaatttcaactgttgacgttttgaccccaaaggtcttcattggtctgatagtgggcgccatgcttccttactggttttctgcaatgacaatgaagagtgtgggaagtgcagctctgaagatggttgaggaggttcgcaggcagttcaacactattcctggtcttatggagggtcatgccaagcctgattacgctacctgtgtcaagatctctactgatgcatctatcaaagagatgattccaccaggtgcactggtcatgctcacacccctcattgttggaaccttctttggtgttgagactctttctggcgtgctggctggttcccttgtctctggcgttcagatagcaatttctgcatccaacactggtggtgcatgggataatgcgaagaagtacattgaggctggtgcatcagagcatgctaggtcactaggccccaaaggttctgagccacacaaagcagctgtaattggagacaccattggtgatccacttaaggacacctcaggtccatcgctcaacatccttatcaagctcatggcagttgaatctcttgttttcgcaccctttttcgccactcacgcttttgctgacaaaaaagaaattgaagattcaaacaaaagcattctcgaatcaaactccaaatcttcctcttccctttccccttctctctcaacagcaacagcaacagcaacagcagcttctctctcaacagcagcagcaataatgcttcaattcacttcaacaaaacccccaaattcccttttccactccctgaattctccacaatttctccccaattccctctgctccatttccctccctctccatcttcctcttttctacaccaactcctctcatcaccctcaccctctctctctccgcatccgcgcaatcgacgcagcccaaccctacgactacgaagcccaactcaaatcccaacaccttaaatcccaatctctcaaaattgcattcatcggtttcggcaactttggtcaattcctcgctaaaaccctctcccgccagggtcacactctcttagcttactctcgtaccaattacaccgacattgccaaacaactcaacaccagattctacaataatccacacgacctctgcgagaatcaccctgatgttctaattttatgtacttcgattctgtcaactgaaaaagttctaaagtcttttccttttcaaagattaaaacgtaataccctttttgttgatgttttgtctgtcaaagaatttgctaagaatgtattgttgaagtatttgcctattgagtttgatattttgtgtacccatccaatgtttggtcctgaaagtggtaagctttcttgggctggtttgccttttgtgtttgataaagttagaattggtaataatgatgatagaattagtaggtgtgacaaatttcttgacattttcgctagagaaggatgtagaatggtggaaatgagttgtgttgagcacgataagtatgccgccgggtcgcaatttgtgactcatactatggggagagtgttggagaagtttggattggagtcgtcgcccattaatactaaagggtacgagactttgttggatttggagacagttgtttggcacctcagagggattgcagatcggcctaagattcagaagttgctccgtaatggtgctccatctgttgaacctcctgcggatgttttg

SEQ ID NO: 3774 - DNA, 2625 bp, Abies balsamea
gtggccttggttcgaatccgtagaggctcattttctgggagttttggcgtcaagaaggcttaattttcgccatgggtaatgctcgactgagcgagggtataacgcaaatactgatacccgttgctgctgttattggaattgggttcgccctgcttcaatgggtcttggtatcgcgcgtcaaagtgggtcctgagaaggcctcgtcgcacaataatggatcgtataacgagtttttgcttgacgaagctgatgaagatggcgccgatgaccgaaatgctgtcccaaagtgtgccgagattcaaaacgccattgccctgggggctacatcgtttctgtttacagagtataaatatctggggattttcaccgtatgttttgggcttatcatatttttgttccttggctctgttgagggtttcagcaccaagcatcagccatgcaactatgataaggcaaagctgtgcaagcctgctcttgcgaatgcattgttcagcaccatagctttcgtgctcggtgcttcgacatctgctttgtctggttatcttggaatgaaaattgcaacatatgctaatgccagaactactttggaagccaggaagggtgttgggaaagccttcattacagcatttaggtctggggctgtgatgggattcttgcttgctgccaatgggcttttggtgctgcacatctccattaacattttcaagctctattatggagatgactgggagggcctctttgaagccattactggttatggtcttggtgggtcttcaatggctcttttcggaagagttggtggaggaatttacacgaaagctgctgatgttggtgctgatcttgttgggaagattgagcaaaacatacccgaagatgaccctcgcaacccagctgttatagctgataatgttggtgataatgttggagacatagctggcatgggctcggacttgtttggatcctatgctgaagcttcctgtgctgctcttgtcgtggcatccatctcatcatttggcagtaatcatgatttcactgccatgtgttatcctctgcttatcagttcaatgggtattgtgatctgcttaattacaacattgtttgctacggacttctttgagatcaaggctgttaaggacattgaacctagtctgaagagacagctgataatctctactgtgctcatgacggttggcgttgctattgtaagctttgttgctctaccatcaaccttctccatctacaattttggttctatgaaagaagtgaagaactggcatctatttttctgtgttgccgtcggattgtgggctggacttgtgattggttacactaccgagtattacacaagcaatgcctatagtcctgtccaggaagtagctcagtcctgcaaaactggagctgcaacaaatgtcatatttggtttggctttaggatacaagtccgtaattattcctatcttctctattgcagcggccatatttgtaagtttcagtgtggctgcaatgtatgggattgcagtcgctgctttgggaatgctcagtaccattgcaactggacttgcgatcgatgcttatggtcctattagtgacaatgctggcggtattgctgagatggctggttttagccataagattcgtgaaaggactgatgctctagatgcagcagggaatactactgctgcaattggcaagggctttgccattggctcagctgcattagtgtctcttgcattatttggagcatttgtaagccgggctgcaatttcaacagtggatgtccttacacccaaagtattcattggtttaattgttggggccatgttgccttactggttttcagctatgacaatgaaaagtgtgggaagtgcagcattgaaaatggttgaagaggtccgcagacagttcaaaaatattcctggtctgatggaaggaactgccaaaccagactatgcaacctgtgtgaagatatcgacagatgcctcgcttaaagaaatgattccccctggtgcccttgtaatgctcacacccctcattgttggtaccttgtttggagttgagactctgtctggagttctggctggagcccttgtctctggagtacaggttgcaatatcagcttccaacactggcggtgcctgggacaatgccaagaaatacatagaggcaggggcatcaaaagctgcaagggaactaggccctaaaggatctgatgcccacaaggcagctgttatcggtgataccataggggacccattgaaagacacgtcagggccatctctgaacattctgatcaaactgatggctgttgagtcacttgtgtttgcaccattttttgctacacatggaggattgctttttaaaatctaaaatgtaaatatgctttcacaacccttagacatttagcggcataagaatatgagttgatcaatatactaatgtttgccctgtggcctgtagactatgcctagccaagggcagctttatatttaaacactatggttaataggtaataagtcctgtcctggtgaactgatcaatgttttgaatttctgagtcagttttgtatcacaaattttcataactgtaaagaataatgtacagtgaagaatcaaggttcggaccccac

SEQ ID NO: 3775 - DNA, 2637 bp, Cephalotaxus harringtonia
aaagtaagagaaggctccattaataaatacgaagcagaggagctcatatgtgtagcgttgttttgggatccgatcgacctcggttccagtcgcaggaggagctgcgtaaactctgaaaggctctagcaatgggggttcctatgctgagcgaaatgctgacggaaatactgattccgctagccgctgttattggaatagggtttgcattgttgcagtgggtattggtgtctcgcgtgaaagtgacgccctccacgacgtcgaatggctacaacgaccatttgctcgatgaggctaacgaagatggaattgacggccgccaggccgtcatcaaatgcgcagagatacagaatgccatctccgaaggggccacttcattcctgtttacagagtacaagtatctggggatttttaccatgtgttttggggctattatatttttgttccttggttctgtggagaattttagcaccaaatatcaagcctgtacttaccagaaggaaaagatgtgcaaacctgctcttgcaaacgctatattcagtgctatagcctttctgcttggtgctttgacttcggtgttatctggttttcttggaatgaagattgcaacttatgcaaatgcaagaactactttggaggctaggaagggtgttgggaaggctttcattactgcatttaggtctggtgctgtgatggggtttttgcttgcagcgaacggacttcttgtgctttacatcaccattaatgttttcaagatctactacggagatgattgggagggtctctttgaagccattacgggctatggtcttggtgggtctgcaatggctctatttggaagagttggtggaggaatttataccaaagctgctgatgttggtgctgacctagtaggtaaggttgagcagaatatacctgaagatgaccctcggaaccctgcggttatagctgataatgttggcgacaatgttggagacattgccggtatgggctcagatttgtttgggtcctatgctgaatcttcatgcgctgctcttgttgtggcatccatttcatctttcggcaacactcatgatttcacatccatgtgctatcccctgcttatcagctcgatgggtattctgatttgcttaatcacaacattgtttgcaactgatttctttgagatcaaggctgttaaggaaattgaaccttctcttaagaggcagcttataatctctactgtgctgatgacaattgggattgctattgtaagctttattgctttgccatcaacctttaccatcttcaactttggttctgccaaagtagtcaagaactggcatctatttttctgtgtttctattggattgtgggctggacttgtgattggttacactactgagtactatactagtaatgcttacagccctgttcaagaagtggcccagtcctgcaaaaccggagctgcaacaaatgtcatatttggccttgctttgggatataagtctgtcatcattcccatttttgctattgcagtagccatatttgtgagcttcagtttggcagccatgtatggaattgcagtagctgcccttgggatgctaagtaccatagcaactggattggctatagatgcttatggtcccataagtgacaatgctggtggtattgctgagatggctggcatgaatcataagattcgggagaggactgatgcccttgatgcagcaggaaacactactgctgcgattggcaagggatttgccattggttctgctgcgttggtgtctcttgcactgtttggagcatttgtaagccgagcagcaattacatcagtcgatgtccttactccaaaagtatttattggtttaattgttggggcaatgctgccttactggttttctgccatgacaatgaaaagtgtgggtagtgctgcactgaaaatggttgaagaggttcgtaggcagttcagagacatacctggcctattggaaggaactacaaaaccagactatgctacttgtgttaagatatcaacagatgcatcccttaaagagatgattcctcctggcgcccttgtgatgctcactcctctcattgttggtatcttatttggagtagagaccttgtcaggagttctggctggtgctcttgtctctggggttcaggttgctatatcagcttctaacaccggtggtgcttgggacaatgccaagaaatatatagaggctggggcatcagctgctgcaagagaattaggcccgaagggatctgatgcccataaggctgctgtaattggtgataccataggagatcctcttaaagacacatctggaccatcacttaacattctgatcaagcttatggctgttgaatcacttgtatttgcaccttttttcgctgctcatggtggaattcttttcaaaatctaaatgcaaatttgcaagcctatatttagcggcggataaattttaactgagaaaggcttgtccaatgtattaatgttcgttctgtagcctgtaggttatgcctggcatggggcatttctattttcaaaatgtatggtgcacgggtatatttccagtgtaatggttaaagacctgattcagttttgtattccaattttcaaaaacggtgaaaataacgtagaagtctgac

SEQ ID NO: 3776 - DNA, 2273 bp, Malus domestica
aggagcaacctcgttcctcttcacggaatacagatatgtaggtgctttcatggttgcttttgcaatcttgatcttccttttccttggatccgtcgagggatttagtacaagtagccgtgcatgtacatatgaccaaaccaagacgtgcaaaccagctctcgccactgccatcttcagcaccatttcctttttgcttggtgctgtaacttcagtggtttctggattccttgggatgaagattgctacttacgcaaatgccagaacaacgttggaggcaagaaaaggtgttgggaaggcttttattactgcatttagatcaggagctgtgatgggctttctcctcgcttcaagtggtctgttggttctttacattgctatcaatgtcttcaagttgtactacggtgatgactggggtggtcttttcgaggctataactggttatggtcttggtggatcttccatggctctctttggcagggttggtggaggcatctataccaaagctgctgatgttggtgcagatcttgtcggcaaggttgaaagaaatattcccgaggatgacccaaggaacccagctgtgatagctgataatgttggcgacaatgttggagatatagctggcatgggatctgatctttttggatcctatgctgagtcatcatgtgctgcccttgtggttgcttccatttcctcattcgggatcaatcacgagctaactgcaatgctatatcctctcattgtcagttccatcggcatccttgtttgtttgctcactaccctatttgcaaccgatttctttgagatcaaggctgtaaaggaaattgagccaacattgaagaggcagctcataatctccactgtactcatgaccgttggagttgcgattgctacatggatatctgttccatcttccttcacaatcttcaatttcggaacacagaaagttgtgaagaactggcagctattcttatgtgtctgtgttggtttgtgggctggccttatcattgggtttgtaacagagtattatacaagcaatgcgtacagccctgtgcaagatgttgctgattcttgccggactggagctgcgaccaatgtcatttttggccttgcattgggatacaaatccgtcattattcctatttttgccattgcagtcagcatttttgttagttttagctttgcagctatgtacgggattgccgtagctgcccttggaatgctgagcaccattgcaactggattagcgattgatgcatatggtcccatcagtgacaatgctggaggcattgctgagatggcaggcatgagccacagaatcagagagagaactgatgctcttgatgctgcaggaaacaccactgctgctattggaaagggatttgcaattggctctgctgctcttgtgtcccttgctctatttggtgcctttgtcagccgtgctggtatcaaaacagttgatgtgttgaccccgaaagtgattattggtttgttagtgggcgcaatgcttccgtattggttctctgccatgacaatgaagagtgtgggaagtgcagctctaaagatggttgaggaagtgcgccggcaattcaataccattcccggtctcatggagggcactgccaagccggactacgctacatgtgttaagatttcgactgatgcttccatcaaggaaatgatcccgcctggtgcccttgtcatgcttacacccctcattgttgggatcttttttggtgtggaaactctcgctggagtgcttgctggatcccttgtctccggtgtacagattgccatttctgcgtccaacacgggcggtgcctgggataatgccaagaaatacattgaggctggtgcgtcggagcatgcaaggacccttggtccaaaaggatcagaatgccacaaagctgctgtcatcggtgacaccattggagaccctctcaaggatacatctggaccatcgctcaacattctcatcaagctcatggccgttgagtctcttgtgtttgctccgttctttgccacacacggtggcctgcttttcaagatttaagttgaaaacggtgcaacagaaacccggaagttgttcctctccgttcatctgctgatccttccttccaatctcctccgcgaaataatagaagatgggactcaaattagtaaccaacgggagaattgacagacaaatttttccctttctgaaggagggtttatgatgacgatgatgataacgacgatgataatggtcgaacttagtagagtttggattttcttct

SEQ ID NO: 3777 - DNA, 2959 bp, Pinus pinaster
gtacatgggaagaggcctgatctaggtggtgggaacttgtaaggtaaggaggccaagttctataaccataaatactgaaacgtgggcgctcagcgaattccatcttcaattttctttcttcgtcatctgtgtggccttggttcgaatccgtagaggctcattttctgttttctgatagttctggcttaaggaagtttcaccatgggtggtgctggtgctctcttgagcgaatcgctatcgcaaatactgatacccgttgctgctgttattggaattggtttcgcgctgcttcaatggctgttggtgtcgcgcgttaaagtgggttctgagaaggcctcgtcgctcaataatggagtgtataacgaggttttgctcgaagaacccgaggaagatggcggcgatttaaaaaacgctgtccccaagtgtgcagagattcaggacgccatttcccttggggctacttcatttctgtttacagagtacaaatatctgggtattttcactggatgttttgggcttctcatgtttttgttccttggctccgtggagggtttcagcacccagcagcagcaatgtagctatgataagacaaagatgtgcaaacctgctcttgcaaatgcattgttcagcaccatagccttcgtgcttggtgcttttacgtctgttctgtcaggttattttggaatgaaaattgcaacatatgctaatgcaagaaccacattggaagccaggaaaggtgttgggaaggccttcattacagcatttaggtctggggctgtgatgggattcttgcttgctgccaatgggcttttggtcctgtacctctccattaatgttttcaagctctattatggagatgattgggagggcctctttgaggccatcactggttatggtcttggtgggtcttcaatggctctttttggaagagttggtggaggaatttacactaaagctgctgatgttggtgccgatcttgttgggaagattgagctaaacatacccgaagatgaccctcgcaacccggctgttatagctgataatgttggtgataatgttggagacatagctggcatgggctcagatttgtttggatcctatgctgaagcttcctgtgctgctcttgttgtggcatccatctcatcatttggcagtgatcatgattttactgccatgtgttaccccctacttatcagttcaatgggtattgtgatctgcttgattacaacactgtttgctacggacttatttgagatcaaggctgttaaggatattgaacctactctgaagagacagctgataatctctactgtgcttatgacggttggcattggtattgtcagcgctgttggattaccatcaaccttctccatctacaattttggttcagtgaaagtagtgaagaactggcatctatttttctgtgttgccgttggattgtgggctgggcttgtgattggttacattacagagtattacacaagcaatgcctatagtcctgtccaggaagtggcccagtcctgcagaactggagctgcaacaaatgtcatatttgggctggctttaggatacaagtctgtaattattcctatctttgctattgcagcggccatattcgtgagtttcagtctggctgcaatgtatggaattgcagttgctgctttggggatgctcagtaccattgcaactggacttgctatagatgcttatggtcctattagtgacaatgctggtggtattgctgagatggctggctttagccataagattcgtgaaaggactgatgctctagacgcagccggaaatactactgctgcaataggcaagggttttgccattggctcagctgcattggtgtctcttgcattgtttggtgcatttgtaagccgggccgcaatttcaacagttgacgtccttacacccaaagtgttcattggtttactcattggggccatgttgccttactggttttcagctatgacaatgaaaagtgtgggaaaagcagcattaaaaatggttgaagaggtccgcagacagttcaaaactattccaggtctgatggagggtactggcaaaccggattatgcaacctgtgtgaagatatcaacagatgcctcacttaaagaaatgattcctcctggtgcccttgtaatgctcacacccctcattgttggtatcttgtttggagttgagactctgtctggagttttggctggagcccttgtctcgggtgtacaggttgcaatatcagcttccaatactggcggtgcttgggacaatgccaagaaatatatagaggcaggggcatcaaaagctgcaagggatcttggacctaaaggatctgattgccacaaggctgccgttattggtgacaccattggggacccattgaaagatacatcagggccatctctaaacattcttatcaaactgatggctgttgagtcacttgtgtttgcaccattttttgctgctcatggaggattgctttttaaaatctaggccgtctctatccacagatatttagcggcctaacaatataggtctgttgatcaatatgctaatgtctgccctgtagcctgtaggctatccctagaccagggcagctttattttcaaacactatggttaggtacgagtcctgtcctagtgaactgataaatgttttgaatttctgaatcagttttgtatataatttttcataattgtaaagaataatatacagtggagaatcaaggtcaaggtcaggggtatttgataggcctatggtatggtatcgtgcactttttacactgggcaataaagtggtatttgataggcttatggtatgctaccatccacctttatcattaggcacaatcatatacaactggcttccagactattgtaaggactttcattttggtgaataatgttatgcttcaatgttcagatcgtattatgatttaacgaaaaaaaaa

SEQ ID NO: 3778 - DNA, 3164 bp, Pinus taeda
acgtgcgaccttggctgtcactcagggggaacaaagagggcgagttcctttccaggtcccctcaaagaggacctggtctaggtggtgggaactagtaaggtaaggatgccagttctataaccataaatactgaaacgtgggcgctcagcaaattccatcttcatttttctttcttcgtcatctgtgtggccttggttcgaatccgtagaggctcattttctgttttctgaatagttttggcttcaggaagtttcaccatgggtggtactctcttgagcgaatcgctatcgcaaatactgatacccgttgctgctgttattggaattgggttcgcgcttcttcaatggctgttggtgtcgcgcgttaaagtgggttatgagaaggcctcgtcgctcaataatggagtgtataacgaggttttgctcgacgaacccgacgaagatggcggcgatttaaaaaacgctgtccccaagtgtgcagagattcaggaagccatttcccttggggctacttcatttctgtttacagagtacaaatatctgggtattttcactggatgttttgggcttctcatgtttttgttccttggctccgtggagggtttcagcacccagcagcagcaatgtcactatgataagacagagatgtgcaaacctgctcttgcaaatgcattgttcagcaccatagccttcgtgcttggtgcttttacttctgttctgtcaggttattttggaatgaaaattgcaacatatgctaatgcaagaactacattggaagccaggaaaggtgttgggaaggccttcattacagcatttaggtctggggctgtgatgggattcttgcttgctgccaatgggcttttggtcctgtacctctccattaacgttttcaagctctattatggagatgattgggagggcctctttgaggccatcacaggttatggtcttggcggttcttcaatggctctttttggaagagttggtggaggaatttacactaaagctgccgatgttggtgccgatcttgttgggaagattgagctaaacatacccgaagatgaccctcgcaacccggctgttatagctgataatgttggtgataatgttggagacatagctggcatgggctcagatttgtttggatcctatgctgaagcttcctgtgctgctcttgtcgtggcatccatctcatcatttggcagtgatcatgattttactgccatgtgttaccccctacttatcagttcaatgggtattgtgatctgcttgattacaacactgtttgctacggacttatttgagatcaaggctgttaaggatattgaacctactctgaagagacagctgataatctctactgtgattatgaccgttggcattggtattgtcagcgctgttgcattaccatcaaccttctccatctacaattttggttcagtgaaagtagtgaagaactggcatctatttttctgtgttgccgttggattgtgggctggacttgtgattggttacattactgagtattacacaagcaatgcctatagtcccgtccaggaagtggctcagtcctgcagaactggagctgcaacaaatgtcatatttgggctggctttgggatacaagtctgtaattattcctatctttgctattgcagcggccatattcgtgagtttcagtctggctgcaatgtatggaattgcagttgctgctttggggatgctcagtaccattgcgactggacttgctatagatgcttatggtcctattagtgacaatgctggcggtattgctgagatggctggctttagccataagattcgtgaaaggactgatgctctagacgcagcaggaaatactactgctgcaataggcaagggttttgccattggctcagctgcattggtgtctcttgcattgtttggtgcatttgtaagccgggccgcaatttcaacagttgacgtccttacacccaaagtgttcattggtttaatcgttggggccatgttgccttactggttttcagctatgacaatgaaaagtgtaggaaaagcagcattaaaaatggttgaagaggtccgcagacagttcaaaactattccaggtctgatggagggcactgccaaaccggattatgcaacctgtgtgaagatatcaacagatgcctcacttaaagaaatgattcctcctggtgcccttgtaatgctcacacccctcattgttggtaccttgtttggagttgagactctgtctggagttttggctggagcccttgtctcgggtgtacaggttgcaatatcagcttccaatactggcggtgcttgggacaatgccaagaaatacatagaggcaggggcatcaaaagctgcaagggatcttggacctaaaggatctgattgccacaaggctgccgttattggtgacaccataggggacccattgaaagatacatcagggccatctctaaacattcttatcaaactgatggctgttgagtcacttgtgtttgcaccattttttgctgctcatggaggattgctttttaaaatctaggccgtctctatccacagatatttaacggcctaacaatataggtctgttgatcaatatgctaatgtctgccctgtagcctgtaggctatccctagaccagggcagctttattttcaaacgctatggttaggtatgagtcctgtcctggtgaactgataaatgttttgaatttctgaatcagttttgtatataatttttcataattgtaaagaataatatacagtggagaatcaaggtcaagttcaggggtatttgataggcctatggtatggtatcgtgcactttttacactggacataaagtggtatttgataggcttatggtatgctaccatccacctttttcattaggcacaatcagatacaactggcttccagactattgtaaggaccttcattttggtgaataatgttatgcttcaatgttcagatcgtattatgatttccagctgttatcaaattggttatgagtggatataacaacattttgtttttccgttgctaggatacaaggttcgatgtttgtcatgtcaagtatggcataactggtttgaagcaggtggttgcttttttcctattgctaagatacaaggttccatgtttgtcatgtcaag

SEQ ID NO: 3779 - DNA, 2672 bp, Pseudotsuga menziesii
atcgcggtggccttggttcgaatccgaagagcttcattttttagcagttttggcttcaagaaggttcatttttcgccatgggtggtgctctactgagcgagactctaacgggaattctgattcctgttgctgctgttattggaattgggttcgccttgcttcaatgggtgctggtatcgcgcgtcaaagtgggtcctgatagttcctcgtcgcgcagtaatggatcatataacgagcttttgcttgacgaggccgatgaagatggtggcgatgcacgaaacgctgtcccaaagtgtgccgagattcagaacgctatttccgaaggggctacttcgtttctgtttacagagtacaaatatctgggggttttcactgcatgttttggggtcatcatatttctgttccttggctctgtgcagggtttcagcaccaagcaacagccatgcaactatgataatgctaagatgtgcaagcctgctcttgcgaatgcattgtttagcaccttagccttcgtgcttggtgctgtgacttctgttctgtctggttattttggaatgaaaattgcaacatatgctaatgcaagaaccactttggaagccaggaagggtgttgggaaggccttcattacagcatttaggtctggagctgtgatgggattcttgcttgctgccaatgggctcttggtgctgtacctctccattcacattttcaagctttattatggagatgactgggagggcctctttgaagccattactggttatggtcttggtggctcttcaatggctctttttggaagagtcggtggaggaatttacactaaagctgctgatgttggtgctgatcttgttgggaagattgagcaaaacatacctgaagatgaccctcgcaacccagccgttatagctgataatgttggcgataatgtcggagacatagctggcatgggctcagacttgtttggatcctatgcagaagcttcctgtgctgctcttgtcgtggcatccatctcatcatttggcactgatcatgatttaactgccatgtcttatcccctgcttattagttcaatgggtatcgtgatctgcttaattacaacactgtttgctacggacttctttgagatcaaggctgtcaaggatattgaacctactctgaagagacaacttataatttctactgtgcttatgacggctggcattgctgttgtaagctttgttggattaccatcaaccttcaccatctacaattttggtactttgaaagaagtgaagaactggcatctatttttctgtgttgctgttggattgtgggctggacttgtgattggttatactactgagtattacacaagcaatgcctatagtcctgtccaggaagtagcccagtcctgcagaactggagctgcaacaaatgtcatatttgggcttgctttaggatacaagtctgtaattattcctatcttcgctattgcagcggccatattcgtgagtttcagtctggctgcaatgtatgggattgcagttgctgctttggggatgctcagtacgattgcgactggacttgcgatagatgcttatggtcctattagtgacaatgctggtggtattgctgagatggctggctttagccataagattcgtgaaaggactgatgctctagacgcggcagggaataccactgctgcaattggaaagggctttgccattggttcagctgcattggtgtctcttgcattatttggagcatttgtaagccgggccgcaatttcatcagtggatgtccttacacccaaagtcttcattggcttgcttgtcggggccatgctgccttattggttttcagctatgacaatgaaaagtgtgggaagtgcagcattgaaaatggttgaagaggtccgcagacagttcaaaaatattccaggtctgatggaagggactgccaaacccgactatgcaacttgtgtgaagatatcaacagatgcttcacttagagaaatgattcctccgggcgcccttgtaatgctcacgcccctcattgttggtaccttgtttggagttgagactctggctggagttctggctggagctcttgtctctggtgtacaggttgcaatatcagcttccaacactggcggtgcttgggacaatgccaagaaatacatagaggcaggggcatcaaaagctgcaagggaacttggtcccaaaggatctgattgccacaaggctgctgttatcggtgataccataggggacccattgaaagatacatcagggccatctctgaacattctgatcaaactgatggctgttgagtcactagtgtttgcaccattttttgctactcatggaggagtgctttttaaattttaaaaagtgaatgccttcagaaccctagatatttagtggcataaggatataggtcgatctatttagcggcataagaatataggttgatcaatatactaatgtttttcctgcgaacttaaggctatgcctaaccaaggacagctttattttcaaacactatggttaataggtgtaactcctgtcctagtgaactcatcaatgctttgaatttctgagtcagttttgtatcataatttttcttaactgtgtaaagaataatatacagtggagaatcgaggttaaagtcggtggcatttgataggc

SEQ ID NO: 3780 - DNA, 2613 bp, Malus domestica
tgggtttggataacgcagttgtaatatatataattttaagattttaagaggttgcagttcaaaacccaccaagcattttcttcttttctttgctatataaatatcttagatatacccagagaattattgaaggaaccaactgttgtgtgtgaagtttttggaagatgggtttgctgagtgagggactgactcaggtggtgattcctttggctgcggttgtggggcttggttttgctttgctgcagtggtttttggtgtcaaaggtgaaggtctctggcgggcatggtgagcgaaatgggttcaaggacaagctcattggagatgaagaagagggtgttagctccgttgaggttaccatcaagtgtgctgagattcaacatgccatttccataggggcgacctcttttctgttcacccaatacagatacctcagcattttcgtcggtgtttttagcaccataatcttcctcttccttggctcagtgaagggttttagcactaaaagcgaagcctgcacatataacacaggcaatatgtgcaaaccggcattagccaacgccttctttagtactattgccttcttgcttggtgcttttacatccgtcctctctggatttctcgggatgaagatcgcaacgtatgccaatgctagaacaactctagaagcaaggaggggtgttgggaaggctttcattactgcctttcgctcaggtgctgtgatggggttccttcttgctgccaatggcctattggtgctgtatatcactatcaatttgtttaagttgtattatggggatgactgggaaggactatatgagtcaattactggttatggacttggaggttcttcaatggcactctttgggagagttgggggaggtatatacacgaaagctgctgatgttggtgctgatcttgtcgggaaagttgaacgaaatatccctgaagatgatccacgaaaccccgccgttattgcagacaatgtgggtgacaatgtaggagacattgccgggatgggatctgacctgtttggatcttatgccgagtcttcttgtgcagcattgtttgttgcatccatatcatcctttggcatcggtcatgactacaccgccatgtcgtatcctttgatcataagctcaatggggattgtggtttgtttggtaacaacccttttcgcaacagatctgtttgagatcaagaaagtcagtgagatcgaacccgctttgaagcgtcaactcgttatctcaaccgtcttaatgactgttgggatcgccgtggtcacctttgtagctttgccatcagagttcactctcttcagctttggaaccaataaggctgtcaagaactggtacctcttcttttgtgtagcaattggcttgtgggctggccttgttatcggatacactacagagtattacactagcaatgcttacagtccggtacaggatgtggcggattcttgcaggactggtgctgcaacgaacgtgatttttgggctggctctcggttacaaatcagtcatcattcctgtgttcgccattgcgtttgctatctacgttagctttagtttggctgccatgtatggaattgctgtggctgctttgggaatgctgagcactatctccacaggtcttgcaattgatgcttatggcccaataagtgacaatgctggtgggatcgcagagatggccgggatgagccatgagatacgcgaaagaacagatgctttagatgctgctggaaacacaactgctgctattggcaagggttttgctattggatcggctgctcttgtttctcttgctttgttcggtgcctatgtcagcagagccggaatagagactgttgatgtgttgacgccgaaagtcttcattggcctgcttgtgggagctatgcttccctactggttttctgccatgacaatgaagagtgtgggaagtgcagcgcttaaaatggtcgaagaggttcgcaggcaattcaacacaattccggggctcatggaaggaacagcaaagccagattacgcaacgtgcgtcaagatttccacagatgcttccctcaaggagatgatcccgccaggcgctttggtcatgcttacaccactcattgccggcaccttctttggagttgaaactcttgccgggattcttgctggttcacttgtttccggtgtgcagattgccatttctgcttccaacactggaggcgcatgggataatgcaaagaagtacatagaggccggcgcttcagaacatgctaagtcactaggtcccaagggttcggagccccacaaggcggccgtcataggtgatacgatcggagatccgctcaaggacacttcaggtccttcgctcaatattctgatcaagctcatggcagttgagtccttggtgtttgctcctttctttgcagctcatggaggcctcctcttcaaatggctttgaaaatggagttgcaaatcaagttaaccgcggtatatgtgttaataaagacggagcttttcactctaattcccaattttactagaactacgtatgtccatgttactctttgttgcgtatcaatatatatatgtatccacaatcatatttatcaatttttttttcttttgtc

SEQ ID NO: 3781 - DNA, 2608 bp, Cedrus atlantica
ttttggcttcaagaaggcttatttttcaccatgggtgatgctctgctgagcgagaatctaacgcaaatactgataccagtttctgctgttgttggaattgggttcgctctgcttcaatgggtgttggtatcgcgcgtcaaagtgggctctgagaaggcctcgtcgcagagtaatggatcgtataacgagtttttgcttgacgaagcggatgaagatggcgctgatatacgaaatgctgtcccaaagtgtgccgagattcaaaacgccatttccctaggggctacttcatttctgtttacagaatataaatatctggggattttcactggatgttttggggttatcatatttttgtttcttggctctgtaaagggtttcagcaccaagattcagacatgcaactatgatacgacaaagatgtgcaagcctgctcttgcaaatgcattgttcagcaccatagcctttgtgctcggtgctttcacgtctgttctgtctggttatcttggaatgaaaattgcaacgtatgctaatgcaagaaccactttggaagccaggaagggtgttgggaaagccttcattacagcatttaggtctggggctgtgatgggattcttgcttgctgccaatgggcttttggtgctgtacatttccattaacattttcaagctctattatggagatgactgggagggcctctttgaagccattactggttatggccttggtgggtcttcaatggcccttttcggaagagttggtggaggcatttacactaaagctgctgatgttggtgctgatcttgttggaaagattgagcaaaacatacctgaagatgaccctcgcaacccagctgttatagctgataatgttggtgataatgttggagacatagctggcatgggctctgacttgtttggatcatatgccgaagcttcctgtgctgctcttgtcgtggcatcgatctcatcatttggcagtgatcatgatttcactgccatgtgctatcccctgcttatcagttcaatgggtattgtgatctgcttaattacaacattgtttgctacggacttctttgagatcaaggctgttaaggacattgaacctagtctgaagagacagctgataatctctactgtgcttatgacgggtggcattgctattgtaagctttgttgcattaccatcaaccttcaccatctacaattttggttctgcgaaatcagtgaagaactggcatctatttttctgtgttgccatcggattgtgggctggacttgtgattggttacattaccgagtattacacaagcaatgcctatagtcctgtccaggaagtagcccagtcctgcaaaactggagctgcaacaaatgttatatttgggttggccttaggatacaagtccgtaattattcccatctttgctattgcagcggccatatttgtgagtttcagtctggctgcaatgtatgggattgcagttgctgctttggggatgctcagtaccattgcgactggacttgcaatagatgcttatggtcctattagtgacaatgctggtggtattgctgagatggctggttttagccataagattcgtgaaaggactgatgccctagatgcagcagggaatactactgctgcaattggcaagggttttgccattggctcagctgcattggtgtctcttgcattatttggagcatttgtaagccgggctgcaatttcaacagtggatgtccttacacctaaagtattcattggcttaattgttggggccatgttgccttactggttttcagctatgacaatgaaaagtgtgggaagtgcagcattgaaaatggttgaagaggtccgcagacaattcaaaaatattcctggtctgatggaaggaactgccaaaccagactatgcaacctgtgtgaagatatcaacagatgcctcgcttaaagaaatgattcctcctggttgccttgtaatgctcacacccctcattgttggtaccttgtttggagttgagactctctctggagttctggctggagcccttgtctctggtgtacaggttgcaatatcagcttccaacactggcggtgcctgggacaatgccaagaaatacatagaggcaggagcatcaaaagctgcaagggaacttggtcctaaaggatctgatgcccacaaggctgctgttatcggtgataccgtaggggacccattgaaggatacgtcagggccatctctgaacattctgatcaaactgatggctgttgagtcacttgtgtttgcaccattttttgctactcatggagggattctttttaaaatttaaagagtaaatgccttcacaacccctagatatttagcggcataggagtataggttgatcaatatactaatgtctgctctgtggcctgtatgctatcctagccagggacagctttattttcaaacactatggttaataggtataagtcctgtcctggtgaactgatcaatgtttcgaatttctgagtcagttttgtataaaaaatttcataaactgtaaagaataatatacaattgagaatcaaggtcagtggcatttgataggctggtggtatggtatctcatgc

SEQ ID NO: 3782 - DNA, 2810 bp, Malus domestica
tttagagtacaccagatattgagaaccttaacggtttagatgtgcgctcgagaattcaaagaaatttaacaagcggatatgatccaaacccactaggatatcgtttggatttggataatgcagttgtaatatattattaagattataagaggctgcagttcatacccaccaagcatttttctttcctttgccatataaatatctcagatataccaagaaaattattgaaggaagcaattgttgtgtgtgagattttggaagatgggtttgctgagtgagggactgacacagattgtgattcccttggctgcggttgtggggcttggttttgctttgctgcagtggtttttggtgtcaagggtgaaggtctctggtgggcatggtgagcgaaatgggtacaaggacaagctcattggagaagaagaagagggtgttaactctcttgaggttaccatcaagtgtgctgagatccagcatgccatttccattggggcgacctcttttctgtttacccaatacaaatacctcagcatcttcgttggcgtttttagcgccatcatcttcctcttccttggctcagtgaagggtttcagcaccaaaagtgaaccctgcacatataacacaggcaacatgtgcaaaccggcactagccaacgccttcttcagtaccgttgccttcttgctcggtgcttttacatctgttctctctggctttcttgggatgaagatcgcaacgtatgccaatgccagaacaaccctagaagcaaggaggggtgttgggaaggctttcatcaccgcttttcgctcgggtgctgtgatggggttccttcttgctgccaatggacttttagtgctgtatgcgtccataaacctatttaagctgtattatggggatgactgggaaggactgtacgagtcaattactggttatggacttggaggttcttcaatggcactctttggaagagtcgggggaggcatatacacgaaagctgctgatgttggtgctgatctcgtcgggaaagttgaacgaaatatccctgaagatgatccacgaaaccccgccgttattgcagacaatgtgggtgacaatgtaggagacattgccgggatgggatctgacctgtttggatcttatgccgagtcttcttgtgcagcattgtttgttgcatccatatcatcctttggcatcggtcatgactacaccgccatgtcgtatcctttgatcataagctcaatggggattgtggtttgtttggtaacaacccttttcgcaaccgatctgtttgaaatcaagaaagtcagtgagatcgaacccgccttgaagcgtcaactcctcatctcaaccgtctttatgactgctgggatcgccgctgtcactttcgtatctttgccatcagaattcactctcttcagctttggaaccaataaggctgtcaaaaactggtacctcttcttttgtgtatcaatcggactgtgggctggtcttgttattggatacaccacagagtattacactagcaatgcttacagtccggtgcaggatgtggcagattcatgcaggactggtgctgcaacaaacgtgattttcgggctggctcttggttacaaatcagtcatcattcctgtgttcgccattgcgtttgctatctacgttagctttagcttggctgccatgtatggaatagctgtggctgctctgggaatgctcagcactatctccacaggtcttgcaattgatgcttatggccccataagcgacaatgctggtgggattgcagagatggccgggatgagccacaagatacgcgaaagaacagatgctttagatgctgcaggaaacacaactgctgctattggcaagggttttgctattggatcagctgctcttgtttctcttgcattgtttggcgcctatgtcagcagggcgggaatagagaccgttgatgtgttgacaccgaaagtcttcattggcttgattgtgggagctatgcttccgtactggttttccgccatgacaatgaagagtgtgggaagtgctgcactcaaaatggtcgaagaggttcgcaggcagttcaatactatcccggggctcatggaaggaacagcaaagccagattacgcaacttgtgtcaagatttctaccgatgcttccctaagggagatgatcccaccaggcgccttggtcatgcttacaccactcgttgccggtaccttctttggagtcgaaactcttgcagggattcttgcaggttcacttgtttccggcgtgcagattgccatttctgcatccaacaccggcggggcatgggataatgcaaagaaatacatagaggccggcggttcagaacatgctaaatcactaggtccgaagggttcggaaccccacaaggcggcggtcataggcgatacgattggagatccgctcaaggacacttcaggtccttcactcaatattctgatcaagctcatggcagttgagtccttggtgtttgctcctttctttgcagctcatggaggcctcctcttcaaatggctttgaaaatggagctgcagcacggtcaaattaaccgttcaagatggagctttttactctaattagttgtttcatgttgttaagtaaaagctatatatttatggcttcgttaatcccaattttactagaactacatatgtaattttactagaactgtatatgtgtgtgtgcgcgcgcatgttactctatgttgcatgtcaatgcatatccacaatcttggttatgtgtgtatctctttctgtttaaagaaattttttctagttgtccaggaataa

SEQ ID NO: 3783 - DNA, 2255 bp, Gossypium hirsutum
aagagccagccttgcacttatgacaaatctaagatgtgcaaacctgctcttgccactgcttatattcagcacagttatctttcttgctcggtgctgtcacttcagtagtttctggctttcttgggatgaaaattgctacctatgctaatgctcgaaccaccctggaggcaagaaagggagttgggaaggcatttattactgcattcagatctggtgctgtcatgggctttcttcttgctgcaaatggtcttttggtgctttacattgccatcaacttattcaagctctactacggtgatgactggggtggtcttttgaggcaatcactggttatgggcttggaggttcgtccatggcgctttttggaaagttggtggaggcatctatacgaaagctgctgatgtcggtgctgatcttgtaggcaaggtggaaaggaacattcctgaggatgaccctagaaacccagctgtgattgctgacaatgttggggataatgttggtgatatcgctgggatgggatctgatcttttgggtcctatgctgaatcatcttgtgctgcacttgttgtcgcttccatctctcttttggcatcaatcatgaattgactccgatgttatatcctctcattataagttccgttggtatcattgttgtttaatcaccaccttatttgctactgatttctttgagatcaaggctgttaaggaaattgagccatcattgaagaggcaacttatcatctccactgttctcatgactatcggaattgggattgttagttgggtagctcttccatcttcctttaccattttcaattttggagatcagaaagctgtgaagaattggcagctattcttatgtgttgctgttggtctttgggctggcctaattatcggttttgtaaccgagtactacactagcaatgcatacagccctgtacaagacgttgctgattcctgcaggactggagcagcgactaatgttattttcggccttgctttgggttataagtcttgcattattcctatttttgccatcgcaatgagtatttttgttagtttcagctttgctgctatgtacggcattgctgttgctgtccttggaatgctgagcaccatagctactggattggctattgatgcttatggtcccatcagtgataatgctggaggcattgctgagatggctggcatgagccacagaattcgagagagaactgatgctcttgatgctgcaggaaacaccactgctgctattggaaagggtttcgccattggttcagcagcccttgtgtcccttgccctctttggtgcctttgtgagccgtgctgctatttcaacagttgatgtattgacccctaaagtttttattgggttgcttgtcggggcaatgcttccttactggttctctgctatgaccatgaagagtgtgggaagtgctgctttgaagatggttgaggaagtgcgtcggcaatttaacacgatcccaggtctcatggagggcactgctaagccagactatgctacctgtgttaaaatctctactgatgcttccatcaaagaaatgatcccacctggtgcgctagttatgctcacaccccttattgttgggatcttttttggtgtggaaactctctccggtgtccttgctggatccctcgtctctggcgtccagattgctatctccgcatcgaacacagggggtgcttgggataatgctaagaagtatatcgaggccggtgcttcagaacatgcaagaactcttggtcccaaaggatcagaaccacataaggcagctgttatcggtgacaccattggggaccctctaaaggatacatccggaccatcactgaacatcctcatcaagctaatggctgttgaatcacttgtctttgcacccttcttcgctacacacggtggactgcttttcaagatattttaagtaaaagaacacaaaaacggttacagtctctgccggttctcttccaaatctccttttttttctcaagtatagttttagtgtgtagcacattttgacaatatcctcttaaaggttgaatctatagcgaaaattttcccttgcaaaaggttgacaatgaaatcaatgatgatgatgactatgataatggtcaatctagaaaagagttcagaactgtattgtcactttcttttgttctatggaagaaggcgttttgtttgtattgctgtgaaattcatgttataaattgcaggcaaaactcaacatttgaatgtatg

SEQ ID NO: 3784 - DNA, 2593 bp, Solanum phureja
ttcctttttgttgtgtggttatatagaaagtgaagtattcaagaaagttgaaaaagtgtgagagatgggtttgatgagtgaggccttaacacagattctgatacctttagctgcttttattggcattggttttgctctgcttcagtggtttttggtctcaaaggtcagagtctccagtgggtcaaacttggtaagtgaatacaatgacaagttgattgaagaagatgaacaagaagaagggattgattctgatgatgttgttgccaagtgtgctgacattcaaaaagccatttctgaaggggcaacatccttcctgtttacggagtacaagtatcttggcatattcatggtggtatttggagcaatcatttttctcttccttggatcagtaaaaagtttcagcacagaaagtgagccttgcactttcaacaaagaaaaaatttgcaaaccagctttagccaatgctttctttaccaccattgccttctttctgggaggcctaacttcagccctctctggcttccttggaatgaaaatcgcaacgtatgccaatgcaagaacgactctggaagcaaggaaaagcattgggaaggccttcattatagcttttcgctctggtgcagttatgggattccttcttgctgccaatggcctcttagttttatatatctctatcaacttatttaagctgtactatggagatgattgggagggtctgtatgagtctattactggttacggtcttggaggatcttcaatggctctctttggaagagttggtggaggtatatatacaaaagcagcagatgttggtgctgatctagtaggcaaagttgaacgtaatattcctgaagatgatccccgcaacccagctgttattgcagacaatgtaggtgataatgtaggggatattgcaggaatgggctcggatctattcggttcctatgctgagtcatcatgtgcagcactgtttgttgcatccatttcatcctttggtagtagccacgactactcggctatgtcttatcctctgattatcagctcaatgggaattgttgtttgcttgataacgactctttttgcaaccgatatgtttgagataaagaatgtgactgagattgaaccatctttgaagaggcaacttctcatctcaactgttctgatgactgttggaattgcttttgtcagtttctttgctttgccatcagaattcactattttcgattttggatccgagaaagtggtgaagaactggcacctattcttttgtgtttcaattggtttatgggctggcttggtcattggttatactactgaatattacactagcagtgcttacagtccagtacaagaagtggcagattcttgcaagactggtgctgcgacaaatgtaatatttggattggctcttggatataaatcggttatcattcccatatttgccattgctgcttctatatacgtgagcttcagcttagctgctatgtatggcattgcagtcgctgctctgggaatgcttagcactatagccactgggctcgcaatagatgcttatggccctatcaacgacaatgctggtggtattgcagagatggctggaatgagccatagcattcgtgaaagaactgatgctcttgatgctgctgggaacacaacagctgcaattggcaagggttttgcgattggatcagctgcacttgtatctcttgctttgtttggtgcctacgtgagcagagctggtatcaaaactgtcgatgtcttatcacctaaggtcttcattggtttgctagtaggagcaatgcttccgtattggttctcagccatgacaatgaagagtgtaggcagtgcagctctgaaaatggttgaagaagttcgcagacaattcaatagtatcccagggctaatggaaggaacagcaaaaccagactatgcaacttgtgtcaaaatctcaactgatgcttcactcaaagagatgatcccaccaggtgctttagtcatgttaacacctcttattgctggtaccttttttggagtggaaacactagctggtgtgctcgctggttctctcgtttctggtgttcaagttgctatttcagcttcaaacacgggaggagcatgggataatgccaagaagtacatagaggctggtgcaacagaacatgctagatcattaggaccaaaaggatcagatgcacacaaagctgcagtaattggagatacagttggtgatccattaaaggacacttctggtccatcattgaatatactgatcaagcttatggctgttgaatctttggtgtttgctcctttctttgctactcatgggggactcctattcaagttactgtagaatgagcctctttgtacaaaaacatatttctccaaataaacatagagttattctgtctagacaaattctttttacttgtcatttttttgagaagtgagtattatttccacacataacatttcttgggaaaattattgtataggtaatccgtaattaccttacagaaaaataataattggggctaagcttttcaaaatttcttaatagaagtatttttatttcaataaaaaggtgtattaagca

SEQ ID NO: 3785 - DNA, 2782 bp, Malus domestica
gatccaaacccaataaaatataatctgggtttggataacgcagttgtaatatatataattttaagattttaagaggttgcagttcaaaacccaccaagcattttcttcttttctttgctatataaatatcttagatatacccagagaattattgaaggaaccaactgttgtgtgtgaagtttttggaagatgggtttgctgagtgagggactgactcaggtggtgattcctttggctgcggttgtggggcttggttttgctttgctgcagtggtttttggtgtcaaaggtgaaggtctctggcgggcatggtgagcgaaatgggttcaaggacaagctcattggagatgaagaagagggtgttagctccgttgaggttaccatcaagtgtgctgagattcaacatgccatttccataggggcgacctcttttctgttcacccaatacagatacctcagcattttcgtcggtgtttttagcaccataatcttcctcttccttggctcagtgaagggttttagcactaaaagcgaagcctgcacatataacacaggcaatatgtgcaaaccggcattagccaacgccttctttagtactattgccttcttgcttggtgcttttacatccgtcctctctggatttctcgggatgaagatcgcaacgtatgccaatgctagaacaactctagaagcaaggaggggtgttgggaaggctttcattaccgcctttcgctcaggtgctgtgatggggttccttcttgctgccaatggcctattggtgctgtatatcactatcaatttgtttaagttgtattatggggatgactgggaaggactatatgagtcaattactggttatggacttggaggttcttcaatggcactctttgggagagttgggggaggtatatacacgaaagctgctgatgttggtgctgatcttgtcgggaaagttgaacgaaatatccctgaagatgatccacgaaaccccgccgttattgcagacaatgtgggtgacaatgtaggagacattgccgggatgggatctgacctgtttggatcttatgccgagtcttcttgtgcagcattgtttgttgcatccatatcatcctttggcatcggtcatgactacaccgccatgtcgtatcctttgatcataagctcaatggggattgtggtttgtttggtaacaacccttttcgcaaccgatctgtttgaaatcaagaaagtcagtgagatcgaacccgccttgaagcgtcaactcctcatctcaaccgtctttatgactgctgggatcgccgctgtcactttcgtatctttgccatcagaattcactctcttcagctttggaaccaataaggctgtcaaaaactggtacctcttcttttgtgtatcaatcggactgtgggctggtcttgttattggatacaccacagagtattacactagcaatgcttacagtccggtgcaggatgtggcagattcatgcaggactggtgctgcaacaaacgtgattttcgggctggctcttggttacaaatcagtcatcattcctgtgttcgccattgcgtttgctatctacgttagctttagcttggctgccatgtatggaatagctgtggctgctctgggaatgctcagcactatctccacaggtcttgcaattgatgcttatggccccataagcgacaatgctggtgggattgcagagatggccgggatgagccacaagatacgcgaaagaacagatgctttagatgctgcaggaaacacaactgctgctattggcaagggttttgctattggatcagctgctcttgtttctcttgcattgtttggcgcctatgtcagcagggcgggaatagagaccgttgatgtgttgacaccgaaagtcttcattggcttgattgtgggagctatgcttccgtactggttttccgccatgacaatgaagagtgtgggaagtgctgcactcaaaatggtcgaagaggttcgcaggcagttcaatactatcccggggctcatggaaggaacagcaaagccagattacgcaacttgtgtcaagatttctaccgatgcttccctaagggagatgatcccaccaggcgccttggtcatgcttacaccactcgttgccggtaccttctttggagtcgaaactcttgcagggattcttgcaggttcacttgtttccggcgtgcagattgccatttctgcatccaacaccggcggggcatgggataatgcaaagaaatacatagaggccggcggttcagaacatgctaaatcactaggtccgaagggttcggaaccccacaaggcggcggtcataggcgatacgattggagatccgctcaaggacacttcaggtccttcactcaatattctgatcaagctcatggcagttgagtccttggtgtttgctcctttctttgcagctcatggaggcctcctcttcaaatggctttgaaaatggagctgcagcacggtcaaattaaccgttcaagatggagctttttactctaattagttgtttcatgttgttaagtaaaagctatatatttatggcttcgttaatcccaattttactagaactacatatgtaattttactagaactgtatatgtgtgtgtgcgcgcgcgcatgttactctatgttgcatgtcaatgcatatccacaatcttggttatgtgtgtatctctttctgtttaaagaaattttttctagttgtccaggaataattaggagattttctataaaatatatgagcaagtgctttttct

SEQ ID NO: 3786 - DNA, 2733 bp, Sorghum bicolor
aaaagaccgaaagagagagcacactgcaactgcacacgcacgctgaccctccgctctgcacgagctcgtcgagcgcaagcttcagagttcacacgcacccccaggccactcacttcacttctttccgccgccacaagtgtacagtacaggccaggtccgatcatggcgatcctgtcggaggtcgccaccgaggtgcttatccctctcgccgcggccgtcggcatcgccttcgccgtcgcgcagtgggtcctcgtctcgcgcgtcaagctggctccatcgtccggacgcgacaaggacgtgctcgccgagtcgctgatcgaggaggaagaggggctgaacgaccacaacgtggtggtgcggtgcgccgagatccagtgcgccatcgccgagggcgcgacgtcgttcctcttcaccgagtaccggtacgtgggcgccttcatgtgcgtcttcgccgccgtcatcttcgtcttcctcggctccgtcgacgggttcagcacccagagccggccctgcgcgtacagcgagggcaaacagtgcaagcccgcgctgttcaacgccgtcttcagcaccgtcgccttcctgctcggcgccgccacctccgtcgtgtcggggttcctcggcatgaaggtcgccacgtacgccaacgcccgcaccacgctcgaggccaggaagggcgtcggcagggcctttgtcaccgcgttccggtccggcgccgtcatgggcttcctgctcgcgtccagtggcctcctcgtgctctacgtcgccatcaacctgttcaagctctactacggcgatgactgggaagggctgttcgagtccatcaccggctatggcctcggtgggtcttccatggcgctgttcggaagggtcggtggcggcatctacaccaaggcggccgacgtcggcgcggaccttgtcggcaaagttgagaggaacatccctgaagatgatcccagaaaccctgctgtgatcgccgacaacgtcggagacaacgtcggcgacatcgccgggatgggatcagatctcttcggctcatacgccgaatcctcctgcgccgccctcgtcgtggcatccatctcctcgtttggtgtcagtcatgacttcaccgggatgtgctacccgctgctggtgagctccgtcggcatcgtcgtctgcctcgtcaccacgctcttcgcaaccgacttcttcgagatcaaggacgtcaaacagatcgagcctgcactgaagaagcagctcatcatctcgacggcgctgatgaccgccggcatcgcgctcatcacttggctggcactccctgctaacttcacaatcttcaatttcggtgaacagaaggaagttagcaactggggattgttcttgtgtgttgcaattggtctctgggctggtttgatcatcggatacgtcacggaatactatacgagcaatgcatacagccctgtgcaggacgtggccgacgcctgcagaaccggcgcggcgaccaacgtcatattcgggctggctctgggatacaagtcggtgataatccccatcttctccatcgccgtcggcatctacgtcagcttcaccgtcgcggcgatgtacggcatcgccgtggcggcactcggcatgctgagcacgatcgcgacgggcctctccatcgacgcgtacggccccatcagcgacaacgcgggcggcatcgcggagatggcagggatgagccacaggatccgcgagcggaccgacgcgctcgacgcggccgggaacacgacggccgccatcggcaagggcttcgccatcggctccgccgcgctggtgtcgctggcgctgttcggcgcgttcgtgagcagggcgggcgtgaaggtggtggacgtgctgtccccgaaggtgatcatcgggctggtgacgggcgcgatgctcccgtactggttctcggcgatgacgatgaagagcgtgggccgggccgcgctggagatggtggaggaggtccggcggcagttcgccaccatcccggggctgatggaggggacggggaagcccgactacgcgcggtgcgtgaagatctcgacggacgcgtcgatccggcagatggtcccgccgggcgcgctggtgatgctgacgccgctggtggtgggcacgctgctgggcgtgcacacgctggccggggtgctcgccggcgcgctggtgtccggggtgcaggtggccatctccgcctccaacacgggcggcgcgtgggacaacgccaagaagtacatcgaggccggggccagcgagcacgcccggtcgctggggcccaagggatccgactgccacaaggccgccgtcatcggggacaccatcggcgacccgctcaaggacacgtcgggaccctcgctcaacatcctcatcaagctcatggctgtcgagtccctcgtcttcgcgccgttcttcgccgcccacggcggcatcctcttcaagctcttctagattgctgctgctctggtgtgactgggtctgggacctgcggatgacctgagatttgctccggcgcgtgtagtgtcaataaatttaaaccctcgataaagagaacggcacgattccttgtgcttgtacgtactagtatccctacatttgtaaatagcttacttgtaaggtcgccttgcagtgtgtaagaacctgaggtttagctttgtgaagttgtgtagctttttccggcattgctcgtcctcctacagtacagagtgaccagatggtgttcatctataactttgcgtgttt

SEQ ID NO: 3787 - DNA, 2840 bp, Solanum lycopersicum
gtttcctttttcttgtgtggttatatagaaagtgaagaattcaagaaagttgaaaaagtgtgagagatgggtttgatgagtgaagccttaacacagattctgatacctttagctgctattattggcattggttttgctctgcttcagtgggttttggtctcaaagatcagagtctccagcgggtcaaaattggaaagtgaatacaataacaagttgattgaagaagatgaacaagaagaaggtattgattctgatgatgttgttgccaagtgtgctgacattcaaaaagccatttctcaaggggcaacatccttcctgtttacggagtacaaatatcttggcatattcatggtagtatttggagcaatcatttttctcttccttgggtcagttaaaagtttcagcacagaaagtgagccttgcactttcaacaaagaaaatatttgcaaaccagctttagccaatgctttctttaccaccattgccttcttgctgggaggcctaacttcagccctctctggtttccttggaatgaaaatcgcaacatatgccaatgcaagaacgactctggaagcaaggaaaagcattgggaaggccttcattacagcttttcgctctggtgcagttatgggattccttcttgctgccaatggcctcttagttttatatatctctatcaacttatttaagctgtactatggagatgactgggagggtctgtatgagtctattactggttatggtcttggaggatcttcaatggctctctttggaagagttggtggaggtatatatacaaaagcagcagatgttggtgctgatctagtaggcaaagttgaacgtaatattcctgaagatgatccccgcaacccagctgttattgcagacaatgtaggtgacaatgtaggggatattgctggaatgggctcggatctattcggttcctatgctgagtcatcatgtgcagcactgtttgttgcatccatttcatccatcggtagtaaccacgattactcggctatgtcttatcctctgattatcagctcaatgggaattcttatttgcctgataacgactcttattgcaaccgatatgtttgagataaagaatgtgactgagattgaaccatctttgaagaggcaacttctcatctcaactgttctgatgactgttggaattgcttttgtcaatttctttgctttgccatcagaattcactatttttgattttggatccgagaaagtggtgaagaactggcacctattcttctgtgtttcaattggtttatgggctggcttggtcattggttatactactgaatattatactagcagcgcttacagtccagtacaagaagttgcagattcatgcaagactggtgctgcgacaaatgtaatatttggattggctcttggatataaatctgtcatcattcccatatttgccattgccgcttctatatacgtgagcttcagcttagctgctatgtatggcattgcagtagctgctctgggaatgcttagcactatagccactgggctcgcaatagatgcttatggtcctatcagcgataatgctggtggtattgcagagatggctggaatgagccatagcattcgtgaaaggactgatgctcttgatgctgctggaaacacaacagcagcaattggcaagggttttgcaattggatcagctgcacttgtatctcttgctttgtttggtgcctacgtgagcagagctggtatcaagactgtcgatgtcttatcacctaaggtcttcattggtttgatagtaggggcaatgcttccatattggttctcagccatgacaatgaagagtgtgggaagtgcagctctgaaaatggttgaagaagttcgcaggcaattcaacagtatcccagggctaatggaaggaacagcaaaaccagactacgcaacttgtgtcaaaatctcaacagatgcttcactcaaagagatgatcccaccaggtgctttagtcatgttaacacctcttattgctggtaccttttttggagtggaaacactagctggtgtgctcgctggttctctcgtttctggtgttcaagttgctatttcagcttcaaacacgggcggatcatgggataatgccaagaagtacatagaggctggtgcaacagaacatgctagatcattaggaccaaaaggatcagatgctcacaaagctgcagtaattggagatacagttggtgatccattaaaggacacttctggtccatcattgaatatactcatcaagcttatggctgttgaatctttggtgtttgctcctttctttgctactcatgggggacttctattcaagttactgtagaataaacctctttgtacaaaaacatatttctccaaataaacatatagttattctgtctagactacttgtcatttgttgagaaggtgagtattatttccacacataacatttcttgggaaaattattgattgtataggtaaattaccttacagaaaaataattattggggctaagcttttcaaaatttctttgtagaagtatttttatttcaataaaaagttgtattaagcatccagtcttttcttgttttgaaaagttaattctcatgtttactttttctaatcttctttaataacataaaaatgaaaaaacaattggtaaacacacaggaaaaaatgtaggtgagtaagttgagcggattacagtatattcctttgtgtatgccatccctcatctttttttgcccaaattcaacaataataattcatcgagagtaggaagtacataaatctttttctatttttatgagaagtagagagattgttttt

SEQ ID NO: 3788 - DNA, 2583 bp, Solanum lycopersicum
gtttcctttttcttgtgtggttatatagaaagtgaagaattcaagaaagttgaaaaagtgtgagagatgggtttgatgagtgaagccttaacacagattctgatacctttagctgctattattggcattggttttgctctgcttcagtgggttttggtctcaaagatcagagtctccagcgggtcaaaattggaaagtgaatacaataacaagttgattgaagaagatgaacaagaagaaggtattgattctgatgatgttgttgccaagtgtgctgacattcaaaaagccatttctcaaggggcaacatccttcctgtttacggagtacaaatatcttggcatattcatggtagtatttggagcaatcatttttctcttccttgggtcagttaaaagtttcagcacagaaagtgagccttgcactttcaacaaagaaaatatttgcaaaccagctttagccaatgctttctttaccaccattgccttcttgctgggaggcctaacttcagccctctctggtttccttggaatgaaaatcgcaacatatgccaatgcaagaacgactctggaagcaaggaaaagcattgggaaggccttcattacagcttttcgctctggtgcagttatgggattccttcttgctgccaatggcctcttagttttatatatctctatcaacttatttaagctgtactatggagatgactgggagggtctgtatgagtctattactggttatggtcttggaggatcttcaatggctctctttggaagagttggtggaggtatatatacaaaagcagcagatgttggtgctgatctagtaggcaaagttgaacgtaatattcctgaagatgatccccgcaacccagctgttattgcagacaatgtaggtgacaatgtaggggatattgctggaatgggctcggatctattcggttcctatgctgagtcatcatgtgcagcactgtttgttgcatccatttcatccatcggtagtaaccacgattactcggctatgtcttatcctctgattatcagctcaatgggaattcttatttgcctgataacgactcttattgcaaccgatatgtttgagataaagaatgtgactgagattgaaccatctttgaagaggcaacttctcatctcaactgttctgatgactgttggaattgcttttgtcaatttctttgctttgccatcagaattcactatttttgattttggatccgagaaagtggtgaagaactggcacctattcttctgtgtttcaattggtttatgggctggcttggtcattggttatactactgaatattatactagcagcgcttacagtccagtacaagaagttgcagattcatgcaagactggtgctgcgacaaatgtaatatttggattggctcttggatataaatctgtcatcattcccatatttgccattgccgcttctatatacgtgagcttcagcttagctgctatgtatggcattgcagtagctgctctgggaatgcttagcactatagccactgggctcgcaatagatgcttatggtcctatcagcgataatgctggtggtattgcagagatggctggaatgagccatagcattcgtgaaaggactgatgctcttgatgctgctggaaacacaacagcagcaattggcaagggttttgcaattggatcagctgcacttgtatctcttgctttgtttggtgcctacgtgagcagagctggtatcaagactgtcgatgtcttatcacctaaggtcttcattggtttgatagtaggggcaatgcttccatattggttctcagccatgacaatgaagagtgtgggaagtgcagctctgaaaatggttgaagaagttcgcaggcaattcaacagtatcccagggctaatggaaggaacagcaaaaccagactacgcaacttgtgtcaaaatctcaacagatgcttcactcaaagagatgatcccaccaggtgctttagtcatgttaacacctcttattgctggtaccttttttggagtggaaacactagctggtgtgctcgctggttctctcgtttctggtgttcaagttgctatttcagcttcaaacacgggcggatcatgggataatgccaagaagtacatagaggctggtgcaacagaacatgctagatcattaggaccaaaaggatcagatgctcacaaagctgcagtaattggagatacagttggtgatccattaaaggacacttctggtccatcattgaatatactcatcaagcttatggctgttgaatctttggtgtttgctcctttctttgctactcatgggggacttctattcaagttactgtagaataaacctctttgtacaaaaacatatttctccaaataaacatatagttattctgtctagactacttgtcatttgttgagaaggtgagtattatttccacacataacatttcttgggaaaattattgattgtataggtaaattaccttacagaaaaataattattggggctaagcttttcaaaatttctttgtagaagtatttttatttcaataaaaagttgtattaagca

SEQ ID NO: 3789 - DNA, 2441 bp, Euphorbia peplus
ttttacagacaacccttttctgcattctgtttatattttgttttggagtgttcagaatttgcctatgttgttcgggaacccctcttgagtagcatttatgcgttgagcgtttgtccgtgttcgtgttgatttgatcagtttgtttctgtttctgtttccgtgcaacataagaaatggcagtgttgagtgaaggattgactcagattgtgatagttttatcttcggttgtcgggatcgtgtttgctttgattcaatggtacctcgtgtcgaaagtgaaggtttctggtgaatctgagaatggtttccatgatagtttgattgctgaggaagaagatgggactaataatgatgaggcttctatcaaatgtgctgaaattcagaatgctatttctgttggtgcaacctcattcttgttcactgagtacaaatatctcagcatcttcaccggaattttcagcatcattatcttcctcttccttggttctgtcaaaggattcagcacacaaagtgaaccttgtacatacaacaaaggaaacatttgcaagccagccttagccaatgccttctttaccacacttgctttcttgcttggtgctattacctcggtcctttcgggttttctaggcatgaaaattgctacttatgctaatgccagaacaactcttcaggcaaggagaggtgttggtcatgccttcatcacggcttttcggtccggggcagtcatgggtttccttttagctgctaatggtctgttggtgctctttgtgaccattagcttgtttaaactctactatggagatgattgggaggggctttatgagtccataaccgggtatggtcttggtggttcatcgatggctctctttggacgcgttggtggtggtatatatactaaggcagctgatgttggtgctgatcttgttgggaaagttgaacgaaacatccccgaagatgatcctagaaatcctgctgttattgcagataatgtgggtgacaatgtaggagacattgctggtatgggttctgatctattcgggtcgtatgctgaatcatcttgtgctgcactttttgttgcatcaatttcatcatttggtataagccatgactatactgctatgttgtatccattgatcataagttcaatgggaattgttgtttgcttgatcactacacttttcgcaactgatctgtttgagatcaagaacgtaaatgaaatcgaaccatcattgaaacgacaacttcttatctctaccattttgatgactgctgggattgccatggtcagcttcttagctttaccatcagaatttactctctttgatttcggaaccgagaaggctgttaagaactggcatcttttcttctgtgtttcaattggattgtgggctggactcgtgattggatacacgactgagtactatactagcaatgcttacagtccggtgcaggatgtagcagattcttgcagaacaggagctgcaacaaacgttattttcgggttggctttgggatacaaatcggtcatcattccaatattcgccattgcagttgctatatatgttagctttagcatggctgctatgtatggaatttcagtggctgctttaggaatgctcagtactattgccaccggtcttgcaattgatgcttacggaccaatcagcgacaatgctggcggaatagccgaaatggcaggaatgagtcgtaaaattcgcgaaagaacagatgctctagatgctgcaggaaacaccactgctgcaattggcaagggttttgcaataggatcagcagctctagtgtcccttgctttgtttggtgcctttgtgagcagagcaggaatcaaatctgtggatgtattaaccccaaaagtattcattggactactcgtaggcgctatgcttccatactggttttcagctatgacaatgaaaagtgtggggagtgcagctctgaaaatggtggaagaagtccgtcggcaattcaatacaattccaggattaatggaaggaagagttaaaccagattatgctaattgtgtcaaaatttcaactgatgcttcacttagagagatgattccacctggtgctttggtcttgctttctcctctcattgccggcacctttttcggtgttgaaactctttctggtctccttgctggttctcttgtttctggtgttcaggttgctatctcagcttcaaacacaggaggggcatgggacaatgctaagaaatacattgaggcaggagtatcagagcatgcaaaatcactggggccaaagggatcagatgcacacaaagcagcagtgataggagacacagtaggagatccattaaaggatacatcagggccttcactaaatatattgatcaaacttatggctgttgagtctttggtttttgcacctttctttgctgctcatggtggcctcttgttcaaactt

SEQ ID NO: 3790 - DNA, 2529 bp, Cleome spinosa
agtgccattcttctacttcatctctctccttctttctatccgctcggtgcagctttctctctcctctgattcaggagtgtacggacgccggagagggatggttgaggtggcgttgttaccggagattgggacggaggtcgtggtgccgttgtgcgccgtgatcgggatcgtgttctcgctcgtccagtggttccttgtctcgcgcgtgaagcttactaccgacggaggctcgtcgtccggcggagccaacaagggcaagaacggatatgacgactacctcatcgaggaagaggaaggggcaacgaccagagcgttgttgccaagtgcgccgagatacagaacgctatatctgaaggtgcaacctctttccttttcactgagtacaaatatgttggagccttcatggttggctttgccattcttatcttccttttccttggctctgtggagggcttcagcagtaagagccagccttgcacttatgacaaaacaagaatgtgcaagcctgccctcgccactgcagccttcagcactatctccttcttactcggtgccgtgacctctctcctctctggctttctcgggatgaagattgccacatatgccaatgctagaaccaccttggaagcaaggaaaggtgttggaaaggcattcattactgcattcaggtctggtgctgtgatgggtttccttctcgcagcaaatggtcttttggtgctctacattgctataaatctcttcaagttgtactatggcaatgactgggagggtcttttcgaggctattactggatatggtcttggtgggtcgtccatggctctctttggtagggttggtggtggaatctacactaaggcagcggatgtgggtgctgaccttgttgggaaagtagagaggaatattccagaagatgacccgagaaatccagctgttattgctgataatgttggtgacaatgtcggagacattgccggcatgggctccgatctctttggttcatacgccgaatcatcttgtgctgctcttgtcgttgcttcaatctcatcttttggattggaccatgattttactgccatgtgctacccgttgctcatcagttcgatgggaatcttggtttgtttgatcacaacactctttgcaactgacttcttcgagatcaaggctgtcaaggagattgaaccggctttgaaatggcaactcatcatctcaaccgctataatgactatagggattgctatagtgacatgggttgggttgccgtcatccttcaccatctacaacttcggaacgcagaaagtcgtgaagaactggcagctattcttgtgtgttggtgttggactttgggctggactcatcattggttttgtcactgagtactacactagcaatgcgtacagccctgtccaagatgtcgcagattcatgcaggactggagcagcgaccaacgtgatatttggacttgctctgggatacaaatctgtcataattccgatctttgctattgctgccagcatctttgttagcttcagctttgctgcaatgtatggcattgctgttgctgctcttggaatgctcagcaccattgccactggtttggcaattgatgcctacggtcccatcagtgacaatgccgggggtattgctgagatggctggcatgagccaccgcatccgtgaaagaaccgatgcccttgatgcagccggaaacaccactgccgccattggaaagggttttgccatcggatctgctgctctcgtgtctcttgcactctttggcgccttcgtgagccgggcagcgatccaaaccgtcgatgtattgacccctaaagttttcatcggactgctggtgggagccatgcttccgtactggttctctgccatgacaatgaagagtgtgggaagtgcggctcttaagatggtcgaagaagtgcggagacagttcaacaccatcccgggactcatggaaggtactgctaaacctgattatgccacgtgcgtcaagatctccaccgacgcatccatcaaggagatgcttccacccggtgccctcgtcatgctcactcctctcattgtcggaaccctctttggcgtcgagaccctatctggtgtcctggctggctcccttgtttctggagtccagattgcgatatctgcatctaacactggtggtgcctgggacaatgccaagaagtacattgaggcgggggtatcggagcatgcgaagagccttgggccaaaggggtcagagccacacaaggcggctgtaataggagacaccattggagatccactaaaggacacatccggtccgtctttgaacatcctcatcaagctcatggccgtcgagtctctcgtctttgctcccttcttcgccacccatggtggcctcctcttcaagatcttctgaactcaaccccacctttgaagaagatgatgatgaagaatgttgattcagggccctctggttaaccttttttgatgggctcgttaaggagatgttttcccgttttagattctacgaaaccccccc

SEQ ID NO: 3791 - DNA, 2215 bp, Malus domestica
aggagcaacctcgttcctcttcacggaatacagatatgtaggtgctttcatggttgcttttgcaatcttgatcttcctttccttggatccgtcgagggatttagtacaagtagccgtgcatgtacatatgaccaaaccaagatgtgcaaaccagctctcgccactgccatcttcagcaccatttcctttttgcttggtgctgtaacttcagtggtttctggattccttgggatgaagattgctacttacgcaaatgccagaacaacgttggaggcaagaaaaggtgttgggaaggcttttattactgcatttagatcaggagctgtgatgggctttctcctcgcttcaagtggtctgttggttctttacattgctatcaatgtcttcaagttgtactacggtgatgactggggtggtcttttcgaggctataactggttatggtcttggtggatcttccatggctctctttggcagggttggtggaggcatctataccaaagctgctgatgttggtgcagatcttgtcggcaaggttgaaagaaatattcccgaggatgacccaaggaacccagctgtgatagctgataatgttggcgacaatgttggagatattgctggcatgggatctgatctttttggatcctatgctgagtcatcatgtgctgcccttgtggttgcttccatttcctcatttgggatcaatcacgagctaactgcaatgctatatcctctcattgtcagttccatcggcatccttgtttgtttgctcactaccctatttgcaaccgatttctttgagatcaaggctgtaaaggaaattgagccaacattgaagaggcagctcataatctccactgtactcatgaccgttggagttgcgattgctacatggatatctgttccatcttccttcacaatcttcaatttcggaacacagaaagttgtgaagaactggcagctattcttatgtgtctgtgttggtttgtgggctggccttatcattgggtttgtaacagagtattatacaagcaatgcgtacagccctgtgcaagatgttgctgattcttgccggactggagctgcgaccaatgtcatttttggccttgcattgggatacaaatccgtcattattcctatttttgccattgcagtcagcatttttgttagttttagctttgcagctatgtacgggattgccgtagctgcccttggaatgctgagcaccattgcaactggattagcgattgatgcatatggtcccatcagtgacaatgctggaggcattgctgagatggcaggcatgagccacagaatcagagagagaactgatgctcttgatgctgcaggaaacaccactgctgctattggaaagggatttgcaattggctctgctgctcttgtgtcccttgctctatttggtgcctttgtcagccgtgctggtatcaaaacagttgatgtgttgaccccgaaagtgattattggtttgttagtgggcgcaatgcttccgtattggttctctgccatgacaatgaagagtgtgggaagtgcagctctaaagatggttgaggaagtgcgccggcaattcaataccattcccggtctcatggagggcactgccaagccggactacgctacatgtgttaagatttcgactgatgcttccatcaaggaaatgatcccgcctggtgcccttgtcatgcttacacccctcattgttgggatcttttttggtgtggaaactctcgctggagtgcttgctggatcccttgtctccggtgtacagattgccatttctgcgtccaacacgggcggtgcctgggataatgccaagaaatacattgaggctggtgcgtcggagcatgcaaggacccttggtccaaaaggatcagaatgccacaaagctgctgtcatcggtgacaccattggagaccctctcaaggatacatctggaccgtcgctcaacattctcatcaagctcatggccgttgagtctcttgtgtttgctccgttctttgccacacacggtggcctgcttttcaagatttaagttgaaaacggtgcaacagaaacccggaagttgttcctctccgttcatctgctgatccttccttccaatctcctccgcgaaataatagaagatgggactcaaattagtaaccaacgggagaattgacagacaaattttttcctttctgaaggagggtttatgatga

SEQ ID NO: 3792 - DNA, 2446 bp, Lippia dulcis
gcgctgagatccagagagctatctccgacggtgcacatctttcctctttactgatatcagtatgtgggtattttctatgttgcttttgtcaatcctcatcttcctgttccttggttcagttgagggtttcagcacaaagagccagttctgcacttatgacaaagagaagttgtgcaagcctgcccttgccactgccatctttagcactgtatccttcttgcttggtgctgttacctccctcatttctggtttccttgggatgaaaattgcaacatatgcaaacgcaaggacaacgttggaagctagaaaaggtgtagggaaagcttttattactgcatttaggtctggtgcagtcatgggttttctccttgctgcaaatggtctattggttctttatattactatcaatctattcaagatctactatggtgatgattgggaaggactttttgaatctattactggatatggtcttggtgggtcctccatggccctgtttgggagagttggaggtggtatttacaccaaggctgctgatgttggtgctgatcttgtaggaaaagttgaaaggaatattcccgaagatgaccccagaaatcctgctgtgatagctgacaatgttggtgataatgtaggagatattgccggaatgggatctgatcttttcggttcatatgctgaatcatcatgtgcggctcttgttgtggcatctatatcttcttttggaatgactcttgactttactgcaatgtgttatccactgctcattagttccatgggaatactggtctgcttaattaccactctttttgctaccgacttttttgagatcaaggctgtcaaggaaattgagccagcattaaaaaatcaacttattatctcaactgctcttatgactgtgggaatagcaattgtcacatggacttgcttgccgtcatcctttacaatcttcaattttggtactcagaaagttgtgaagaactggcaacttttcctctgtgtttgtgttggcctttgggccggacttatcattgggtttgtcactgaatactacaccagcaatgcttacagccctgtgaaagatgttgctgattcctgcagaactggtgctgccaccaatgtaatatttggtttggccttgggatacaaatccgttataattccaatttttgccattgcagtcagcatttttgtcagtttcacttttgctgctatgtacggaattgcggttgctgctttaggaatgctgagcactattgcaactggattggctattgatgcttatggtccaatcagtgataatgctggaggtattgctgaaatggctggtatgagccacaaaattcgtgagaggacggatgcccttgatgctgctggaaacaccaccgctgcaattggaaagggctttgccattggatctgctgcacttgtttcattggcactttttggcgcctttgtcagcagggctaatatttcaactgttgatgttctgacacctaaagtcttcatcggtttaattgtgggtgctatgctcccatactggttttcagccatgaccatgaagagtgttggtagtgcggctttgaaaatggttgaggaagtccgcaggcagttcaacactattcctggtattatggagggcctttcgaagcctgattatgctacatgtgtcaagatttcaactgatgcatctatcaaggagatgattccgcctggtgcccttgtcatgcttacccctctaattgtgggaaccttttttggtgttgagacgctctctggcgttcttgctggttctctcgtttctggtgtccagattgctatatctgcatccaacactggtggtgcttgggacaatgctaagaaatatattgaggctggtgcttcagaacatgccagaacccttggaccaaagggatcagagccacacaaggcagctgtcattggtgacaccattggagaccctcttaaggatacatcaggtccttcactaaacatccttatcaagcttatggctgtcgaatccctcgtgtttgctcctttcttcgccacccatggtggtcttctatttaagatcttctgaaggagggatggtgttcgggcctcatttctttctccggagccacaatcttcaattttctctggtaattcatcttaattcgcatcctcactctgttttcacatccaatgtctcgctagtgtgagaaatttaagttcggtcattgttagtgagattttgatgttctttttcgatggcgatggtgaatgatgatgaatcatgttaggatcctcattgttgtaatttttagatctcaaatgtattaaatttttaacgtttaagacagtagtcttcgccgctcgttggctgggctagaattttattgttttttttttgctatactccccttccgttggaacagacagatcaacaaatgtaatacataaatta

SEQ ID NO: 3793 - DNA, 2820 bp, Pennisetum glaucum
tcgggcgccatctccgaaggagcaacatcgtttctcttcacggagtatcaatatgttggtattttcatgtcgatcttcgctgttgtcatcttcctctgccttggctcggttgagggattcagcaccaagagccagccctgcacctatagcaagggaaagtactgcaagcccgcactgttcactgcactcttcagcactgcatccttcttgcttggagctatcacctctttggtctctggtttccttggaatgaagatagccacatatgccaatgccagaaccaccctggaagccaggaagggtgttgggaaggcattcattgttgctttccgctctggtgccgtcatgggctttttgcttgcatcaagcggtcttgtggttctctacatcaccattaacgtatttaagttgtactatggtgatgactgggagggtcttttcgagtctatcactgggtatggccttggtgggtcttccatggctctctttggaagagttggcggaggtatctacacaaaggctgctgatgtgggtgctgatcttgttggcaaagttgaaaggaacatccctgaggatgatcctaggaacccagctgtgatcgctgataatgtcggtgacaatgttggtgatattgctggaatggggtctgatctctttggatcatacgcagaatcttcctgtgctgcccttgttgttgcatctatttcatctttcggaatcgaccatgatttcactgggatgtgctacccactgcttgtgagctctgttggcatcatcgtctgcttgatcaccacactctttgccactgacttctttgagatcaaggctgtgaaagaaatcgaacctgcacttaagaagcagctcattatctctactgctctgatgactgttggtattgcgataatcagctggttggcccttccagccaagttcaccatcttcaacttcggtgctcagaaggaagtatccaactggggcttgttcttctgtgtttcaattggtctgtgggctggtcttattattggtttcgttacagaatactacaccagcaatgcatacagtcctgtgcaagatgttgcggattcctgcagaactggtgctgccaccaatgtgattttcggtcttgctctaggatacaagtcagttatcatcccaatttttgctattgctgtcagcatctatgtcagtttctctattgccgcaatgtacggcatagcagttgccgcccttggtatgctaagcacaattgcaactggccttgctattgatgcttatggtcccattagtgataatgctggtggcattgctgagatggctggaatgagccacagaatccgtgagagaactgatgctctcgatgcagctggcaacaccactgctgctattggaaagggatttgccattggatcagctgctcttgtgtccttggccctttttggtgcttttgtcagtagagctggagtgaaggttgtcgatgtcctgtcccccaaggtcttcattggcttgattgttggagccatgcttccgtactggttctctgccatgaccatgaagagtgttggaagtgctgctctgaagatggttgaggaggtccgcaggcagttcaacaccattcctgggctgatggagggaactggcaagcctgactacgctacctgtgtcaagatctctactgatgcttccatcaaggagatgattcccccgggtgctctggtcatgctcactcccctcattgttggaactctctttggtgtggagaccctctctggtgttcttgctggtgccctggtttctggagtgcagattgccatctctgcttccaacactggtggtgcatgggataacgccaagaagtacattgaggctggtgccagcgaccacgctaagtccctgggccctaagggatcggactgccacaaggctgctgtgatcggcgacaccatcggtgaccccctgaaggacacctctggcccatccctcaacatcctcatcaagctcatggccgtggagtcccttgtgttcgcccccttcttcgccacccacggtggcctcatcttcaagtacctgtaagagccacaccaagcgcagcagaagtatacaccgatccatggacatcttgaataactcctgccagattgccagtctgtgtgtcgtgcgcagtgtttgcgccgctgttttttggtctcattgtttcgggattgctgcaactgttcatctttctctttgggggcctcctggaggcattaccgttagccttactcttactgcttgtagctccacgtagaagagaagagatgtgtcctgtgtctggcaaattttcccagtccccttgacgatggcgatgatgttgaaatctttgaacaatgatacgtgattgttgcattgtactggtggcaaatcaaatcgctgttaatggctgccttctgtccattccaaaaaaagacattcaatttgatgaacatccagatacaaagtgtgattcaccatatccttgacaaactcttctctacttgaaatacatttctggttgcgagctgttgattccaactcactgataagatgctgcttccattcaacctgggatgtaattataagaagcactactatcctcaacaccaacagaactctggacagagggtgctgggtagtgggcaactgggcatgcaatgagttcctgggcaactgggcatgcaatgagttcctgcaatggctcctcctacttgttttggcattgatccaaatgatgacaaaaatccttcaacccagagtgtacaaagacaaaaaggcatgtagatacataccaatgacctaaataatctt

SEQ ID NO: 3794 - DNA, 2383 bp, Platanus occidentalis
actctgtgtctggtgtgaacaatgggtgtaaggagaaattattagaagatgaagaagagaatatcgacggtcatgatgttgttgttaagtgtgctgaaattcagaacgccatatctgttggggcaacttcatttctgtttactcaatacaagtacctcagcgtcttcgtggttgtctttagtgccatcattttcctcttccttggctcagtaaagggtttcagcactgagagtgaaccttgcacctataacaaggagagcctatgcaaaccagccctggccaatgccatctttaccacaattgcattcttgctcggcgctttaacctctgttctctcaggcttccttggaatgaagattgcaacatttgctaatgcaagaacgactctggaagcgaggaagggtgttgggaaggcatttattacagctttccgctctggtgctgtgatgggcttccttttagctgccaatggcctcttggttctgtacattgctattaatctcttcaggttttactatgggaatgactgggagggactttatgagtctattactggttatggccttgggggttcttcaatggccctgtttggaagagttgggggaggtatatacacaaaggccgctgatgttggtgctgatcttgttgggaaagttgaacggaatatccctgaagatgacccacgaaatccagctgttattgcagataatgtgggtgataacgtaggagacattgccgggatgggctctgaccttttcgggtcttatgctgaatcgacctgtgctgcactttttgttgcatcaatatcctcctttggcatcaatcatgacttcaccgccatgtcctatcctctgattataagctcagtgggtattgtggtttgcctgattaccacactttttgctactgatctctttgagataaaagaagtgactcagatcgaaccatccttgaagcaacaacttctcatatcgacaatactgatgactgttggaattgctattgtcagcttcgtggctcttccatcccaattcactctcttcaactttgggaaagaaaagacagtaaagaactggtacctcttcatctgtgtttcaattggcctgtgggcagggcttgttattggatacactactgagtattatactagtaatgcttacagtccagtgcaggatgtggctgattcttgcaggacaggtgcagcaacaaatgtcatttttggtctggctctgggatacaaatctgtcattattcccatatttgccattgcggtcgccatttatgtgagcttcagcttgggtgccatgtatggaattgcaatgtctgctctgggaatgcttagcactatttcgactgggcttgcaattgatgcatatgggcccataagtgataatgctggtggaattgcagagatggctggaatgagccacaagatccgtgaaagaacagatgctctggatgctgctggaaacaccactgccgccattggcaagggttttgccattggatcagcagctctcgtgtctcttgctttgtttggtgcctttgtgagcagagctggtatcaaggctgttgatgtgttgactccaaaggttttcattggattgattgtgggggccatgcttccatactggttttcggccatgacaatgaagagtgtcggaagcgcagctctgaagatggtggaagaggttcgcaggcaattcaatacgattccagggctcatggaggggagagccaaacctgattatgcaaactgtgtgaagatctctactgatgcttcactgaaggagatgatcccacctggtgcactggttatgcttacgccactgatagctggaaccttctttggtgtggaaaccctagctggggttcttgctggttcactcgtttctggtgtgcaggttgccatctctgcttctaacactggtggtgcttgggataatgcaaagaaatatatagaggctggcgcttctgaacatgcaagatcactgggtccaaagggatcagacccacacaaggctgctgtgattggagacacaattggagatcccctcaaggacacttctggaccttccctcaacatcttaattaagctcatggctgtagaatcattggtgtttgccccgttctttgcaacccatggtgggatattgttcaaatggctttgagatggagatatttggtagtcagggttgactcggtggagaatttcaaaaatctagctgtgatagtgaccagggtttggccctagatcctagttttaaggttttctggcatataatgatgatctgagtaaactatggtaaaaaacggtatggtctgtctactgtaagttaaccatgtccaacgaatcaaaataacatgtacaaatcaccagtct

SEQ ID NO: 3795 - DNA, 2195 bp, Cephalotaxus harringtonia
gctttgcagttatcatatttttattccttggttcagtcgagaaattcagcacaaaaagtcagccttgcacctacaacaaggatgtgatgtgcaagccagctcttgccaatgctctattcagtaccgtgtctttcttgcttggttcattgacatctgctttatctggttatcttggaatgaagattgcaacttatgcaaatgcaagaacaacattagaagccaggaagggtgttggaaaagctttcattactgcctttaggtctggtgctgttatgggatttttgcttgctgcaaatgggctgttggtgctttatattaccattaatctattcaagttgtactatggcgatgactgggagggtctttttgaagctattactggttatggtcttggaggttcttccatggctctatttggcagagttggtggtggtatttacaccaaagcagcagatgttggtgcagatcttgttggcaaggtcgagaggaacattcctgaagatgacccacgaaacccagcggttattgctgataatgttggtgacaatgttggagatattgctggcatgggatcagatctgtttggttcctatgctgaatcttcatgtgcagctcttgttgtagcatcaatttcatcatttggaacctcacatgagtttactgcaatgtgctatcccttgcttataagttcaatgggcatcattgtttgcttgatcacaaccttatttgcgactgatatatttgagatcaaggccgtgaaggaaattgagcctgcattgaaaaagcagcttataatttctacagtattgatgaccattggaattgctgttgtaagttttgttgcattgccatcatccttcaccattttcaattttggtgaacaaaaggttgtcaaaaactggcatcttttcttctgtgttgctgttggtctatgggctggccttgtaattggttttgtcactgagtactacacaagtaatgcttacagccccgtccaagatgttgccgattcatgcaggacaggagcagcaacaaatgttatctttgggttggcattgggatacaaatcagttattattcctatttttgccattgcagtaagcatatttgtcagttttagtttggctgccatgtatggtattgcggtagccgcactgggaatgctcagtactatcgcaactggattggccattgatgcatatggacccatcagtgacaatgcgggaggaattgctgagatggctggcatgagtcacaggatccgtgaaaggactgatgctctcgatgcagctggcaatactactgctgccattggcaagggctttgcaattggatcagctgcattggtgtcacttgcactgtttggagcctttgttagccgtgcagcgatttcaactgtggacgtcttgactcctaaagtgttcattggtttaattgtgggagcaatgcttccctattggttctctgcaatgacaatgaaaagtgtgggtagtgcagccttgaaaatggttgaagaggttcgcagacaattcaacaccatacccggtctcatggaagggcttgccaagccagattatgcaacttgtgtgaagatatcaactgatgcttcccttaaggaaatgattcctcctggttgccttgtaatgcttacacctctgattgttggtactttctttggtgtggagactctggcaggagttctggcgggtgctcttgtgtccggtgtgcaggttgctatatctgcttcaaacactggaggtgcttgggacaatgcaaagaagtacattgaggctggagcgtcagaacatgccagaacacttggtccaaagggttctgatccccacaaggctgctgtcattggcgacaccattggagaccctttgaaggacacatctggaccatctcttaatattttaatcaagcttatggccgttgagtcgttggtgtttgctcctttctttgcagtccatggtggcttgttctttaagatttagaagtgttccttgggctgtagtaaagcggaatcaattttcttttttgattggtaggtattgaaagcttgccaaaaatgttgtggacggcaagtctatttagataaggctaggttcctagagggtactggttctagttaaatataatttggctacttttcgttcaattttgttaccatttctcatgaaaatataaactatttt

SEQ ID NO: 3796 - DNA, 791 bp, Vitis vinifera
cgcattttccgtctggtggagactgtagagggagagaaatggttttatgggtattcgggtatgggtcactgatatggaaagcagggtttgaatatgatgatcgacgagtttgtttcatcaaagggtaccgtcgtgtcttctaccaaggtagtacagaccacagagggacaccagaatacccaggaagaacagttacattggagcctgctgaaggagagatctgctggggagttgcctacaaggtttccaaggaggaagatgaacagattgcattaacatatctagaagtgagggagaaacagtatgacaagaaggcttatcttgatgtttatgctgagccaatggctactactcctgtcatctctggagtaatggtatacatagcatccccagacaagaaacttaatcgtaactaccttggccctgcatcagttgaagagattgccaaacaaattattcatgctgaaggcccctcaggtcctaacagagaatatcttttccaacttgaacaagcactccttcaaatgggatgtgaagacaaacatgtaatggatctcgcgaatgaagtgaggcgcatcctttcagagaaggagctgactgtttcatgaccccatttaacaatggacaagagaattctgattagaattgaaactcaaaaatgtcctcaaacttttatgagttgataaaatattatttattggatagagaaacattgttgagactcgttgttgaagctctggaaaggcttatatcaataatatctcaataaattcatgaatgctactttgtgg

SEQ ID NO: 3797 - DNA, 1048 bp, Citrus clementina
atgaatttcgtttccaaaaaattaataaaaacacattacaggtttattatttgaggcaatacatgaactgagctgaagaggatcagaatttgagttaaaatagaaaaaaaaaaatggccatgtgggtatttggttacgggtctctaatatggaaagctgggtttcattttgatgaacgtgttgttggtttcatcaaaggataccgccgtgtattccaccaaggaagtacggatcacagagggacaccaaagtttcctggaagaacagtgacattggagcctgctgagggcgaagtttgttggggagctgcatacaagatcaccaaaaaagaagataaagaagttgcggtgacgtatttagaagtgagggagaaacaatatgacaagaaagcttatcttgatttgttcactgatcccatggctacaactccagcagtttcaggagtaatggtatacattgcatctgcaaacaaacagctcaacagtaactatttgggccctgcatctcttgaagatattgccaaacaaattattcaagctgaaggcccctcaggacccaacagagattacctcttccagcttgagaaggctcttcttgaactcggatgtgaagacaagcatgtcattgatcttgcgaatacagtcaggcgcattctttcagaggaggactcggcctcaaagtgatctgaatatgaatccattagaagcaactattattggtagatcccattcatcgtagttacaattattggttcataattttatattccgtcgtatacaactttggctcctgcattttttagtgtttctttactcaagtgaggaagcattctagggttatagctactacagaagcgacaattgctggccacactctattcatgagattttatgaaataatggtcgctcagatggcatttttgtgctcttatactacggtttgtagtgaacattattcataagtatcaaacacagaaagcaatcttgacgaatccaattttttttcccagaaaacaaaaaattgtttgcccttgtaaaattaacgctgc

SEQ ID NO: 3798 - DNA, 1191 bp, Citrus sinensis
  misc_feature (799)..(799): n is a, c, g, or t
  misc_feature (879)..(879): n is a, c, g, or t
atgaatttcgtttccaaaaattaataaaaacacattacaggtttattatttgaggcaatacatgaactgagctgaagaggatcagaatttgagttaaaataggaaaaaaaaatggccatgtgggtatttggttacgggtctctaatatggaaagctgggtttcattttgatgaacgtgttgttggtttcatcaaaggataccgccgtgtattccaccaaggaagtacggatcacagagggacaccaaagtttcctggaagaacagtgacattggagcctgctgagggcgaagtttgttggggagctgcatacaagatcaccaaaaaagaagataaagaagttgcggtgacgtatttagaagtgagggagaaacaatatgacaagaaagcttatcttgatttgttcactgatcccatggctacaactccagcagtttcaggagtaatggtatacattgcatctgcaaacaaacagctcaacagtaactatttgggccctgcatctcttgaagatattgccaaacaaattattcaagctgaaggcccctcaggacccaacagagattacctcttccagcttgagaaggctcttcttgaactcggatgtgaagacaagcatgtcattgatcttgcgaatacagtcaggcgcattctttcagaggaggactcggcctcaaagtgatctgaatatgaatccattagaagcaactattattggtagatcccattcatcgtagttacaattattggtttatacttttatattccgtcatatacaactttggctcctgcatttttgnagtgtttctttactcaagcgaggaagcattctagggttatagctactacagaagcgacaattgctggccacactctattnatgagattttatgaaataatggtcgctcagatggcatttttgtgcttctaatactaagggttgggagaggaaattattccaacagaaaccaaccaaaaaagagatctttgaagaaactaatttttttttcccctaacccggccacgtacgcaaataaacacatcgatatacattcatagacctcaaacataaagacacaagacacacatgaacaggtgtgagcaaaaaccacaaacgcgccaggggaggggcacctcagggaagtacacattgtgttctacgccatactgacaaaatgaaaccttaattttc

SEQ ID NO: 3799 - DNA, 882 bp, Lotus japonicus
ggggttttctcaggttctgataatataactacgcattagctaccaaaccactgcgtttgttcacagttcacttgtattgtattgctacccaattaccattccacacctcaaactccaaaacttcaaaccatggtaatgtgggtatttgggtacggttccttgatcaccaaagcaggcttcaaatacgatgagcgtcttgttggtttcatcaaagactatcgtcgcgtcttctaccaaggctctactgatcacagaggaacccctgagtttcctggaagaactgttactctggaacctgctgaaggagaaatatgttggggagctgcttacaagatctcaaataaggaagatcaagaaatcgcattaacgtatctggaagtgagagagaagcaatatgacaagaaggaatatgtagatgttttcactgaggtgaatgctacaacgccagcgatttctggggctttggtatatatagcttctccaaacaaaaaagttaacgtaaattatttaggccctgcatccgttgaagatattgcaagacaagtagttcaagctgaaggacccacaggacctaatagagagtatcttttcctacttgaaaaggctctccttcaaataggttgcaaagacaagcatgtcattgatcttgcaaatgaagtaaggcgtattatttcagaggagccctgaatgcttcagtgtgttctgttattagcattgaacattcaaaaactttgagcagccctttatttatatatccattggaaactccaattctttcaagaatgtcagtgggtcataatatctagctctagttatttatacttctcatgtaacatgtcgatttctttgttttttttgtacatatcgattttatttcatata

SEQ ID NO: 3800 - DNA, 968 bp, Medicago truncatula
aaaaacaaaacatttgtgctgaaataaatttgccaatgagtgagtgactgcattttccaagtgattggtcattttctgagttccataaccagaaaactgaaaaccttaaacaacataaacatggcaatatgggtatttggttacggttctttgatctcaaaagctggttttaactacgatgaacgtcttgttggtttcatcaaagattatcgacgtgtcttctaccaaggctctactgatcatagaggaacccctgagtttcctggtagaactgtcacattggagcctgctcaaggagaaatttgttggggagctgcttacaagatcacaaagaaagaagatcaagaaattgcattaacatatctgggagtgagggagaagcaatacgatcggaaggaatatgttgatgttttcactgagcttactgctacaacgccagccatttccggggcattggtatatatagcatccccagacaagaaggttaatgtaaattatctaggtcctgcgtctgttgaagagattgcaaggcaaattgttcaagctgaaggtcccacaggacccaacagagagtaccttttcctgcttgaaaaggctctccttcaaataggatgccaagacaagcatgttattgatcttgcaaatgaagtcaggcgtattctttcagaagaacaatgaatgcttcctcagtgttattagcaccagacattctgagactttttagcaatcccttattaaaatccattggaaacttcaattctttccagaatgttattgggagataatatttatctttagccatgtctataatattctcatgtaatatcttgtttctgacttaatgcagctgagtagaataaccaaccattgcaaaagtagaacccaatttcagtacttattatataagtgatttatgatcaagttattttgatgacaaaggataaaataaagtcaaacttttttcattt

SEQ ID NO: 3801 - DNA, 957 bp, Arachis hypogaea
gagttaacttgccagctccaattggctcttctcctcgtcacaacaagttgcgaatctgccaagtgatcgcttctgttcataatataacatacatcgggtagaaatggtaatgtgggtatttggttatggttctctcatctggaaggctggctttcacttcgatgagcgcgtcgttggtttcatcaaaggctatcgacgtgtcttctaccaaggctcaactgaccacagaggaacacctgagtatcctggaagaacagtgaccctggagcctgctgaaggagaaatatgttggggagttgcttacaagatctccaagaaagaagaccaagaaatcgcattaacgtatctggaagtgagagagaagcaatatgacaagaaggaatatgtggatcttttcaccgatattaatgctacaagcccagccataactggtgtcatggtgtatatagcatctccagacaagaaagttaatgtaaattacttgggtcctgcatcttctgaacatatagcgaggcaaataattcatgctgaagggccctcaggacctaacagagattatcttttccaacttgaaaaggctcttcttcaaataggatgccaagacaaccatgttattgatcttgcaaacgaagtgaggcgttttctttcggagaaacgttgaatgcttcagtgtattctgtcagctttcaacatcctgagactttaacaaatcccttttaactttaattctattggggaaacactgcatatgtttgtcgtagatgaatgattaatcaattgttaaaatacataattattttttatattggggtgggaatggtatttttcataatcatgtattgtatgggtgttaatctcaaatacagcacggtttgatttaaggtgtagaaatcgaacccttgatattttgggaagcaaaaattagaccctcggatttgatattaaaagattttcaaa

SEQ ID NO: 3802 - DNA, 1048 bp, Citrus sinensis
atgaatttcgtttccaaaaaattaataaaaacacattacaggtttattatttgaggcaatacatgaactgagctgaagaggatcagaatttgagttaaaatagaaaaaaaaaaaggccatgtgggtatttggttacgggtctctaatatggaaagctgggtttcattttgatgaacgtgttgttggtttcatcaaaggataccgccgtgtattccaccaaggaagtacggatcacagagggacaccaaagtttcctggaagaacagtgacattggagcctgctgagggcgaagtttgttggggagctgcatacaagatcaccaaaaaagaagataaagaagttgcggtgacgtatttagaagtgagggagaaacaatatgacaagaaagcttatcttgatttgttcactgatcccatggctacaactccagcagtttcaggagtaatggtatacattgcatctgcaaacaaacagctcaacagtaactatttgggccctgcatctcttgaagatattgccaaacaaattattcaagctgaaggcccctcaggacccaacagagattacctcttccagcttgagaaggctcttcttgaactcggatgtgaagacaagcatgtcattgatcttgcgaatacagtcaggcgcattctttcagaggaggactcggcctcaaagtgatctgaatatgaatccattagaagcaactattattggtagatcccattcatcgtagttacaattattggttcataattttatattccgtcgtatacaactttggctcctgcatttttgagtgtttctttactcaagtgaggaagcattctagggttatagctactacagaagcgacaattgctggccactctctattgatgagattttatgaaataatggtcgctcagatggcatttttgtgctcttgtactccggtttgtagtgaacattattcataagtatcaaacacagaaagcaatcttgacgaatccaatgtttttttcccagaaaacaaaaaattgtttgcccttgtaaaattaacgctgc

SEQ ID NO: 3803 - DNA, 732 bp, Tropaeolum majus
tactccttcaatacgcccacagagggaaaaaaaaggaagataagaaaatggagatgtgggtatttggatatggttctctaatatggaaagctggatttcactacgacgatcgtcttgttggtttcatcaaagactatcgtcgcgttttttaccaagggagtactgatcaccgtgggacacaggaatatccaggaagaacagtcacattagagcatgcgaagggagagtactgttggggagctgcttacgaaataaccaataaggaagacaaggaagatgcattgacgtatttggaagtgagggaaaaacagtatgacaagaaagcttatgttgatctctttactgagcctactgcttcagctccagccgtttctggagtaatggtatacatagcttcaccggataagaagaaaaacccaaactatttgggacctgcacccattgaagatattgcaaaacaaattgctaatgctgaaggcccctcaggacccaacagagactaccttttccatctcgaaaaggctctcttacaaatgggacgcgaagataaacatgttacagacctagggaatgaagtgaggaggattatttcggagacgtagacgacttcttcattcgataggataaagcatcaaactactggttcattcatagaggcaatccgcttaacattgaattgatatgtaagctgagaattgtttattcatcaactagtccaatttagttaaaata

SEQ ID NO: 3804 - DNA, 2110 bp, Theobroma cacao
aaggaaaaacagcaggagaaagggaaaccgacaaagtccaaagcagtactgtcagtaaatatctactaccctaatctaatatcttatcaacaaaatccgacggttcagagctcttaacatgtaatccaaagcacgggcggcaggaggcaatttgcctctcttctccttccaattccccttctatatgtaagtatctactctaatccaagcccttctccttaaaccctctctctttccgttacaaaaaccttatcttttcagcaaagcggaaacaaaggctaaaaagaaaggaagccatgtctgcaacatctgcctcatctctcattctcccatgtctcaatcccaaaaccttatctttatccaacccaagacccatctcacttttcctcttctctctttctcacaagctccatgcaaagcctctattctgttctgctcttcaaagcttcgagcttttaaccaagaagtcttcttcttctaggtttgttcgaaacgttgccatttcatctgagtatggtcaggaggaggacctatttggtagtgatgatggagaagaggctcctagtttctcccctgacttgaaactttttgtgggtaatcttccttttagtgtggacagtgcccagctcgctggtttgtttgaaagtgctggaaatgttgagatggttgaggtgatttatgacaaggtaactgggagaagcaggggatttggttttgtaaccatgtccacagctgaggaagttgaagctgctgctcaacagttcaatggctatgaattggaagggagggcattgagggtaaactctggacctcctcctcctcgtagggaagaattttctcctagggggtcaagaggtgctccagctttgggtgcttcaaatcgtgtctatgttggtaacctttcatggggcgttgatgatttagcacttgagactttgttcagcgagcaaggcaaggttgtggaagcaaaagtcgtttatgacagggaaagtggaagatcaaggggttttggctttgtaacttacaattctgctgaagaggttgacagtgccattaaatccttgaatggtgttgatttggatggcagaccaattcgagtctctgtggctgagtctaggccaaggcgtcaattttgagtgtgtatgtttcatactagtactgctaaaattctttggggacacctagaatatgcagctggaagctggcggctgcaacttcgtgctcttcttgggaatctgcaaacatccttcttgtaccagctgcatttgcgcgtcgtggccatctgttcttttcgacatctgcactagactagaaagagctgataatatccattgaaatattttcgttgtatgttctaagtatcatgattcagtaactgacatgtagcctaatgttttgcctcactggatagaattgcttcaaattattgacttttttttttttgtttacaatatttgcctcccttgtatgtatatgctgctctggaaggtctatgcttgttcattaactgcaggaaaagctaaacctggaaatgtcacataacaacctagattctaaaatttgtagatgtttgaatttgtgagagcaatatgaatttattgggagcttgaaacttgttcaaacttccaggcacaatgatgtggcttcaaactttttacccctgttctcgggggctgtggagatgtgtcattctatttttccaaggttcagttaaggcttgagagttggcctgagtcatgcccaagttcacttcctatgcacccattaattggctggtcatctcacaagggacaaagatatccaccaaggcatgttggtttcctttttgttttcctgttctctatagacctgtggcatacgtgtttgtggatgtatatgctgatgcattaccaggtatttatgccttgtagttatggggaggactttaggttttgtggttttgatgatttcagtcctgaatcaggaaggggataaactcttgagtagcaatagcatgtcaagacagctttttcttgtgaatttttgcggttttgctgctggccaatgcaatctatttggcggttgcctgttcacactttgacgcgtttgccattaaactgctttaattttg

SEQ ID NO: 3805 - DNA, 1157 bp, Gossypium hirsutum
caaaaaccttatcttctctttggctaaagcagaaacaaaggctaaaatgtctgcaacatctgcttcatctctcatcctcccatctctcaaacccaaaaccatatctttaccaaacccaactcccatttcactgtcccccttctctctttcccaccgcctccatgcaaagcctctcttttcttccgctcttcaaagtttcacgcttttaacaaaaaagtcttcttcttttccttctaattttgttagaaacgtttccgtttcatctgagtacggtcaggaagagggtttatttggtagtgatgatgaagaggctactagtttctcccctgacttgaaactttttgtgggcaatcttccttttagtgtggatagtgctcagcttgccggtttgtttggaagtgctggaaatgttcagatggttgaggtgatttatgacaaggtaactgggagaagtaggggatttggttttgtaaccatgtctactactgaggaagtggaagctgctgctcaacagttcaatggctatgaacttgaagggagagcgttgagggtaaactctggaccacctcctcctcgtagggaagaattttctcctagggcgagaggtggttcaaccatgggtgcttcaaatcgtgtctatgttggtaacctttcgtggggcgttgatgatttagcactggagaccttgttcagtgagcaaggcaaggttgtggaagcaaaagttgtttatgacagggaaagtggtagatcaaggggtttcggctttgtaacttacaattctagtgaagaggtggatagtgctgtcaaaacatttaatggtgttgagttggatggcagaccaattcgagtctcagtggccgagtctaggccaaggcgtcaattttgagcgcgactggtatctactggtactgctgaagttctttgggaatctacaaacatgcaaattgtagcagctgcatttggatggtattcgcaatctgtgcttagattagattagaaagagccgataacgagatgataatatcaattgaaatattttggttatatgttccgaaagtatcatgattcagtgactgacatgtgccttaattttgtttattcaagtgtgggatttccagttagcaaaaaagaaaaaagtaccgactgcgactctgcgt

SEQ ID NO: 3806 - DNA, 2193 bp, Glycine max
ccataatttgcaatcataaaatgtcttctgccctatgtttctcagtctcccccactttgatgcacaagcctcaagacctttccaaggacacacacctcacaaaagccaacaacaaagacaaatcatgcaaacaatcattgttagataacaaattcagcaagaggaagattttatcatctgctgttattgggttgggcccagcattggttgggctttctactgctcagcccacaagagctgagccagaaagcccagctgcttccacctcaagcagaatatcatactcaagattcctgcagtacttggatgaaggtgctgtcaagaaggtggacctctttgagaatggaacagttgctattgcagagatatacaatccaaccttggaaaaaatccaaagggtcaaaattcagttaccagggttgcctcaggagttaataaggaaaatgaaggataaaaatgttgattttgctgcttatcccatggaagctagttggtggcctgcagtacttgatttgttgggaaatttggcttttcctttgatattgcttggttctctaatcttgaggacatcaactaataatcctgctggtggccccaacttgccctttggattaggaaggagtaaggcaaagtttgagatggaaccaaacacaggagttacatttgaggatgtagctggagtggatgaagccaagcaagacttccaagagattgttgagttcttgaagaccccagagaagttttctgcagttggagcaaaaattcccaaaggggtacttctggtagggccaccagggactggaaagacattgctggccaaggcaattgcaggagaggctggggttcctttcttttccctatctggatcagagttcattgagatgtttgtgggtgtaggggcctcaagggtgagggatttgtttaacaaggcaaaacaaaattctccttgtctgatattcattgatgagatagatgctgtagggaggcagagaggtacaggtataggtggagggaatgatgaaagggagcaaacactgaatcagttgctcactgaaatggatggtttcactggaaacaccggagttatagtcattgctgccaccaacagacctgaaattcttgattcagctttgcttagacctgggaggtttgataggcaggttactgttggattaccagatgtaagagggagggaagaaatattgaaagttcatagtaacaacaagaagcttgacaaggatgtctctcttagtgtcattgccatgagaactcccggattcagtggtgcagacctagcaaacctcatgaatgaagccgccattcttgccggtcgaaggggcaaagataagatcacaatgaaagaagttgatgactccatagatcgcattgtggcaggcatggaaggaaccaagatgactgatggcaaaagcaaaattctggtggcttaccatgaaattggacatgctgtttgtgcgacactgacaccagggcatgatccagtacagaaagtcactctagttcccagaggccaagcccggggcttaacatggttcatatcaggtgaagatccatctctcatctctaagaagcaattatttgctagaatagttggaggcttagggggaagagcagcagaggaagtcatatttggtgaaactgagataaccactggagctgctggggacttgcaacaagttacacaaatagcaagacagatggtaacagtgtttggcatgtcagagattggaccatgggcattgactgatcctgcagtgcaaagtagtgatgtggtgctacgaatgctggctaggaactcaatgtcagagaaattagccgaggacattgataactcagtgagccagataatagaggcagcatatgaaattgcaaagaatcacataaggaataaccgtgatgcaattgataaattagtggatgtgctacttgagaaggagacccttagtggagatgaattcagagctatattgtcagaattcactgatatttcttcaattaagatagatagaatccctattcgggaattgatcgaagcataagtgtaattcaagggatgaggaagactatatagctttgtaatggagtaggatgacgttgtacatgagtactggtatagagcttagttttgagatagtattttgttgataaatgataattgcctttcatcttgtttca

SEQ ID NO: 3807 - DNA, 2172 bp, Glycine max
atgtcttctgccctatgtttctcagtctcccccactttgatgcacaagcctcaagacctttccaaggacacacacctcacaaaagccaacaacaaagacaaatcatgcaaacaatcattgttagataacaaattcagcaagaggaagattttatcatctgctgttattgggttgggcccagcattggttgggctttctactgctcagcccacaagagctgagccagaaagcccagctgcttccacctcaagcagaatatcatactcaagattcctgcagtacttggatgaaggtgctgtcaagaaggtggacctctttgagaatggaacagttgctattgcagagatatacaatccaaccttggaaaaaatccaaagggtcaaaattcagttaccagggttgcctcaggagttaataaggaaaatgaaggataaaaatgttgattttgctgcttatcccatggaagctagttggtggcctgcagtacttgatttgttgggaaatttggcttttcctttgatattgcttggttctctaatcttgaggacatcaactaataatcctgctggtggccccaacttgccctttggattaggaaggagtaaggcaaagtttgagatggaaccaaacacaggagttacatttgaggatgtagctggagtggatgaagccaagcaagacttccaagagattgttgagttcttgaagaccccagagaagttttctgcagttggagcaaaaattcccaaaggggtacttctggtagggccaccagggactggaaagacattgctggccaaggcaattgcaggagaggctggggttcctttcttttccctatctggatcagagttcattgagatgtttgtgggtgtaggggcctcaagggtgagggatttgtttaacaaggcaaaacaaaattctccttgtctgatattcattgatgagatagatgctgtagggaggcagagaggtacaggtataggtggagggaatgatgaaagggagcaaacactgaatcagttgctcactgaaatggatggtttcactggaaacaccggagttatagtcattgctgccaccaacagacctgaaattcttgattcagctttgcttagacctgggaggtttgataggcaggttactgttggattaccagatgtaagagggagggaagaaatattgaaagttcatagtaacaacaagaagcttgacaaggatgtctctcttagtgtcattgccatgagaactcccggattcagtggtgcagacctagcaaacctcatgaatgaagccgccattcttgccggtcgaaggggcaaagataagatcacaatgaaagaagttgatgactccatagatcgcattgtggcaggcatggaaggaaccaagatgactgatggcaaaagcaaaattctggtggcttaccatgaaattggacatgctgtttgtgcgacactgacaccagggcatgatccagtacagaaagtcactctagttcccagaggccaagcccggggcttaacatggttcatatcaggtgaagatccatctctcatctctaagaagcaattatttgctagaatagttggaggcttagggggaagagcagcagaggaagtcatatttggtgaaactgagataaccactggagctgctggggacttgcaacaagttacacaaatagcaagacagatggtaacagtgtttggcatgtcagagattggaccatgggcattgactgatcctgcagtgcaaagtagtgatgtggtgctacgaatgctggctaggaactcaatgtcagagaaattagccgaggacattgataactcagtgagccagataatagaggcagcatatgaaattgcaaagaatcacataaggaataaccgtgatgcaattgataaattagtggatgtgctacttgagaaggagacccttggtggagatgaattcagagctatattgtcagaattcactgatatttcttcaattaagatagatagaatccctattcgggaattgatcgaagcataagtgtaattcaagggatgaggaagactatatagctttgtaatggagtaggatgacgttgtacatgagtactggtatagagcttagttttgagatagtattttgttgataaatgataattgcctttcatcttgtttc

SEQ ID NO: 3808 - DNA, 3581 bp, Citrus clementina
cgaacaaccaatgtctcctgccgtgtctttgtccatctcccaccttccaatctgcaaatctcaggacattgcaaaagatacccacatcccaaaaagcactttcagagaaagccctttccataaaacacctacagatgtcgaacttagtaaaagaaagctgttaaattccactgccttggggcttttaggagggctgtctcttgttcagccagcaaaatcagctgaacctgagagcccaattgagtatacttcgaatagaatgacttattcaagattcttgcagtacttagatgaaggtagtgtcaagaaagtagatttgtttgagaatggaaccgttgcgatcgctgagatatataatcaagcacttgacaaaatccagagggtcaaagttcagttgccaggattgccacaagagttgctgaggaaaatgaaagagaagaatgttgattttgctgctcatccaatcgaaatgaattggggagtttctttactggacttcctagcaaattttggctttccattgttactacttggctctttgtttttaagatcatcttctgtaaacagtcctggaggtcctaacctgccatttggccttggaaggagcaaggccaaatttgagatggagcctaatacaggagtgacatttgatgatgttgctggagttgatgaagcaaaacaagattttcaagagattgtgcaattccttcagacaccagagaaattcgccgcagttggtgcaaaaattccaaaaggagttctattagttgggccaccagggacaggaaagacgctgttggctaaggccatagctggagaagcaggggttccctttttttctctgtcaggatcggaattcattgagatgtttgttggtgtaggagcttcaagagtaagagatttgtttaacaaggccaaggcgaattcgccatgcttggtgtttattgatgaaatagatgcagtggggaggcagagaggaactggcattggtggaggaaatgatgaacgggagcaaactttgaaccagttgcttactgaaatggatggtttcactgggaacagtggtgtgattgttattgcagctacaaatcggcccgaaattcttgattctgctttgcataggcctggaagatttgacagacaggtcagtgttgggctgcctgatataagagggagagagcaaatattaaaggtgcacagcaacaacaagaagcttgacaaggatgtatctctcagtgttattgccatgaggactccaggattcagtggtgcagacctggcaaacttaatgaatgaagctgccattcttgctggtaggagaggaaaagccaacattactctgaaagaaattgatgattcaattgaccgaattgtggccggaatggagggcaccaagatgactgatggaaagaacaagatcctggttgcttaccatgagattggacacgctgtttgtgcgacattgaccccaggacatgatccagtgcagaaagtaactctgatccctagaggccaagctcgagggctaacatggttccttcctgaggaagatcctgcactcatctccaagcaacagctttttgccaggattgttggaggacttggaggaagagcagctgaggaagtgattttcggagaagcagaaatcacaactggagcagcaggggacttgcagcaaattacccagatagcaagacagatggtaacgaggtatggcatgtccgaaattgggccatggacactgattgatccttcagtgcaaagcagtgatgtcgtgatgaggatgttagcaagaaactcaatgtcagaaaaacttgcagacgacattgataaaacagtgagaaatataattgaaagtgcttacgaggttgcaaagaatcacataaggaataacagggaagccattgataagcttgtggatgtgcttatggagaaggaaacactttcaggagatgaattcagggcggttctatcagaatttactgatgtatctgcagatcaagttgatagaactcctatccgagaatttgctctctaaagcccgccaatgcctctcttttctaaagctctgctgctccaaaaagcacctctatcaaatccatgcacaaatccaagtctctggtctccaaaacgatgcccaaattttaaaggaacttgtgcgcttctgcactttatcatcctccaaaaacttaacgtacgcgcgttcaattctttgtaactacgttaatgattcagtgcccattccttggaacaatctcatcagaggctatgcctggagtgatagaccaagagaggccgtttgggtttttattgatatgaaaagaagaggaattaaacccactgaatttacctacccttttgttttaaaggcgtgtgcagagatttccgggcttaatgaagggatgcaggttcaggcgaatgttacgaagagtgggttggactcggatgtatatactaataataatttggttcgtttctatgggtcctgtaggagaaaaagagatgcgtgtaaggtgtttgacgatatgtgtgagagaagtgtggtttcgtggaatgtgattataactgtttgtgttgagaatctgtggttaggagaggcagttgggtattttgttaaaatgaaggatttagggtttgagccggatgagaccacaatgttggttgtgctgtctgcatgtacagaacttggaaatttaagcttggggaaatgggttcatttgcagttgattgagagaggaactgtgttgaattgtcaattgggtactgctcttatcgatatgtacgcaaagtgtggagcagtaggttgtgctaggttattgttcagtaggatggaggagataaatgtttggacatggagtgctatgattttgggattagcccagcatgggtatgctgaggaagctcttgaacttttttcaaatatgaaaaattcttcaataagtccaaattatgtcacttttcttggggttctttgtgcctgtaaccatgctggaatggtggaagatgggtaccggtactttcatgagatggagcatgtgcatgggattaaacccatgcgcatacattaccataccatggcggatatcttggctcgtgctggccatctaaaagaggcctacactttcataatgaacatgccttttcagcctaacccaattgtgttgagggcattgttgagtgcaagcagcattcatgatgctaaataccaagatggagtggggaatgaggtgagaaggaggctgcttgaattggagcccagggggagtcagaatctagtgattgttgcaaacaagtatgctgaggtcgggatgtgggagaaagtatcaaatgtaagaaggtttatgaaaaatgttgggttgaagaaaatgaaaggaatgagttgggtagagcttggaggatctattcataggttctattctgggtatgattctcaggttgaacttgcaggaatttaccagattcttgaaacattgaacttgcacatgaaggtactaaatttttaatagtaattttttatctgcttgtatctcaaacggtggatgtctgcggtcatttgatttttcggtgaatcatcttctact

SEQ ID NO: 3809 - DNA, 3581 bp, Citrus sinensis
tgaacaaccaatgtctcctgccgtgtctctgtccatctcccaccttccaatctgcaaatctcaggacgttgcaaaagatacccacatcccaaaaagcactttcagagaaagtccttttcataaaacacctaccgatgtcaaactcagtaaaagaaagctgttaaattccactgccttggggcttttaggagggttgtctctggctcagccagcaaaatcaactgaacctgagagccccattgagtatacttcgaatagaatgacttattcaagattcttgcagtacttagatgaaggtagtgtcaagaaagtagatttgtttgagaatggaaacgttgcgatcgctgagatatttaatcaagcacttgacaaaatccagagggtcaaagttcagttgccaggattgccacaagagttgctgaggaaaatgaaagagaagaatgttgattttgctgctcgtccaatggaaatgaattggggagtttctttactggacttcctagcaaattttggctttccattgttactacttggctctttgtttttaagatcatcttctgtaaacagtcctggaggtcctaacctgccatttggccttggaaggagcaaggccaaatttgagatggagcctaatacaggagtgacatttgatgatgttgctggagttgatgaagcaaaacaagattttcaagagattgtgcaattccttcagacaccagagaaattcgccgcagttggtgcaaaaattccaaaaggagttctattagttgggccaccagggacaggaaagacgctgttggctaaggccatagctggagaagcaggggttccctttttttctctgtcaggatcggagttcattgagatgtttgttggtgtaggagcttcaagagtaagagatttgtttaacaaggccaaggcgaattcgccatgcttggtgtttattgatgaaatagatgcagtggggaggcagagaggaactggcattggtggaggaaatgatgaacgggagcaaactttgaaccagttgcttactgaaatggatggtttcactgggaacagtggtgtgattgttattgcagctacaaatcggcccgaaattcttgattctgctttgcataggcctggaagatttgacagacaggtcagtgttgggctgcctgatataagagggagagagcaaatattaaaggtgcacagcaacaacaagaagcttgacaaggatgtatctctcagtgttattgccacgaggactccaggattcagtggtgcagacctggcaaacttaatgaatgaagctgccattcttgctggtaggagaggaaaagccaacattactctgaaagaaattgatgattcaattgaccgaattgtggccggaatggagggcaccaagatgactgatggaaagaacaagatcctggttgcttaccatgagattggacacgctgtttgtgcgacattgaccccaggacatgatccagtgcagaaagtaactctgatccctagaggccaagctcgagggctaacatggttccttcctgaggaagatcctgcactcatctccaagcaacagctttttgccaggattgttggaggacttggaggaagagcagctgaggaagtgattttcggagaagcagaaatcacaactggagcagcaggggacttgcagcaaattacccagatagcaagacagatggtaacgaggtatggcatgtccgaaattgggccatggacactgattgatccttcagtgcaaagcagtgatgtcgtgatgaggatgttagcaagaaactcaatgtcagaaaaacttgcagacgacattgataaaacagtgagaaatataattgaaagtgcttacgaggttgcaaagaatcacataaggaataacagggaagccattgataagcttgtggatgtgcttatggagaaggaaacactttcaggagatgaattcagggcggttctatcagaatttactgatgtatctgcagatcaagttgatagaactcctatccgagaatttgctctctaaagcccgccaatgcctctcttttctaaagctctgctgctccaaaaagcacctctatcaaatccatgcacaaatccaagtctctggtctccaaaacgatgcccaaattttaaaggaacttgtgcgcttctgcactttatcatcctccaaaaacttaacgtacgcgcgttcaattctttgtaactacgttaatgattcagtgcccattccttggaacaatctcatcagaggctatgcctggagtgatagaccaagagaggccgtttgggtttttattgatatgaaaagaagaggaattaaacccactgaatttacctacccttttgttttaaaggcgtgtgcagagatttccgggcttaatgaagggatgcaggttcaggcgaatgttacgaagagtgggttggactcggatgtatatactaataataatttggttcgtttctatgggtcctgtaggagaaaaagagatgcgtgtaaggtgtttgacgatatgtgtgagagaagtgtggtttcgtggaatgtgattataactgtttgtgttgagaatctgtggttaggagaggcagttgggtattttgttaaaatgaaggatttagggtttgagccggatgagaccacaatgttggttgtgctgtctgcatgtacagaacttggaaatttaagcttggggaaatgggttcatttgcagttgattgagagaggaactgtgttgaattgtcaattgggtactgctcttatcgatatgtacgcaaagtgtggagcagtaggttgtgctaggttattgttcagtaggatggaggagataaatgtttggacatggagtgctatgattttgggattagcccagcatgggtatgctgaggaagctcttgaacttttttcaaatatgaaaaattcttcaataagtccaaattatgtcacttttcttggggttctttgtgcctgtaaccatgctggaatggtggaagatgggtaccggtactttcatgagatggagcatgtgcatgggattaaacccatgcgcatacattaccataccatggcggatatcttggctcgtgctggccatctaaaagaggcctacactttcataatgaacatgccttttcagcctaacccaattgtgttgagggcattgttgagtgcaagcagcattcatgatgctaaataccaagatggagtggggaatgaggtgagaaggaggctgcttgaattggagcccagggggagtcagaatctagtgattgttgcaaacaagtatgctgaggtcgggatgtgggagaaagtatcaaatgtaagaaggtttatgaaaaatgttgggttgaagaaaatgaaaggaatgagttgggtagagcttggaggatctattcataggttctattctgggtatgattctcaggttgaacttgcaggaatttaccagattcttgaaacattgaacttgcacatgaaggtactaaatttttaatagtaattttttatctgcttgtatctcaaacggtggatgtctacggtcatttgatttttcggtgaatcatcttctact

SEQ ID NO: 3810 - DNA, 2223 bp, Solanum lycopersicum
aagttgtcaactgccttcaacttcccaaactgcaattcatagttcataagcacaaaaagcctaagtagaggaaaacaaaatgtctactgctctttctttgtctgtctctcagttccccctatgcaaatcccaagacttctccaaggatgtttacaatcctaaaatctccaataaagaaaccccatgtcagaaaacacattcagacaccagaataaacaggaggaagctgttgagtactagtggtttgagccttgtagcagggactttgtctaagccagcaagagctgagactgaagcaccagttgaggtaacttcaagtagaatgtcatattcaagattcttggattacttgaatcaaggtgctgtcaagaaagttgatttctttgagaacagtgctgttgctgagatattgatcaatcctgctcttaacaaagtccagagagttaaaattcagttgccaggattgccaccagaattggtgagaaaacttaaagacaagaatgtagattttgctgctcatctacctgaaaagaatgtaattggaccacttcttgatttgcttgggaatttagcttttccattgatattgcttggttatttactgttgagaagctcttcaaatacccctggagggccaaacttgccttttggattaggaaggagcaaagccaaattccagatggaaccaaatacaggagtaacatttgatgatgtggctggagttaatgaagcaaaacaagattttcaagagattgttgagtttttgaagactccagagaagtttgctgcagttggagcaaagataccaaagggatttctcttagtagggccaccagggacagggaagacattgctggctaaggcgattgctggagaagcaggggtgccattcttttctctctctggctcagagttcattgagatgtttgttggtgtgggagcttctagagttagggacttattcaacaaggcgaaacaaaattcgccttgcataatttttattgatgaaattgatgctgttgggaggcagagaggaactggtattggtggaggaaatgatgaaagagagcagacactgaaccaacttcttactgaaatggatggttttactgggaacactggagtcattgtcattgctgctactaataggcctgaaattcttgatcaagctttgcttagacctggaaggtttgataggcaggtaactgttggactgcctgatataagaggaagagaagaaatattgaaagttcacagtaacaacaagaagcttgacaaagatgtgtctctaagtgttattgcaatgagaacaccaggattcagtggtgcagatcttgcaaacctgatgaatgaagctgccattctagctggaaggagaggaaaagataagattacctcaaaagagatagatgattccatcgatagaattgtcgctggaatggaaggaactaccatgacagatggaaagaacaagattctggtagcataccatgaggttggacatgctgtctgcgcgacattgacccctggccatgatgcagtacagaaagtcacattgatcccaagaggtcaagctcgcggtcttacatggttcattcctggtgaagatccaaccttaatctctaagaagcaactctttgctagaatagtgggaggcttaggaggtagagcagcagaggaaataatttttggtgaaccagaaatcactactggtgcagcaggagacttgcaacaaataactcaaatagcaagacagatggttacaatgtttgggatgtctgagattggaccatgggcgttaacagatccagcagcacaaagtggcgatgtggtgctgagaatgctagcgaggaatcaaatgtcagagaaactagcagaagacattgatgaatctgtaaggcacataatcgagagagcatatgaaattgcaaagaaccacatcaggaacaacagggaggcaatcgacaaattagtggatgtcctgctggaaaaggagactcttacaggagatgagtttagagctatactctcagaattcactgatatcccattcgttaacataaacagaaaaccaattagagaactaattgaggcctaggtgaaattacttccaatgtacagctgcagaaactaaataccttcacaagattttacatgtttaatgcagtgcagaaagcaagatcaatgtaatataaatagataatcttcatcaactttgtgtat

SEQ ID NO: 3811 - DNA, 2199 bp, Eucalyptus grandis
agaacacaaaacgctagctgctctttagctgaatctcatcaggttcgatagaagagaatgtcgcctgctctgtccctgtctctctctcacctccctccgtgcaagtcccaggacggcatccccaaggagagtccacatcccaggatcagcgccgcaagccaaaacccttgtcagaaatcgtgttccgacgccagcgtcggcaggagaaagctgctcgcgactgtggcttcgacgggtctggggctagggacttcttttctcaggcctgcgagggcggagccccagagcctgatcgagtccgcctcaagtaggatgtcctacaccaggttcttgcagtacctggacgaaggcgcagtgaggaaggtggacttgttcgagaatgggaccgttgcgattgcagagatctacaaccccgcccttgacaaggtccagagggtgaaggttcagctgccgggcctaccacaggagctgctcaggaagatggaggacaagaacgtggacttcgcagctcatcctatggaggccagcatgtggccagcgatcctcgatctgctggggaacttggctttcccgttgatactcctagggagtctgctgttgaggagctcgtcttggaacaatcccgcaggacccaatttgccctttggacttgaaagaagcaaggcgaagtttcagatggaaccaaacacaggaatcacatttgatgacgtggctggggttgatgaggtgaagcaggacttccaggagattgtggagttcttaaggacgccggagaagtttgcagccgtgggagcaaggatcccaaaaggagttcttctagtggggccaccagggacagggaagaccttgttggccaaggcgatcgcaggagaagctggggtccctttcttttcgctgtctgggtcagagttcatcgagatgtttgtcggtgtaggcacttcgagggtgcgagacctgtttaacaaggcgaaggcgaattcgccttgcttggtcttcattgatgagattgatgctgttgggaggcagagaggaactggcatcggaggaggaaatgacgagagagagcaaacactgaatcagttgctcactgagatggacggttatagtgggaacagtggagtgatcgtcatcgcagcgacgaatcgtcccgaaatccttgattctgccttgcttaggccaggaaggtttgatagacaggtaagtgttggactaccagatataaggggaagggaagagatactgaaggtacacagcaaaaataagaagctagataaggatgtctctctcagtgtgattgccatgcgaacaccaggatttagtggtgctgacttggcgaatctgatgaacgaggccaccattcttgccgggaggagaggcaaagacaagatcacgctgaaggaggttgacgactcaattgaccgcattgtggctggaatggaaggaaccaagatggtggatggaaagaacaaaatgttggtcgcgtatcacgaagtcggccacgctatctgcgcgacattgacgccaggacatgacccggtacagaaagtcactctaatacccagaggccaagctcgcggtctcacgtggtttttgcctggtgaagatcctaccctgatctccaaacagcagttatttgctagaatcgttggaggtctaggtggccgagctgctgaggaagtcatatttggagaaccagaaatcaccaccggcgcagctggagacctgcaacaaatcactcagatagcaagacagatggtaataacgtatggtatgtccaatattgggccatgggcgttgatcgaaccaacagtgcaaagcagtgatgttgtcctgaggatgctagctaggaattccatgtcagagaagctcgcggaggacattgactcatctgtcaagaacatcattgacaatgcatatgagattgcaaaggcacatataaggaacaaccgggaggccatggacaagatagtggatctgcttctggagaaggagacgcttacaggagatgaattcagagcgatgctttcggaatttacagatgtttcaatcaacaacacaaagaggactcctgttagggagatgattgaggccttggaaacacaatcatagttgtacataagcagagtgaaaagaattctaaataggtactctgactagaggatagtatagataacaacgtctagtttctttatatggaaa

SEQ ID NO: 3812 - DNA, 2103 bp, Solanum phureja
aagttgtcaactgccttcaacttcccaaactgcaatacatagttcataaacacaaaaagcttaagttgaggaaaacaaaatgtctactgctctttctttgtctgtctctcagttccccttatgcaaatcccaagacttttccaaggatacttacaatcctaaaatctccaataaagaaaccccatgtcagaaaacacattcagacaccagaataaacaggaggaagctgttgagtactggtggtttgagccttgtagcagggactttgtctaagacagcaagagctgacactgaagcaccagttgaggtaacttcaagtagaatgtcatattcaagattcttggattacttgaatcaaggtgctgtcaagaaagttgatttctttgagaacagtgctgttgctgagatattgatcaatcctgctcttaacaaagttcagagagttaaaattcagttgccaggattgccaccagaactggtgagaaaacttaaagacaagaatgtagattttgctgctcatctccctgaaatgaatgtaattggaccacttcttgatttacttgggaacttagcttttccattgatattgcttggctatttgctgttgagaagctcttcaaatacccttggagggccaaacttgccttttggattaggaaggagcaaagccaaattccagatggaaccaaatacaggagtaacatttgatgatgtggctggagttaatgaagcaaaacaagattttcaagagattgttgagttcttgaagactccagagaagtttgctgcagttggagcaaagataccaaagggatttctcttagtagggccaccagggacagggaagacattgctagctaaggcgattgccagagaagcaggggtgccattcttttctctctctggctcagagttcattgagatgtttgttggtgtaggagcttctagagtcagggacttattcaacaaggcgaaacaaaattcgccttgcataatttttattgatgaaattgatgctgttgggaggcagagaggaactggtattggtggaggaaatgatgaaagagagcagacactgaaccaacttcttactgaaatggatggttttactggaaacactggagtcattgtcattgctgctactaataggcctgaaattcttgatcaagctttgcttagacctggaaggtttgatagacaggtaactgttggactgcctgatataagaggaagagaagaaatattgaaggttcacagtaacaacaagaagcttgacaaagatgtgtctctaagtgttattgcaatgagaacaccaggattcagtggtgcagatcttgcaaacctgatgaatgaagctgccattctagctggaaggagaggaaaagataagattacctcaaaagagatagatgattcaatcgatagaattgtcgctggaatggaaggaactacaatgacagatggaaagaacaagattctggtagcataccatgaggttggacatgctgtctgcgcgacattgacccctggccatgatgcagtccagaaagtcacattgatcccaagagggcaagctcgcggtcttacatggttcatccctggtgaagatccaaccttaatctccaagaagcaactctttgctataatagtgggaggcttaggaggtagagcagcagaggaaataatttttggtgaaccagaaatcactactggtgcagcaggagacttgcaacaaataactcaaatagcaagacagatggttacaatgtttgggatgtctgagattggaccatggacgttaacagatccagcagcacaaagtggcgatgtggtgctgagaatgctagcaaggaatcaaatgtcagagaaactagcagaagacattgatgaatctgtaaggcacataattgagagagcatatgaaattgcaaagaaccacataaggaacaacagggaggcaatcgacaagttagtggacgtgctgctggaaaaggagactcttacaggagatgagtttagagctatactctcggaattcactgatatcccatcagctaacataaacagcaaaccaattagagaactaattgaggcataggtgaa

SEQ ID NO: 3813 - DNA, 2182 bp, Manihot esculenta
aaaaagaaaaagcaaaccaccatttcaggtttcacattttgcaacagagaacatgtcacctgcactatctctatctatttcccacattcccatctgcaaatctcaggacctttcaaaggatgcccacatctccaaaatttctggtagagaaaacccatctcacaaaacatcctcggatgtcaaactgagtaaaagaaaactactaaatgccactgcctttggccttttaagtgaaggaatctctatagctcagcctgcaaaagcagagccagagagcccagtagcagcaacttcaagtaggatgtcatattcaagattcttgcagtacttagatgaaggtgctgtaaggaaggtagacctgtttgagaatggaactgtagccattgcagagattttcaatccaactctttccaagatgcagagagtgaaaatacaattaccaggattgccgcaagagctgttgaggaaactgaaggataaaaatgtagattttgcagctcatccattggaaatcaactggggtgctgctttgcttgacttgttggggaacttggcctttccattgattttgcttggcagtttgttgttaaggtcatcatccacaaaccctgatggaggccccaacttaccattcgggcttggaagaagcaaagccaaattccaaatggaacccaacactggagtaacattcaatgatgttgctggagttgatgaagccaagcaagattttcaagaaattgttgaattcttgaagacaccggaaaagtttgctgcagtaggggcaagaattcctaaaggagtactgctagtaggacctcctgggactggcaagaccttactagctaaagcaatagctggagaagcaggagttcctttcttttcgctctcaggatcagagttcatagagatgtttgttggtgtaggggcttcaagagtgagagatttattcaacaaggcaaaggcaaactcgccatgcttggtttttatcgacgagatagatgcagttggaaggcagagagggacaggcatcggaggaggaaatgatgagagggaacaaacattaaaccagttactcactgaaatggatggttttagtggtaacagtggagttattgtaattgctgctacaaatcggcctgaaattcttgattctgctttgctaaggccaggaagatttgacaggcaggtaactgttgggctaccagatattagaggaagggaagagatattacaggtgcacagcaaaggcaagaatcttgacaaggatgtttccctaagtgttattgccatgaggacaccaggattcagtggcgcggacttggcaaacctaatgaatgaagccgccattcttgctggtaggagaggcaaaggtaagatcaccctgaaagaaattgatgattcgattgatcgaatagtggcgggcatggaaggaaccaagatgacagatgggaaaagtaaaatcctggtggcttatcatgaagttgggcatgctgtttgcgcgacactgactccaggtcatgacccagttcagaaagtaactctaattccacgaggccaggcccgaggactaacatggtttatgccaggtgaagatccaactctcatctccaagcaacagctatttgctcggattgttggaggtcttggaggtagagcagcagaggaagtgatttttggtgaatcagaaatcactactggtgcagcaggggacctgcagcaaatcactcaaattgctagacagatggttacaatgtttggcatgtccgagattgggccatgggcactcacggatccagcagtacaaagcagtgatgttgtactaaggatgctggctagaaattccatgtctgagaaacttgcaaaggatattgattcagcggttcgagacataattgaaagagcgtataagatcgcaaaggaacatgtaaggaataacagagaggccattgataaactagtagaggtgcttctagagagggaaaccctaactggggatgaattcagggcaatcctgtcagaatttactgatatttccgtaggcaaagtagataggatctcttatagcggcagaaaattgccttacattttatccatgacagtggaaataaaggcactggtaccagaaaaccagacgtatgcctacgcactcaaggcattggagttagagcttggtgagacttga

SEQ ID NO: 3814 - DNA, 2454 bp, Fragaria vesca
aatgtcacctgcactctccctatctctctccctctctccagtctgcaacgcccaggaagtttctaaggacacccacctcctaaaaaacactagcagagaaaccccatgtcacaaatctcagccaaacttgaaatcctctagaagatcactattgaatgctgcctctcttggctttatagtgcctggaaccctcatgtctaactccgcaagagctgagcctgagccagagagcccgaatgcatcaacttcaagcagactgtcatactccagattcttgcagtacttggatgaaggtgctgtgaggaaggtagacctgtttgagaatggaaccgtcgcgatcgccgagatcttcaatcccacattagagaagctccagagagtcagagttcagctacctggattgccacaagagttgctgaggaaactaaaagagaagaacatagattttgctgctcatccaaaggaagtggattggtggcctgcagtactagacttgttgggtaattttgcttttccactgttacttcttgggtcattgctcttgaggagttcatcatcaaacatgccaggaggccccaacttgccttttggacttgggaggagcaaggccaaatttcaaatggaacccaatacaggggtaacatttgatgatgtggctggagttgatgaagcaaagcaagatttccaagagatagttgaatttctgagaactccagagaagtttgctgcagtaggtgcaagaattcctaaaggggtacttttagtagggccgccggggaccggaaagacactgctggccaaggccattgcaggagaggcaggggtgcctttcttttctctgtcagggtcggagttcattgagatgtttgtaggagtaggagcttctagagtaagagacttgttcaacaaggcgaaagataattcgccgtgcttggttttcattgatgagattgatgctgttgggaggcaaagagggacaggaatcggtggaggaaatgatgagagggagcagacattgaatcagcttcttactgaaatggatggatttagtgggaacagtggagtaattgttattgctgctactaaccgccctgaaattcttgattctgctttgcttaggcccgggaggtttgacagacaagtctcagttggattgccagatattaggggaagagaggagatattaaaggtgcatagtaacaacaagaagcttgataagagtgtttctattgatattattgctatgagaactcctggattcagcggtgcagatctcgcaaacctcatgaatgaagctgcgattcttgctggtaggagaggcaaagataagataacagcaaaagaaatagatgactcgattgatcggattgttgcagggatggaaggaacaaaaatgactgatggaaagagcaagactcttgtggcttaccatgaagttggccacgctatttgtgcaacattgactccgggccatgatccagtgcagaaagtctctcttattccccgaggccaagctcgcggtcttacatggttcttaccaggtgaagatcctgctctcatttctaagcaacaactgtttgctagaatagttggaggtctaggaggtagagcagcagaagaaataatttttggggagccagaaataacaactggtgcagcaggagacttgcaacaggtcacacaaatagcaaaacagatggtaacaatgtatggtatgtccgagattggaccatgggcattgacagacccagcagcacaaagcaatgacttagtgttgaggatgctagcaaggaacaccatgtccgaaaaacttgcagaggatattgacttgtcagtgagacgcataatcgaaagtgcatatgaggttgcgaagaatcatataaggaataaccgggcagccatggatcaattagtagatgtgctattagaaaaggagatactcactggagatgagttcagggcaattctgtctgaatttactgatacttctttggtagaggtaaataggaactccatcagggaaatgattgaagcatagtaggtataaggtaggacaatagatgtaaaagatagcatactgctactggtgaacggtgactagttacatggtaatgtatagagattttcatagtgtatatgactagttaccatcaggaataaattcactacactactaattacatttaggggggaacagagttcaattatcatgtttggtacatttacatatatgatatatatcattgctcatggccaacatcaaagacacaaactcttcagctatacattgactgagctgaagaggagtatttctgactttggtgattttgggacgtcgggtggcaatttctgtgccttgaagaaggggcttcaacttctgcagatgactcttctggagatgactcttccgattcgtgcccggttgcaccacacctgacctccctcaatcgatct

SEQ ID NO: 3815 - DNA, 2174 bp, Cucumis sativus
aaactatgtcttctaccatatatttgtctccctctctctctcctgtctgcaagcttcatgatcattcaaggaagacccatcactccaaaacatctaacaaagaaaacccatgtcctaaaattcctttaaacgctcaaatcagtaagagaaatctgttgagctccactggtcttactcttccagctgatgccttcttcaatgactctggtttggcaagggcagagcctgagagtcctattgaatcggcttcgagtcgattgtcgtactcgagattcttgcagtatttggatgagggggcagtgaagaaggttgatgtttttgagaatggtactgttgccattgctgagatttataatcctgtgttggataagattcagagggttaagattcagttgcctgggttgccaaaggagttgataagaaagatggaggaaaagaatgtggattttgcagctcatcctatggagatcaattgggggcctgcaattcttgatttgttaggaaattttggttttccattgttgttgcttggctcattgctgcttcgatcatcttcttcaaactctcctggaggacccaacttgccatttggacttggaaggagcaaggccaaattccagatggaacccaacacaggagttacatttgatgatgtagctggggttgatgaagcaaagcaagatttccaagagattgtggagtttttgaaaactccagagaagttctcagcagttggagcaagaataccaaaaggggttctcttagttgggccaccaggaacaggaaagactttgttggccagagccattgcaggggaagctggagttcctttcttctctctctctggttctgagttcatagagatgttcgttggggttggggcctcaagagtgagagatttattcaacaaagcaaaagccaattccccatgcttagttttcattgatgagattgatgctgttggtagaatgagaggcacaggcattggtggaggaaacgatgaaagagagcagacactgaatcagttgctcactgaaatggatggttttactggtaacagcggtgtgatcgtcatcgctgctacaaaccgccctgaaatccttgattctgctttgcttcggccggggaggtttgatagacaagttactgtggggttgccagacgtgagaggaagagaagaaatcctgaaggtccacagcaacaacaagaagctggacagcaacatattactcagcgtcattgcaatgagaacgccaggcttcagtggagccgatctagccaacctaatgaacgaagctgcaattttagcaggaagaagagggaaagacaaaatcacactaaaagagatcgatgattcgatcgacagaattgtggctgggatggaagggaccacaatgacggatgggaagagcaaaattttagtggcttaccatgaaattggtcatgcagtatgcgcgaccttgacagaaggtcatgatcaagtacagaaagtaactctaattccaagaggacaagcaagaggactaacatggttcttgcctggagaagacccaactcttgtttccaagaagcaattatttgctcgaatagttggtggacttggaggcagagcagctgaggatgtgatcttcggggagccggagatcaccaccggtgctgctggagatctattacaagtcactcaaattgctagacagatggtaacaacgcttgggatgtcagagatagggccatggacattgatagatccagcagtacagagcagtgatgtagtgatgagaatgctagctcgaaactccatgtcggagaagttagcagaagacatagattcatcggtacgaaatacaatagcaaaggcgtacgagattgcaaaaactcatattagaaacaatcgagaagccattgacaaattggtagatgttttgttagagaaagaaacaatctcaggagatgaatttagatcgattctttcagagttcacaaatattccctcagacaatggtattcaaacaagttcttccatacctcaattggtcaaagcctagataatctttgtgtacaagttaggacatcaaattataaatatgctgtgtatttattacatagaataaaaggcagaagtagagatcataggactaagatggttgtataaatgaaacgttgcagcttttcaa

SEQ ID NO: 3816 - DNA, 2945 bp, Theobroma cacao
  misc_feature (660)..(660): n is a, c, g, or t
  misc_feature (945)..(945): n is a, c, g, or t
  misc_feature (1323)..(1323): n is a, c, g, or t
cggggaacacaattaactctcttctttttgtttccctcttctttcttgcaatcttttttttgccctacgtagtggggtttcagaattctttcttctaaacaagttctgatgcattcaagttttcaagggttatacttggtctgcctttttctagcgttttgtgctgttggattttgcgttttggggttggaggcttctcagaaaagtttcttctttgagattcaaccatgcctgctcttgttaattacggtggtgatgatgatttctattctgggggttcattttatacaaattccacagacttgggtagattgtgttcaatcagttcccaagtggatgtgtactgccctcctcgtaaaagagctcgtatttgtgccccatttctcttcggagaaactgagtttgagcagaataagcaaccatcaattgatgttcttcctgaggaatgcctttttgagatcttcaaacgtcttcctgggggcagagaaaggagctcctgtgcttgcgtctcaaagcattggcttatgcttctgaccagtattcgtaagagtgaatatgagtcatcaaaggtggtcaaggagaatactgatttggtttctgaggatgttgagatgatctcatctgatgaggatgatgggtatcttacaaggtgcttggaanggaagaaagcaactgacatgagacttgctgcagtggctgttggaacaagtggtcatggtgggctgggaaagctttctataaggggaagtagctcctcatgtggagtgaccaatttcgggctatctgcaatagctcgtgggtgcccttctctcaaggcactgtctttgtggaacatcccttgtgttggggatgaaggtctgtcagagatagctaaagaatgccatttgttggagaagcttgacctttgccagtgccccttagtttccaacaagggtttgatcgcantcgcagagaactgccctaatttgacctctttgagcattgaatcttgcccaaagattggtaacgagggcctccaagccatcggaaagctttgccccaagctgcagtccatctctatcaaggactgcccacttgttggggatcatggagtttcaagcctgttggcatcagcatcttctgtcctttcaaaggttaagcttcagggattgaacatcacagatttttctcttgctgtgattgggcactatggcaagtctgtgacaaatctaatgctcagtggtctacaaaatgtgagtgagaagggattttgggtcatgggtaatgctcagggtttgcaaaaattggcatctttgatgattacttcttgctggggggtaacanatgtcagtcttgaagccatgggaaagggatgcacaaacctaaagcagatgtgccttcgcaggtgttgctttctttctgatgatggactggtggcttttgccaagtctgcaggttctcttgagtgcctgcagttggaggagtgtaacagggtcacacaatctgggattattcgtgtcctctcaaactgtggattaaaatctcttacgctagtaaagtgcttgggaattaaggatatgtccttgggagctcctttgtcctccacttgcaattcccttaaatccttgtctgtaaggaactgcccaggatttgggactgccagcttggctatggtgggcaaactgtgccctcagcttcagcatgtagatctgagtgggctctatggcatcacagatgcaggtcttctgcctcttcttgagagttgtgaggcaggacttgtgaaggtgaacctgagtggctgcttaaatttgactgatgaggtagtgttggccttgaccagactacatggcggaaccctcgagttgctcaatcttgatggttgcaggaggatcactgatgcaagtttggtagctgttgcagacaattgtgtttttctcagcgatctggatgtatcaaggtgtgcgatcaccgattctggtgttgctgccttgtctcatgctgagcaactcaatttgcaagtcctttctttttcaggttgctctggagtgtcaaacaaaagcatgcctttcctgaaaaaattgggcaagaccttggtggggttgaatctccagcactgcaattcaatcagcagtcgaactgttgagctgcttgtagagagcttgtggagatgtgacacccttttctaattaaggatagaaggctgttgagccagatctgaacaactacacttacggcataaagatggtagaaatatcaaactcatatagtcagctcacacgggtagcaacattcagaacagttttttggtccgacaaagtggtcatgctggttgctctacggcttggtgttttcctggggactttggctgttttgcagatggcctatccatccgttttttgctggctttcttgacatgggaaagcctgttgtaactatcaagcccccatttacccgcggggcagtttcatagccatggttcctggagaactctgtcatcaagtcatggatttagatttccactcatgatcatcagagcatttggttctattttgctggatgtggtctactcagtgttttagcttttgtcatacatttctttacgggagtgcttgactaagctttctttgttttcagtcctatgaagtctgttgtttggatcagtccatcttagttttaagcgtctgtttttcaaaggtcttccggtgtttgaaactcgtgtaggggttcttctgtgtttccttttgtcgcgtctttatagttgctttgagcagttctatgtttgggtgccgcaggttgtggggctgtggcaagggcagtggattcatctgatctgccataacaaccttctgtggttgtttttttcgtttttccacaagtcctagtcttgcaggcttttccttgtgtatgaattgaactactgcaactactctgttattagcaataaagcttaatatttctttgtaaga

SEQ ID NO: 3817 - DNA, 2984 bp, Theobroma cacao
agaacccttatgttctgtttcagctaacacaattaactctcttctttttgtttccctcttctttcttgcaatcttttttttgccctacgtagtggggtttcagaattctttcttctaaacaagttctgatgcattcaagttttcaagggttatacttggtctgcctttttctagcgttttgtgctgttggattttgcgttttggggttggaggcttctcagaaaagtttcttctttgagattcaaccatgcctgctcttgttaattacggtgattttgtttattggaatttcaggtgatgatgatttctattctgggggttcattttatacaaattccacagacttgggtagattgtgttcaatcagttcccaagtggatgtgtactgccctcctcgtaaaagagctcgtatttgtgccccatttctcttcggagaaactgagtttgagcagaataagcaaccatcaattgatgttcttcctgaggaatgcctttttgagatcttcaaacgtcttcctgggggcagagaaaggagctcctgtgcttgcgtctcaaagcattggcttatgcttctgaccagtattcgtaagagtgaatatgagtcatcaaaggtggtcaaggagaatactgatttggtttctgaggatgttgagatgatctcatctgatgaggatgatgggtatcttacaaggtgcttggaagggaagaaagcaactgacatgagacttgctgcagtggctgttggaacaagtggtcatggtgggctgggaaagctttctataaggggaagtagctcctcatgtggagtgaccaatttcgggctatctgcaatagctcgtgggtgcccttctctcaaggcactgtctttgtggaacatcccttgtgttggggatgaaggtctgtcagagatagctaaagaatgccatttgttggagaagcttgacctttgccagtgccccttagtttccaacaagggtttgatcgcaatcgcagagaactgccctaatttgacctctttgagcattgaatcttgcccaaagattggtaacgagggcctccaagccatcggaaagctttgccccaagctgcagtccatctctatcaaggactgcccacttgttggggatcatggagtttcaagcctgttggcatcagcatcttctgtcctttcaaaggttaagcttcagggattgaacatcacagatttttctcttgctgtgattgggcactatggcaagtctgtgacaaatctaatgctcagtggtctacaaaatgtgagtgagaagggattttgggtcatgggtaatgctcagggtttgcaaaaattggcatctttgatgattacttcttgctggggggtaacagatgtcagtcttgaagccatgggaaagggatgcacaaacctaaagcagatgtgccttcgcaggtgttgctttctttctgatgatggactggtggcttttgccaagtctgcaggttctcttgagtgcctgcagttggaggagtgtaacagggtcacacaatctgggattattcgtgtcctctcaaactgtggattaaaatctcttacgctagtaaagtgcttgggaattaaggatatgtccttgggagctcctttgtcctccacttgcaattcccttaaatccttgtctgtaaggaactgcccaggatttgggactgccagcttggctatggtgggcaaactgtgccctcagcttcagcatgtagatctgagtgggctctatggcatcacagatgcaggtcttctgcctcttcttgagagttgtgaggcaggacttgtgaaggtgaacctgagtggctgcttaaatttgactgatgaggtagtgttggccttgaccagactacatggcggaaccctcgagttgctcaatcttgatggttgcaggaggatcactgatgcaagtttggtagctgttgcagacaattgtgtttttctcagcgatctggatgtatcaaggtgtgcgatcaccgattctggtgttgctgccttgtctcatgctgagcaactcaatttgcaagtcctttctttttcaggttgctctggagtgtcaaacaaaagcatgcctttcctgaaaaaattgggcaagaccttggtggggttgaatctccagcactgcaattcaatcagcagtcgaactgttgagctgcttgtagagagcttgtggagatgtgacacccttttctaattaaggatagaaggctgttgagccagatctgaacaactacacttacggcataaagatggtagaaatatcaaactcatatagtcagctcacacgggtagcaacattcagaacagttttttggtccgacaaagtggtcatgctggttgctctacggcttggtgttttcctggggactttggctgttttgcagatggcctatccatccgttttttgctggctttcttgacatgggaaagcctgttgtaactatcaagcccccatttacccgcggggcagtttcatagccatggttcctggagaactctgtcatcaagtcatggatttagatttccactcatgatcatcagagcatttggttctattttgctggatgtggtctactcagtgttttagcttttgtcatacatttctttacgggagtgcttgactaagctttctttgttttcagtcctatgaagtctgttgtttggatcagtccatcttagttttaagcgtctgtttttcaaaggtcttccggtgtttgaaactcgtgtaggggttcttctgtgtttccttttgtcgcgtctttatagttgctttgagcagttctatgtttgggtgccgcaggttgtggggctgtggcaagggcagtggattcatctgatctgccataacaaccttctgtggttgtttttttcgtttttccacaagtcctagtcttgcaggcttttccttgtgtatgaattgaactactgcaactactctgttattagcaataaagcttaatatttctttgta

SEQ ID NO: 3818 - DNA, 924 bp, Gossypium hirsutum
cgtctctcatccacgtgtgtgaccaccactgtcctcaacacttccctccccccacctgtcacctccttttcctcccttccgtacgctctcctctttataaaccccctcccctgaaatccctctctcatcataaaactcagacaccaattatcatcttccatggaatcccagaatctcaaacaccgttccagggatgaccctcgttttgccaccaccacctccaacgaaaagaacagagcaaacaggcgagaaaaaagaatggcaatggccaaacgtgggctaagatcactagtcatagcagtttccttccctttgtctctcaccttgttaaacatatacttgtttggttcaggtcgtggttacgcctctttagccaaacctttctggttccctcctttgtggcttttacatacaggttgcttggcttcgagcttcgtgatggggctgtcggcttggtttgtttgggttgaaggtgggttccacgttaaaccgacggctttgtctctttatttgggttacttaggattgagtatggcttggcatccgactgtgctttggatgggagctagctgggctgggttgcttgtgagtttggcgatggttgggaccttggtcgggtgttcaagagattttggaaaggtgaatccgattgctggtaactcggttatgccttgtttggcttgggctgcgtttttggccactgtaaatctaaaacttgtcttcctttgaagcatataccaccatcttttgttctgcaagaaatagtccctctatgaataagatcaagttgttggtttgttcattagacagcttagaaagaaacacatgtccttttgattttcctgttgcttcttacagtatcatggttttgttgtacatattgtccttttagcatgtttttcaatggaatgttttgtagtttga

SEQ ID NO: 3819 - DNA, 1118 bp, Theobroma cacao
gccacgtcacagccaccgaaggatacgagggttccacaatatctccaacaaggacgcgtgtaaggacatgaagactccaaaagagttgaggcttttccagatggttcgcgtaacttgtgtccctgtttactccccaactttctattcttctgctttctatatattctctttcccctcaagaatgcttttcaatagccaagcagacaagactgtgtcattaacgtcaaagatcctagcatttcttagctttagattacccgttactaaagtctgaaaatgagccgagttgctgacacaatgaaccactggcttagtttcccagaaaacatcggaaagttgatgttctcttcacggactcaggacacacacgacaacgagaacaaaggcttcagtagcataccagccgacattttggacacacccaaggagttcattttcttcttagatgttccaggcttgtccaagacggatatccaggttactgttgaaaatgagcatacattggtgatcaaaagtggagggaagaggaaacgtgaggaagttgaagaggaagggtgtaaatacatcaggcttgagaggaagccaccccagaagcggatgaggaagatccgattgccggagaatgccaatgcgtcggccattacagctaaatgtgaaaacggggttttgactgtggttgttgagaagcttcctccgccaccaaagcctaaaacagttgaagttgccatagcatgaaagtacgaatgagagccatggttatgtgggaaacaaaaattttgagttcttactgcttccatccaatcaacactagagagtagatagtcttggtcttggggtgggggcttttttgaagtttctcaactgtggaaactggaggaattaaattattgtttgatgtatcaagatgtcatctgtatgtctgtttgcaattctgcattttgcatagtttggactatctcatcagttaagaattagctagtgaaacagccgaattaaaagaaaaatgcaacatctccttcaggttttgtttgattgagaattagtcaaaatgacatcaagatttctatcgagcatataatgtttgtgtacaagataactaataaaatatattagcatgt

SEQ ID NO: 3820 - DNA, 849 bp, Theobroma cacao
  misc_feature (82)..(82): n is a, c, g, or t
  misc_feature (467)..(467): n is a, c, g, or t
cggggaatagccaagcagacaagactgtgtcattaacgtcaaagatcctagcatttcttagctttagattacccgttactanagtctgaaaatgagccgagttgctgacacaatgaaccactggcttagtttcccagaaaacatcggaaagttgatgttctcttcacggactcaggacacacacgacaacgagaacaaaggcttcagtagcataccagccgacattttggacacacccaaggagttcattttcttcttagatgttccaggcttgtccaagacggatatccaggttactgttgaaaatgagcatacattggtgatcaaaagtggagggaagaggaaacgtgaggaagttgaagaggaagggtgtaaatacatcaggcttgagaggaagccaccccagaagcggatgaggaagatccgattgccggagaatgccaatgcgtcggccattacagctaaangtgaaaacggggttttgactgtggttgttgagaagcttcctccgccaccaaagcctaaaacagttgaagttgccatagcatgaaagtacgaatgagagccatggttatgtgggaaacaaaaattttgagttcttactgcttccatccaatcaacactagagagtagatagtcttggtcttggggtgggggcttttttgaagtttctcaactgtggaaactggaggaattaaattattgtttgatgtatcaagatgtcatctgtatttctgtttgcaattctgcattttgcatagtttggactatctcatcagttaagaattagctagtgaaacagccgaattaaaagaaaaatgcaacatctccttcaggttttgtttgaca

SEQ ID NO: 3821 - DNA, 686 bp, Heritiera littoralis
taacgaatttctcgctagcttagcaggcgaaagataaaatctgttagttcttactttgaaagtggtcattcacgtcaaagaatctagcatttctcttccttcctattccaataacgtttggaaatgagccgagttgcagacactatgaaccattggttcagtttcccagagagcatcgagaaattcatgttccaatcacggactcaggatagtcatgagaacgagaacaaggggttcagtagcataccagtagacattttggacactcccaaggagttcattttctgcttggatgttccaggcttgtccaagtccgatatccaggttactgttgagaacgagaccatattggtgatcaaaagcggcgggaagaggaaacgcgacgaagttgaagaggaagggtgtaaatacatcagacttgagaggaagccaccccagaagcttatgagggagttccggttgcctgagaacgccaatgtgtcggctatcacagctaaatgtgaaaatggggttttgactgtggttgttgagaagcttcccccgccaccaaagcctaaaacagttgaagttgccatagattgaaacggatgagtgagaaacaagaagttattggcgttcccattcaaaacaacagtgaacagagagggtggccagatttaggcgttgagggggttgagtttgtcgac

SEQ ID NO: 3822 - DNA, 2189 bp, Ricinus communis
agaagcactcagtccttaccacctactctttacactcgcctcaccaaactcgcaccaataactccgtcatggattccgatttcggcatcccaagagaactctccgacctccaaaaactccgatctctttaccagcctgagctccctccctgccttcagggaactaccgtgagggtagaacttggtgatggtactacagctgcagacgaagctggtgcacacaccataagccgatcctttcctcacacttatggtcagcctttggctcactttctcagggcaactgctaaagttgctgatgctcatatcataagtgaacatccagctatgagggtgggagttgtattttgtggcagacaatctcctggaggtcacaatgtcgtatggggccttcataatgctctcaaaatccacaaccctaacagtactttacttggattcttaggtggctctgaaggattatttgcccagaaaactcttgaagtcacagatgatatcctctcaacctacaagaatcaagggggctatgatttgctgggacggactaaagatcaaataagaacgactgagcaagtacatgctgccttaaccacgtgcaaaaatttgaaattggatggccttgttattattggaggagttacatcaaatacagatgctgctcagcttgctgaaacttttgctgaggcaaagtgcccaaccaaggtggttggtgttcctgtcacattaaatggagatctcaagaatcaatttgtagaaacaaatgttggttttgatacaatttgcaaggttaattctcagctcattagcaatgtctgcactgatgcactctctgctgagaagtattactattttatccggctcatggggagaaaggcatcgcatgttgctttagaatgcacgcttcagtctcatccaaatatggtaattctcggtgaggaggtagctgcatcaaagcttactctttttgacctgacaaaacaagtttgtgatgcagtccaagccagagcagaacaagacaagtaccatggggtcattctactgccagaggggcttattgaaagcattcctgaagtgtatgctctattgaaggaaatacatggtttgctacgacaaggtgttagccccaataacatttcatctcaactctcgccatgggcatctgctttgtttgaatttttgccaccatttatcaagaaacagctgctcctttaccctgaatcagatgactcagcccagttatcccagattgagacagagaaacttcttgcacatcttgtggaggcagaaatgaacaagcggctgaaagaagggacatacaaggggaaaaaatttaatgccatctgccacttttttggttatcaggcccggggttctctgccatctaaatttgattgtgactatgcttatgttcttggacacatctgctaccatgttctggcagctggtctgaatggttacatggcaactgcaactaacctgaagaatcctgtgaacaagtggcgctgtggtgctgctccaattgcagcaatgatgacagtgaagcgttgggctcaaaatccaggtgccacttctataggaaaacctgctattcatccagctgctgttgatttgaaaggcaaagcatatgagcttctcagactaaatgcggtgaagttcttaatggatgacctatacagaaatccaggtccccttcaatttgaaggtcctggtgctgatgctaagccaataactctctgtgttgaagaccaggattacatgggccggatcaagaaattgcaggaataccttgacaaggtacgaactattgtgaaaccaggttgttcgcaggaagtgctgaaagctgctttgagtgtcatggcttctgtgacagatgtgctcttgacaatgtcttcaacttcactagatggccagagacctctttaagacacacaaagtatgcttcttctcaaacttccctggtgctgctgcatagtttgagaattccttgggcacattgtctccttaatttgtatcttgaactgtaggtgcatatcagttagatgcggcaattagctgaattttgcctcttttttttttcttttgctattttatttggaaaaacaactaatttttgttttttaaattacttgtgtgtgtgaaaataaccggaggactatatattgcaagttttgcagagttgagattttgtta

SEQ ID NO: 3823 - DNA, 2238 bp, Tropaeolum majus
cggccgggggacgaacgtaagaccaaagtagcctacttgatggtaccctctcaggacccttttctcatttaaacgtgaaatcagtcttcccaaccaaaaacccctactaacactaaaaccactaacaaccaaaacgccatggattccgatttcggcattcctagagagctttctgatcttcaaaaacatagatctctgtaccagccagacctccctccttgcctccagggaactactgttcgtgttgaatttggtgattcgacaacacccattgaccctgctgatgcgcataacattgctcgagcctttccacacacttatggtcatcctttggctcactttctaagggcaaatgcaaacgttcctgatgctcagatcattaccgagcatccagagaaaagggtcggaatagtgttttctggaagacaatcacctggtggacataatgtcatatggggtcttcatgaagctctcaaaatccacaatcccaaaagcactttacttggatttttaggtggttctgaaggtttgttcgcacagaagaccctagagataacagatgacattctttcgttctacaaaaatcaaggtggttatgatttgctgggacgaacaaaagatcaaattagaacaaccgagcaagttaatgctgcactatctgcatgtaataatttgaaattagatagcctcgtcattattggaggagttacatcaaacactgatgctgctcaacttgctgaaacatttgctgaagcaaattgcgcaacaaaggtggttggtgttcctgttacattgaacggtgacctcagaaatgcatttgtggaaacaaatgttggttttgatactatttgcaaggtcaattcacagcttatcagtaatgtctgcactgatgctctttcggcagagaagtattattacttcatacgtctcatgggtaggaaggcgtctcatgttgctttggagtgcacccttcagtctcatcctaacatggtaattcttggtgaggaggttgctgcttcaaagcttaccctttttgacttgacaacgcagatctgtgacgcagttcaagcaagagcagtacaagataagaaccatggagtcattttactgccagaagggcttattgaaagcattcctgaagtttacgctcttttgaaggaaattcatggattgcttcggcaaggtgtctctgttgatatgatttcgtcccagctttcaccttgggcatctgctttgttcgaatttttgccagcctttattaggaaacagttagtactttatcccgaatctgatgactctgcgcagttatctcagattgagactgagaaacttctagcttatcttgtggagactgaaatgaataagcgcttgaaagaaggcacgtacaaagggaaaaagtttaatgctatctgccacttcttcggatatcaagctcgtggttctttaccatcaaagtttgactgtgactatgcttatgtgctcggacacatctgctatcatgttcttgccgctggtttgaatggttacatggcaactgtaactaatctgaaaaatcctgtcaacaagtggaaatgtggggctgcaccgatttcagcaatgatgactgtgaggcgctggtctcaaaacccaggtgctactatgattggtaaacctgctattcatccagctactgttgatttgaaagggagagcatatgacctattgaaacagaatgctcagaagtttttgttagatgatctctacagaaatccaggacccctgcagtttgatggtcctggtgctgatgctaagcctgttactctctgtgtcgaagaccaggattacatgggacgtatcaagaaacttcaagaatatcttgacaaggtcaaaaccattgtgaaaccaggatgttctcaagaggtcctgaaagcagcattgagtgttatgggctctgtgacagaggtactcactgtcatgtcttcttcttcaggccatctttaagatctaaactcggacgtacgtttttcttgtattcctggggccgctggaaaagtgagttttagtggtaatttaatctcgtgtttcttaatttacttatcaacttagaggtgcataaatttgttattccctaataaattgacttcttccacttattcttattgcatattactattactattactattactattactattactattactattagattagtatcaacgtctgattttgtccattaacttatgtttatctgat

SEQ ID NO: 3824 - DNA, 2166 bp, Citrus clementina
gtaacaaaccaaacaaaaaccccaatcagtatagtagtactgcacacaacacagtcaataccaaataccaaaaaaacgcaacaaacagtaataaccatccactgaaacgaaaacacaatggactcggatttcggtattccgagagaactctccggccttcaacaactccgatctctttaccagcccgagctccctccttgccttcagggaactactgtcagggtggaatttggtgattcaactacaactgctgacccagctgatacccattccattagccgatcctttcctcacacttacggtcagcctttggctcactttcttagagcaactgccaaagtacctgatgctcaaattataactgagcatcctgctattagggtgggaattgtcttctgtggaagacaatctcctggtggacacaatgtcgtttggggcctttacgatgcgctcaagctacacaaccctaagagtactttgcttggatttttgggtggttctgaaggtttatttgcacagaaaactcttgaggtcacaaaagaaattctttcaacctacaaaaatcaaggtggttatgacatgctgggacgcacaaaagatcaaatcagaacaacagagcaagtcaatgctgcactaactgcatgcaaaaatttgaacttggatggccttgtcattattggaggggtcacatcaaacacagatgctgcataccttgctgaaacatttgctgaagcaaaatgcccaacaaaggtggttggtgttcctgttactttgaatggagatctcaagaatcaatttgtggaaaccaatgttggttttgatacaatatgcaaggtcaattcacaactgatcagtaatgtgtgcactgatgctctctctgcagagaagtattattattttattcgtctgatgggtaggagggcatcacatgttgctttggaatgcacccttcagtctcatccgaatatggtaattctaggtgaggaagtggctgcttcaaagcttactctgtttgatctaacgaaacaaatttgtgatgctgttcaagccagagcagaacaagacaagaaccatggggtcatcctgctgccagaagggctcatagaaagcattcctgaagtatatgctctattgaaggaaattcacagtttgctgaggcaaggagttcctgttgataacatttcttctcaactttcaccctgggcgtctgctttgtttgaatttttaccacccttcatcaagaaacagcttcttcttcaacccgagtcagatgattctgcacaattatcccagattgagacggagaaacttcttgcacatcttgtggaagttgaaatgaacaagcgcctgaaagagggcacgtacaagggtaaaaagttcaatgcaatctgccactttttcggttatcaggctcgtggatcattgccatcgaaattcgactgtgactatgcctacgttcttggacacatctgctaccatattcttgctgctggtttgaatggttacatggctactgtgactaatcttaagaatcctgcgaacaagtggcgttgtggtgctgctccaattacatcaatgatgactgtaaaacgttggtctcaaaatccgggtgcttcttcaattggacgaccggctattaaccccgctactgtggatatgagaggcaaagcttatgagctcttgagacaaaatgcaacaagattcttgttggacgacctctacagaaatcctggacccgttcagtttgatggtcctggtgcagatgctaaggctgtaactctgtgtgttgaagaccgggattacatgggccgtattaaggaactgcagaagtatctagacgaggttcgaaccatagtgaaaccaggttgttcacaagaggtactgaaagcagctttgagtgttatggcttctgtgacggaagttctctcagcaatgtctgcatctggaggccagacaacactttaagacgaagttggctgattatgctttgctttcttctttaagacaacttagctgattatgcttgctttcttcttcttttgccaagccatttactgtgtattggtagtaatgaattgagttcattctcttttgttattctatccagtgttacatttttgtccgatatagataataactagagaggtatgcattgcgagtttttgg

SEQ ID NO: 3825 - DNA, 2166 bp, Citrus sinensis
gtaacaaaccaaacaaaaaccccaatcagtatagtagtactgcacacaacacagtcaataccaaataccaaaaaaacgcaacaaacagtaataaccatccactgaaacgaaaacacaatggactcggatttcggtattccgagagaactctccggccttcaacaactccgatctctttaccagcccgagctccctccttgccttcagggaactactgtcagggtggaatttggtgattcaactacaactgctgacccagctgatacccattccattagccgatcctttcctcacacttacggtcagcctttggctcactttcttagagcaactgccaaagtacctgatgctcaaattataactgagcatcctgctattagggtgggaattgtcttctgtggaagacaatctcctggtggacacaatgtcgtttggggcctttacgatgcgctcaagctacacaaccctaagagtactttgcttggatttttgggtggttctgaaggtttatttgcacagaaaactcttgaggtcacaaaagaaattctttcaacctacaaaaatcaaggtggttatgacatgctgggacgcacaaaagatcaaatcagaacaacagagcaagtcaatgctgcactaactgcatgcaaaaatttgaacttggatggccttgtcattattggaggggtcacatcaaacacagatgctgcataccttgctgaaacatttgctgaagcaaaatgcccaacaaaggtggttggtgttcctgttactttgaatggagatctcaagaatcaatttgtggaaaccaatgttggttttgatacaatatgcaaggtcaattcacaactgatcagtaatgtgtgcactgatgctctctctgcagagaagtattattattttattcgtctgatgggtaggagggcatcacatgttgctttggaatgcacccttcagtctcatccgaatatggtaattctaggtgaggaagtggctgcttcaaagcttactctgtttgatctaacgaaacaaatttgtgatgctgttcaagccagagcagaacaagacaagaaccatggggtcatcctgctgccagaagggctcatagaaagcattcctgaagtatatgctctattgaaggaaattcacagtttgctgaggcaaggagttcctgttgataacatttcttctcaactttcaccctgggcgtctgctttgtttgaatttttaccacccttcatcaagaaacagcttcttcttcaacccgagtcagatgattctgcacaattatcccagattgagacggagaaacttcttgcacatcttgtggaagttgaaatgaacaagcgcctgaaagagggcacgtacaagggtaaaaagttcaatgcaatctgccactttttcggttatcaggctcgtggatcattgccatcgaaattcgactgtgactatgcctacgttcttggacacatctgctaccatattcttgctgctggtttgaatggttacatggctactgtgactaatcttaagaatcctgcgaacaagtggcgttgtggtgctgctccaattacatcaatgatgactgtaaaacgttggtctcaaaatccgggtgcttcttcaattggacgaccggctattaaccccgctactgtggatatgagaggcaaagcttatgagctcttgagacaaaatgcaacaagattcttgttggacgacctctacagaaatcctggacccgttcagtttgatggtcctggtgcagatgctaaggctgtaactctgtgtgttgaagaccgggattacatgggccgtattaaggaactgcagaagtatctagacgaggttcgaaccatagtgaaaccaggttgttcacaagaggtactgaaagcagctttgagtgttatggcttctgtgacggaagttctctcagcaatgtctgcatctggaggccagacaacactttaagacgaagttggctgattatgctttgctttcttctttaagacaacttagctgattatgcttgctttcttcttcttttgccaagccatttactgtgtattggtagtaatgaattgagttcattctcttttgttattctatccagtgttacatttttgtccgatatagataataactagagaggtatgcattgcaagtttttgg

SEQ ID NO: 3826 - DNA, 2171 bp, Citrus sinensis
caaaaaccccaatcagtatagtagtactgcatacaacacagtcaataccaaataccaaaaaaaacgcaacaaacagtaataaccatccactgaaacgaaaacacaatggactcggatttcggtattccgagagaactctccggccttcaacaactccgatctctttaccagcccgagctccctccttgccttcagggaactactgtcagggtggaatttggtgattcaactacaactgctgacccagctgatacccattccattagccgatcctttcctcacacttacggtcagcctttggctcactttcttagagcaactgccaaagtacctgatgctcaaattataactgagcatcctgctattagggtgggaattgtcttctgtggaagacaatctcctggtggacacaatgtcgtttggggcctttacgatgcgctcaagctacacaaccctaagagtactttgcttggatttttgggtggttctgaaggtttatttgcacagaaaactcttgaggtcacaaaagaaattctttcaacctacaaaaatcaaggtggttatgacatgctgggacgcacaaaagatcaaatcagaacaacagagcaagtcaatgctgcactaactgcatgcaaaaatttgaacttggatggccttgtcattattggaggggtcacatcaaacacagatgctgcataccttgctgaaacatttgctgaagcaaaatgcccaacaaaggtggttggtgttcctgttactttgaatggagatctcaagaatcaatttgtggaaaccaatgttggttttgatacaatatgcaaggtcaattcacaactgatcagtaatgtgtgcactgatgctctctctgcagagaagtattattattttattcgtctgatgggtaggagggcatcacatgttgctttggaatgcacccttcagtctcatccgaatatggtaattctaggtgaggaagtggctgcttcaaagcttactctgtttgatctaacgaaacaaatttgtgatgctgttcaagccagagcagaacaagacaagaaccatggggtcatcctgctgccagaagggctcatagaaagcattcctgaagtatatgctctattgaaggaaattcacagtttgctgaggcaaggagttcctgttgataacatttcttctcaactttcaccctgggcgtctgctttgtttgaatttttaccacccttcatcaagaaacagcttcttcttcaacccgagtcagatgattctgcacaattatcccagattgagacggagaaacttcttgcacatcttgtggaagttgaaatgaacaagcgcctgaaagagggcacgtacaagggtaaaaagttcaatgcaatctgccactttttcggttatcaggctcgtggatcattgccatcgaaattcgactgtgactatgcctacgttcttggacacatctgctaccatattcttgctgctggtttgaatggttacatggctactgtgactaatcttaagaatcctgcgaacaagtggcgttgtggtgctgctccaattacatcaatgatgactgtaaaacgttggtctcaaaatccgggtgcttcttcaattggacgaccggctattaaccccgctactgtggatatgagaggcaaagcttatgagctcttgagacaaaatgcaacaagattcttgttggacgacctctacagaaatcctggacccgttcagtttgatggtcctggtgcagatgctaaggctgtaactctgtgtgttgaagaccgggattacatgggccgtattaaggaactgcagaagtatctagacgaggttcgaaccatagtgaaaccaggttgttcacaagaggtactgaaagcagctttgagtgttatggcttctgtgacggaagttctctcagcaatgtctgcatctggaggccagacaacactttaagacgaagttggctgattatgctttgctttcttctttaagacaacttagctgattatgcttgctttcttcttcttttgccaagccatttactgtgtattggtagtaatgaattgagttcattctcttttgttattctatccagtgttacatttttgtccgatatagataataactagagaggtatgcattgcaagtttttggaagatcaaaatttttcc

SEQ ID NO: 3827 - DNA, 2276 bp, Populus trichocarpa
cgcccgaccacaacacttctacttctactaactcatcacctacctaagaacaagaagaagagaaaagcggcatggattccgatttcggcattcccagagaactttccgatctccagaaacttcgatctctttaccaaccagaacttcctccctgtcttcagggaactgcagtgagggtagaacttggtgatgcaaccactgctgcagacccagctgatgtccacagcataagccgatcctttcccctcacttatggccagcctttagctcacttcctcagggcatctgctaaagtctctgatgctcaaatcataactgaccatccagctttcagggtcggaatagttttttgtgggagacaatctcctggaggacataatgtcatatggggtcttcacaacgctcttaaaatccataaccctaacagcactttacttggatttctaggaggttctgaaggtttattcgctcagaaaacacttgaaattacagatgacattctttcaacctacaaaaatcaaggtggttatgatttgttgggacggacaaaagatcaaataagaacaactgaacaggttaatgctgctctaactgcatgcaaagatctgaaattggatggccttgttatcattggaggagttacttcaaatacagatgccgctcagcttgctgaaacatttgccgaggcaaaatgcccaacaaaggtggttggtgttcctgttactttaaatggagatctcaagaatcaatttgtggaaaccaatgttggttttgatacaatatgcaaggtcaattcccagctcatcagcaatgtctgcacggatgctctctctgcagagaagtattattatttcatccggctcatgggccgaaaggcatcacatgttgctttggaatgtacacttcagtctcatccgaacatggttattcttggcgaggaggtggctgcatcaaagcttactctttttgacttgacaacacaaatttgtgatgcagtccaagcccgagcagtgcaagacaagaatcatggagtcattctactgccagagggactcatagaaagcattcccgaggtctatgctctcttgaaggaaatacatggcttactcaggcatggtgttgcccctgacaacatttcatcacagctttcaccatggacatctgctttatttgaatttttgccaccatatattaagaagcagctgctgcttcatcctgaatcagatgactcggcacaattatcccagattgaaacagagaaacttctagctcatcttgtggagacagaaatgaacaagcggctgaaagaaggcacatacacggggaaaaagttcaatgctatctgccacttttttggttatcaggcccgtgggtctttaccatcgaaattcgattgcgactatgcctatgttcttgggcacatcagctaccatattttagcagctggtttgaatggttacatggccactgtaactaacctaaagaatcctgtgaacaagtggcgatgtggtgctgctccaattacagcaatgatgacagtgaagcgttgggctcaaagccctggtgcatcttcaattggaaaacctgctattcatcctgctactgtggatttgaaaggcaaagcatatgagctgctgagacaaaatgcaggaaggttttggatggatgacctgtacagaaatccaggtccccttcaatttgatggtcctggtgcggattctaaggctgtaactctctgtgttgaagaccaggattatatgggcgggatcaagaagctgcaggaataccttgacaaggtaagaaacattgtgaaaccagggtgttctcaggaagttctgaaagctgctttgagtgtcatgtcttccgtgacagatgttctctctgttatgtcttcaacttcatccaatggccagacacctctgtaagagtacagcttaaaatgttctttcctcgatccaccccgatgttgctgcttggtttgacaattacatactcccatcggcgcacattgtgccatttttcttaatttttattttgaagattttaattagatggtaatgagccaattcttcatctctttaatcagcggtaactttcccgcgtgaggacaatgagcaaagatggaattttgtttatgttgcgtcgtgtttgattatgtgtgcggacgcctccgttgtatctctattcagcaagtcgcatgatagagttgtaactttcaagatttgaaactatttttatcctaaatgaaagttggaaactagaacaaccttacgtgt

SEQ ID NO: 3828 - DNA, 2142 bp, Vitis vinifera
ctaacagagaccgaggctcggagacaagagggcagagcgaaagcgaagcgatggattcagatttcggcattcccagagaactctcggatcttcaaaaacaccgatgtctttacgaacctgaactccctccttgccttcaggggactactgtcagggtagaatttggtgatgcaacaactgcttcagacctctctggtgcccgcacaataagccgatcctttcctcacacatatggtcagccattggctcactttctcagggctactgcaaaggtccctgatgctcaggttataactgagcatccacccattagggtgggagtggtcttctgtgggagacaatctccgggaggacacaatgtcatatggggtcttcacaatgctctcaaaattcacaaccctaagaatattttacttgggtttttgggtggctctgaaggtttatttgctcagaaaactcttgagatcactgatgacattctttcaacctacaagaatcaaggtggttatgatttgcttggacggacaaaggatcaaataagaacaactgaacaagttaatgctgcattatccacatgcaaaaatttgaagttggagggccttgtcattattggaggggtgacatcaaacacagatgctgctcagcttgcagaaacctttgcagaagcaaaatgccaaacaaaggtggttggggttcctgttagtttgaatggggatctgaagaaccaatttgttgaaagcaatgttggttttgatacaatatgtaaggtcaattcccaactcatcagcaatgtctgcactgatgctctttctgcagagaagtattattattttatccgactcatgggccggaaggcatcacatgttgctttggagtgcactcttcagtcacatccaaatatggtcattcttggtgaggaggtggctgcatcaaagcttactctttttgacttgacaaaacaaatttgtgatgcagttcaagccagggctgaacaagacaagtatcatggtgtcatcctacttcctgaaggacttattgagagcattcctgaagtttatgctctcttgcaggaaattcatggtttgctcaggcaaggtgtttctgctgttaacatttcttctaaactttcaccttgggcatctgccttgttcgaattcttgccaccctttatcaagaagcagctgctcctttaccctgaatcagatgactcagcacagttatctcagattgaaacagagaaacttctcgcacatcttgtggaggcagaaatgaacaaacgattgaaggaaggtacatacaaggggaagaaattcaatgccatctgccacttctttggttatcaggctcggggatccttaccatcaaaatttgactgtgattatgcctacgttcttgggcacatttgctaccatgttctagcagctggcttaaatggttacatggcaactgtaactaacctaaagaatcctgtgaacaaatggcgttgtggtgccgctccaatcacagcgatgatgactgtaaagcgttattcccgtggtcctgggacctcttcaattggaaaacctgctgttcatccttatgctttggatctgaagggcaaagcatatgagcttctgagtcaaaatgcaacaaaatttttgctggacgatctttacagaaacccaggacccctccagtttgatggtccaggtgctgatgccaaggctgtgactttgtgcgttgaggaccaggattacatgggtcgtatcaagaaactccagcaatatcttgacaaggtgcgaaccattgtgaaaccaggatgctcacaggatgttctcaaagcagctttgagtgccatggcttctgtgacagagattctctctgtaatgacatcaccttctagtggccagacaccgctttgaaagtcgaaccaattgcacccttcccttggaactttctggtgccgctgctaatggtactggaattccaatatccactgtgccttttttgtctggtttctggtaatttatatgctgaacttcttgttaggtacagaacgcttaggtgatggcaataaactgagttttgctctggtgtaaacttcacaaaataattatgagagaattgtactgcggtttttttttaaagacgaaattttgtcct

SEQ ID NO: 3829 - DNA, 2153 bp, Silene vulgaris
aaaatccggagccgaaaatatggattcagatttcggaattcccagagaactctctgatcttcaaaaacaacgttctctttatcaccctgaacttcctccttgtcttcagggaaccacagtaagggtagagtatggcgacacaaccacctctttggatccatcagatgcccatgccatcagccggtattttccccacacatatggtcaaccattggctcactttctaagagaaactgccaaggtcgcagatgcaaaaatcattactgagcatccagctatcagggtgggattggtgttcagtgggcgacagtccccaggaggacacaatgttatttggggtctttacaatgctcttaaaacacacaacgagaacaatgttttgcttggatttcttggtggtactgaagggttgtttgcacaaaaaactcttgagatatctgatgatattttgtctacctacaaaaatcagggtggttatgacttgctgggaaggacaaaagatcagataagaacaactgaacaagttaatgctgcacttgcttcatgcaaggctttgaagttggatgggcttgtaatcattggaggtgtgacatccaataccgatgctgctcaactcgcagaaacatttgccgatgctaaatgtgcaactaaggtagttggagttccggttaccctgaatggagatttgaagaatcaatttgtcgaggctgatgttggcttcgataccatttgcaaggttaactctcagctcatcagcaatgtttgcactgatgcattgtctgccgagaagtattattacttcattcgactcatgggtagaaaggcatcacacgttgctttggaatgcactcttcagtcacacccaaacatggttgtccttggggaggaagtggcagcttcaaaacttactttgtttgatgtgacaaaacaaatttgtgatgcagttcaagccagggcggaaacagacaaaaaccacggagttatcctactcccggaagggcttattgaaagtattcctgaagtgtatgctctcctgcaggaaattcacagtcttcatagagaaggtgtatctattgaaaatatttcttctcaactctctccctgggcatctgctttgtttgagttcctgccaccttttattaagaaacagttgctccttcaccccgagtcagatgactctgcccaactgtcacagattgagactgagaaactgctagcgcaccttgtggaaacagagatgaataaacgcctgaaagaaggcacttacaagggcaaaaagtttaatgccatctgccacttttttggctaccaagctaggggatccttaccatcaaaattcgactgtgactatgcatatgtgcttggacatatatgctatcatattctagcagctggtcttaatgggtacttggcaactattaccaaccttaaaaatcctgtcaataagtggaaatgtggtgctgctccattaacggcaatgatgactgtcaaacgttactctcgtggtcctgctggcactttatctattggaaaacctgcaattaatcctgctaccgtggatttgaaaggcaaggcatatgaacttttgagacaaaatgctacgaggtttttgattgaagatatctaccgaaatcctggcccacttcaatttgatggtcctggagctgatgcgaaggctgttacgttatgcgtggaagaccaggattatatgggccgcattaagcagcttcaggtgtatttagacaaggtacgctccatagtgaaaccaggatgctcacaagatgttttaaaagcagcactgagttccatgtcctcagtaaccgaaattctctctcttatgtcatcaaactctaacagtggccaaagaatgatctgaggattcccgagttttcaacgctacccccgtcccccgcttatccatcgatgcatcttcgggttagataattcatttgcgtctttcttaggagttgcaatgttaggatttttgttgaacacgagaggcattttcggaatgatgcgacattttacatagaataattatgagaactgtgagtgtgattttgttacgaatagaactttgcagttggttgttgagacttcagatgactttaaacagtattcttcctttcagtatttgaagatcttctgttgac

SEQ ID NO: 3830 - DNA, 2208 bp, Fragaria vesca
tagtgctactactaactttccaccaaaccacagtaccaaccaattccaattctctcactactcatggattccgactacggcattccccgggagctctccgccgtccagaagctccgatctcaataccagccggaccttcctccttgcctccagggaactactgtaagagttgaatttggggacacaaccacagcggcagaccccacagatgccaataccattagccgatactttccaaacacttatggtcagcctttggctcactttctgagggcaactgcaaaagttgctggtgctcaggttatttcagagcatccggctatgagggttggaattgtcttttgtgggagacaatctcctggaggacacaatgtcatctggggacttctcaaggctctcaaaactcataaccccaacagtaccttacttgggtttttgggtggatctgaaggtttatttgcacagaaaactcttgagataacagatgatgttcttgccacctacaaaaatcaaggtggttatgatttgcttggacggacaaaagatcaaattagaacaaaggagcaagtcaacgctacgttaactgcatgcaatgctttgaagttggctggccttgtcataattggaggggtgacatcaaacactgatgctgctcagcttgcagagacattcgcagaagcaaaatgccagacaaaggtggttggagttcctgtcactatgaacggagatcttaaaaaccagtttgtggaagctaatgttggttttgatacagtatgcaaggtcaattcccagctcatcagcaatatgtgcacagatgctctttctgctgaaaagtattattatttcattcgactcatgggccggaaagcatcacatgttgccttggagtgcacccttcaatctcatccaaacttggtaattcttggtgaggaggtggctgcatccaagctaacgctttttgacattgcaactcgaatctgtgatgccgtccaagaccgtgccgcacaagacaagaatcatggtgtcatcctattaccagaaggacttatagaaagcattcctgaagtgtatgccctcctgaaggaaattcatggtttgtataggcaaggagtttctgctgataagattttgtctcaactctcaccatgggcatctgctttgtttgaatttttgccacattttatcaagaaacagctgcttcttttgcctgaatcagatgactctgcacagttatctcagattgagacagagaaacttcttgcacatcttgtggaggtggagatgaacaagcgccaaaaagaaggcacatacaaggggaagaagttcaatgctatctgccactttttcggttatcaggctcgggggtctttaccatcaaagttcgattgtgactatgcctatgttcttgggcacatctgctaccacatgcttgcagctggtttgaatggttacatggcaactgtaactaatctgaaaaatcctttgaacaagtggcgttgtggtgctactccatttacggccatgatgtccgtaaagcgctggtctcaaaatcctgggtctgctgcatctattggaaaacctggcatatttcctgctaccgtagatttgaaaggcaaagcatacgagctattgaggcaaaacgctacaaaattcctgctggatgatatctacagaaatccagggcctctccaatttgaaggtcctggtgccgattccaaggctgtaacactctgcgttgaagaccaggattacatggggcgcatcaagaaattgcaggaatatcttgaccagattcgaaccattgtgaagcctggatgctcacaggaggttctgaaagcagcattgagcgtcatgggctccgtatcagaagtcctaaccgttatgtcttcatcttcattgaatgccccgtcatctctttaagagcatttttcttgttcttcgatcaagctgctgtacagggagagtgctaaatgtttcacatctcccatgtctcatatgaggaactataggtttggaagtgtcaaattatggcaataattagatttggaatttttccccttttgatttaacactgttaaaaataatcgagttatattaaattttggcacagatgaaacgatttttgtgataataaggtgatatggtctttttcttctctggtctttttcttctttcataacatgcagtcatgaaattatatttgaactt

SEQ ID NO: 3831 - DNA, 1856 bp, Actinidia deliciosa
  misc_feature (456)..(456): n is a, c, g, or t
  misc_feature (747)..(747): n is a, c, g, or t
aaagaaagagaatcagtaatggattctgattacggaataccaagagagctctccgatattcaaaagcttcgatctacctaccagccccagcttcctccttgccttcagggaactactgttagggtggaatttggagatgcaactactgctgaagacccctctggtgcccacaccattagtcgaacctttccgcacacgtatggtcaacctttggttcactttcttagggcaactgcaaaggtccctgatgctcagataattacttttcatccagcaattagagtgggagtggtcttctgtgggagacagtctcctggagggcataatgttatatggggtcttcacaatgctctgaagattcacaaccctaacagtgctttagttggatttttgggtggttctgaaggtttatttgcgcagagaactcttgagatcacagatgacattcttgcaacntacaaaaatcaaggtggttatgatttgttgggacggacaaaagatcaaataagaacaactgagcaagttaattctgcgctggccgcatgcattgctttgaagttggatggtcttgtcattattggaggggtaacatcaaacacggatgcggctcagcttgcagaaacattcgcagtggaaaagtgcccaacaaaggtggttggggttcctgttactttaaatggagatctcaaaaaccaatttgttgaaacaaatgttggctttgatacgacatgtaaggttaattcccanctcattagcaatgtctgcactgatgctctctctgcagaaaagtattattattttatccgactcatgggccgtaaggcatcacacgttgctttggagtgcacacttcagtcgcatccaaattcggttattcttggtgaggaggtgtctgcatcaaagcttacactttttgacctgacaaaacaaatttgtgatgcagtgcaagccagagcagaccaagacaagtaccatggagtcattctgctaccagaggggcttattgaaagcattcctgaagtgcatgcactcttacaggaaatccatggtttgctcaggcaaggtgtctctcttgataatatttcttctcaactgacaccttgggcatctgctttgtttgaatttttgccaccctttattaggaagcagttcctccttttcccagaatcagatgattcggcacagttatcccagattgagacagagaaacttttagctcatcttgtggaagcagaaattaacaagagactgaaagaaggcacgtacaaagggaaaaaatttaatgccatctgccacttctttggttatcaagcacggggatcattaccatcgaagtttgactgtgattatgcctatgttctggggcacatctgttatcacattttggcagccggtctgaatggttatttagcaactgttactaacctgaaaaatcccgtgaacaagtggcgttgtggtgcagctccaataacggcaatgatgactgtaaagcattatggtcgtggtcctggggcctcgtcaattggaaagcctgctctgcatcctgctgcagtggatttgagaggcaaagcatatgagctgctgagacaaaatgccacaaagttcttgatggacgatgtttacagaaatcctggacctcttcaatttgatggtcctggtgctgatgctaagcctgtaacactttgtgttgaagaccaggactacatgggccgtattaagaaactgcaggagtatcttgacaaggtgcgaaccattgtgaaaccaggttgttcacaggatgttctcaaggcagctttgagtgccatgtcttctgtgacagacattctctcagtaatgtcttcattttcaaacagcgg

SEQ ID NO: 3832 - DNA, 2314 bp, Nicotiana tabacum
  misc_feature (560)..(560): n is a, c, g, or t
  misc_feature (1251)..(1251): n is a, c, g, or t
  misc_feature (1975)..(1975): n is a, c, g, or t
  misc_feature (1980)..(1980): n is a, c, g, or t
  misc_feature (2031)..(2031): n is a, c, g, or t
  misc_feature (2133)..(2133): n is a, c, g, or t
  misc_feature (2135)..(2135): n is a, c, g, or t
gttattcggcacgagggtgagagtgagagtgagtagtaggtgaatatcacaatggatgcagattacggaatagctagagaactttctgatctgcaaaaacatcgatctcagtaccaaccagaacttcctccttgtcttcagggcactactgtgcgggtagagctaggtgatgcaaccactgcatcagatccctctggtgaacacacaataagtcggtcttttcctcacacttatggtcagcccttagcccattttcttagggcaactgctaaggtcactgatgctcagataattactgagcatccggcaaagagggttggagttgttttctgtgggagacaatcacctggagggcataatgtaatatggggtattcatgacgctcttaaaattcacaatcctaacagcactttgcttggtttttagggtggttctgaaggtttatttgctcagaaaaccctagagatcaccaacgatgttctttccacctataagaatcaaggtggttatgacatgctgggccggacaaaagatcaaattagatcgaccgagcaagttantgccgcgatggctgcatgcaaaactttgaaattggacgcccttatcattgttggaggggtaacatcaaacactgatgctgctcagctggcagaaacatttaccgaagcaaaatgccaaacaaaagtggtaggagttcctgttacgttaaatggagatctaaagaatcagtttgttgaaataaatgtcggttttgacacaatatgcaaggttaactcccaactcattagcaatgtctgcactgatgcgctctcggcagaaaagtactactatttcatccgactcatggggcgaaaggcatcacatgttgccttagaatgcactctgcagtcacatcctaatatggtgattcttggtgaggaggtagctgcgtcaaagctaactctctttgacatcacaaaacaaatttgtgacgcagttcaggctagggctgaacatgacaaaaaccatggtgttatcctgttgccagaggggcttatagaaagtattcctgaagtatatgctctattgcaggaaattcatggtttactcaggcaaggtgtttctgctgataagatttcctcccaactatcaccatgggcttctgcgcttttcgagttcttgccgtattttatcagaaagcagcttcttctttacccagaatcagatgactctgctcagctatcacagattgagaccgagaaacttatagcncatctcgttgaaacagaaatgaacaagcgattgaaagaaggaacttacaaaggaaagaaatttaatgctatttgccatttctttggttatcaagcacgaggttcattgccttcaaaatttgattgtgactatgcctatgtacttggtcatgtttcctaccatattttggctgctggtcttaatggttacatggctactgtgaccaacttgaaaaatccagtcaacaagtggcactgtggtgctgctcctatatctgccatgatgactgttaagcgctatggtcgtggtcccggcaaagcgtcaattggagtacctgctttgcatcctgctactgtagatttgaaaggcaaatcgtacgaactgttgagtcaaaatgcgacaaagttcttgttggatgatgtttacagaaacccagggcccctccagtttgatggccctggtgcagatgccaaggccgttactctttgtgttgaagaccaggattacatgggtcgtatcaagaaattgcaggagtacctggacaaggtgcgtacaattgtgaagcctggatgctcacaagacgtcctgaaagctgcattaagtgccatggcttctgtgaccgacattctttcagtgatatcctcaccctcaagtgtgaacacaccattttaaatgagaattatcatcttttaacattgagattgctttgcttttcttttattcccctccaaggttctcttcttgnattcnggggaaacttgacttagatgcagagcagttagttgattgtgtgataatatnggtttccatctttggcggctgtctgcttctttgttttgtgccctttctttttccagttttgtaaaagccaaataatgttgagaagtttgtaccttttgaggntngttgagggatccaaaaattcttggttaataacatatagtattaagttaagttgtgaggagttgggaactcaatttgaagttcccgctgatgctgaagaccatttgaagccagcagttatttttgatgtaatttattggcactggagtttgaaatctctcgcttggcagcggccgcatga

SEQ ID NO: 3833 - DNA, 2213 bp, Solanum lycopersicum
ggggggagagagaaacacaaacagagtgagtgagtgtgtgcgtagtaggtgaaaaatatcagaaatggatgcagattacggcatagctagagaactctctgatctgcaaaagcttcgatctcagtatcaacctgagcttcctccttgtctacagggtactactgtgcgggtagagctaggtgatgcaaccactgcagcagatccctctggtgaacatgtaataagtcggtcttttcctcacacttatggtcagccattggcccattttctcagggcaactgccaaagtctctgatgctcagataattaccgagcatccagcgaagagggttggaattgttttctgcgggagacaatctcctggtggacataatgtgatatggggtattcatgacgcccttaaaattcacaatcctaacagtactttgcttggttttctgggtggttctgaaggtttatttgcacagaaaaccctagagatcaccaatgatattcttgccacctataagaatcaaggtggttatgacatgctgggtcggacaaaagatcaaattagaacaaccgagcaagttaatgctgcaatggctgcatgcaaagctttgaaattggatgcccttattattatcggaggggtaacatcaaacactgatgctgctcaactggccgaaacatttgccgaagcaaaatgccaaacaaaagtggttggagttcctgttacattaaatggagatctaaagaatcagtttgttgaaacaaacgtcggttttgacacaatatgcaaggtgaactcccaactcattagcaatatgtgcactgatgcgctctcggcagaaaagtactactatttcatccgactcatggggcgaaaggcatcacatgttgccttagagtgcactctgcagtcacatcctaatatggtaattcttggtgaggaggtatctgcatcaaagcttactctttttgacataacaaacaaaatttgtgatacagttcaagctagggctgaacaagataaaaaccatggtgtgatcctgttgccagaggggcttattgaaagtattcctgaagtatatgctctactgcaggaaattcatggcttgctcaaacaaggcgtttccgctgataagatttcctctcaactatcaccttgggcatctgcgctctttgagttcttgccgccctttataaaaaaacagctcctcttacacccagaatcagatgattctgctcagctatcacagattgaaaccgagaaacttctagctcatctggtggaaacagaaatgaataagcgattgaaagaaggaacttacaagggaaagaaatttaatgcaatttgccatttctttggttatcaagctcggggatcattgccatcaaagtttgattgtgactatgcatatgtacttggtcacgtctgctatcatattttggctgctggcctcaatggttacatggctacattgactaacttgaagaatcccgtcaacaagtggcgctgtggggctgctcctataactgctatgatgagtgtgaagcggtatggtcgtggtcctggcaaggcatcacttgggaagcctgctgtgcatccagccactgtagatttgaagggcaaatcatacgaattattgagtcaaaatgcgacgaagttcttgctcgatgatgtttacagaaacccaggccccctccagtttgatggccctggtgctgacgcaaaggctattactctttgcgttgaagaccaggattacatgggtcgtatcaagaaattgcaagagtatctggacaaggttcgtacaatcgtgaagcctggatgctcacaagatgtcctgaaagctgctctgagtgccatgtcttctgtcacagaaatcctttctgtgatggcctcgccttcaagcaatgcgaacacaccattctagatgagaacacccctaaacctcacggaaaatttaggaggcagacatatttgtcaaacttaacagaattcatagcctcccctccccactccccccacccacctacccacccttttttccccctccgatcgtcttttccactttgcataaactttatttagttacagaaatgttagtcggattgtatgacattagagaggctttcaactgtctttactcttgtagattgttttctttatttgtgtttttgaaattttgacgacctgaataatgttgagatttgagaagatagtattta

SEQ ID NO: 3834 - DNA, 1992 bp, Solanum lycopersicum
ggggggagagagaaacacaaacagagtgagtgagtgtgtgcgtagtaggtgaaaaatatcagaaatggatgcagattacggcatagctagagaactctctgatctgcaaaagcttcgatctcagtatcaacctgagcttcctccttgtctacagggtactactgtgcgggtagagctaggtgatgcaaccactgcagcagatccctctggtgaacatgtaataagtcggtcttttcctcacacttatggtcagccattggcccattttctcagggcaactgccaaagtctctgatgctcagataattaccgagcatccagcgaagagggttggaattgttttctgcgggagacaatctcctggtggacataatgtgatatggggtattcatgacgcccttaaaattcacaatcctaacagtactttgcttggttttctgggtggttctgaaggtttatttgcacagaaaaccctagagatcaccaatgatattcttgccacctataagaatcaaggtggttatgacatgctgggtcggacaaaagatcaaattagaacaaccgagcaagttaatgctgcaatggctgcatgcaaagctttgaaattggatgcccttattattatcggaggggtaacatcaaacactgatgctgctcaactggccgaaacatttgccgaagcaaaatgccaaacaaaagtggttggagttcctgttacattaaatggagatctaaagaatcagtttgttgaaacaaacgtcggttttgacacaatatgcaaggtgaactcccaactcattagcaatatgtgcactgatgcgctctcggcagaaaagtactactatttcatccgactcatggggcgaaaggcatcacatgttgccttagagtgcactctgcagtcacatcctaatatggtaattcttggtgaggaggtatctgcatcaaagcttactctttttgacataacaaacaaaatttgtgatacagttcaagctagggctgaacaagataaaaaccatggtgtgatcctgttgccagaggggcttattgaaagtattcctgaagtatatgctctactgcaggaaattcatggcttgctcaaacaaggcgtttccgctgataagatttcctctcaactatcaccttgggcatctgcgctctttgagttcttgccgccctttataaaaaaacagctcctcttacacccagaatcagatgattctgctcagctatcacagattgaaaccgagaaacttctagctcatctggtggaaacagaaatgaataagcgattgaaagaaggaacttacaagggaaagaaatttaatgcaatttgccatttctttggttatcaagctcggggatcattgccatcaaagtttgattgtgactatgcatatgtacttggtcacgtctgctatcatattttggctgctggcctcaatggttacatggctacattgactaacttgaagaatcccgtcaacaagtggcgctgtggggctgctcctataactgctatgatgagtgtgaagcggtatggtcgtggtcctggcaaggcatcacttgggaagcctgctgtgcatccagccactgtagatttgaagggcaaatcatacgaattattgagtcaaaatgcgacgaagttcttgctcgatgatgtttacagaaacccaggccccctccagtttgatggccctggtgctgacgcaaaggctattactctttgcgttgaagaccaggattacatgggtcgtatcaagaaattgcaagagtatctggacaaggttcgtacaatcgtgaagcctggatgctcacaagatgtcctgaaagctgctctgagtgccatgtcttctgtcacagaaatcctttctgtgatggcctcgccttcaagcaatgcgaacacaccattctagatgagaacacccctaaacctcacggaaaatttaggaggcagacatatttgtcaaacttaacagaattcatagcc

SEQ ID NO: 3835 - DNA, 2158 bp, Solanum tuberosum
gtgagtgtgtgtagtaggtgaacaatatcacaaatggatgcagattacggcatagctagagaactctctgatctgcaaaagcttcgatctcagtatcaacctgagcttcctccttgtcttcagggtactactgtgcgggttgagctaggtgatgcaaccactgcagcagatcactctggtgaacatgtaataagtcggtcttttcctcacacttatggtcagccattggcccattttctcagggcaactgccaaagtctctgatgctcagataattaccgagcatccagcgaagagggttggaattgttttctgcgggagacaatctcctggtggacataatgtgatatggggtattcatgacgcccttaaaattcacaatcctaacagtactttgcttggttttctgggtggttctgaaggtttatttgcacagaaaaccctagagatcaccaatgatattcttgccacctataagaatcaaggtggttatgacatgctgggtcggacaaaagatcaaattagaacaaccgagcaagttaatgccgcaatggctgcatgcaaagctttgaaattggatgcccttatcattattggaggggtaacatcaaacactgatgctgctcaactggccgaaacatttgccgaagcaaaatgccaaacaaaagtggttggagttcctgttacattaaatggagatctaaagaatcagtttgttgaaacaaacgtcggttttgacacaatatgcaaggttaattcccaactcattagcaatatgtgcactgatgcgctctcggcagaaaagtactactatttcatccgactcatggggcgaaaggcatcacatgttgccttagaatgcactctgcagtcacatcctaatatggtaattcttggtgaggaggtagctgcatcaaagcttacactttttgacatcacaaacaaaatttgtgatacagttcaagctagggctgaacaagataaaaaccatggtgtgatcctgttgccagaggggcttattgaaagtattcctgaagtatatgctctactgcaggaaattcatggtttgctcacacaaggcgtttccgctgataagatttcctctcaactatcaccttgggcatctgcgctctttgagttcttgccgccctttataaaaaaacagctcctcttgcacccagaatcagatgattctgctcagctatcacagattgaaaccgagaaacttatagctcatctggtggaaacagaaatgaataagcgattgaaagaaggaacttacaagggaaagaaatttaatgcaatttgccatttctttggttatcaagctcggggatcattgccatcaaagtttgattgtgactatgcatatgtacttggtcacgtctgctatcatatattggctgctggcctcaatggttacatggctacattgactaacttgaagaatcctgtcaacaagtggcgctgtggggctgctcctataactgctatgatgagtgtgaagcggtatggtcgtggtcctggcaaggcatcacttgggaagcctgctgtgcatccagccactgtagatttgaagggcaaatcatacgaattattgagtcaaaatgcgacaaagttcttgctcaatgatgtttacagaaacccaggccccctccagtttgatggccctggtgctgacgcaaaggctattactctttgcgttgaagaccaggattacatgggtcgtatcaagaaattgcaagagtatctggacaaggttcgtacaattgtgaagcctggatgctcacaagatgtcctgaaagctgcacttagtgccatgtcttctgtcacagaaattctttctgtgatgacctcgccttcaagcaacgtgaacacaccattctagatgagaacaccccttaacctcgcggatatttagaggcagacgtatttgtcaaacttaatagaattcatagcctccccccctccccccacccttttttcccctccaatcatcttttgcactttgcagaaactttatttagttacagaaatgttagtcggattgtgtgacattacagaggccttcaactgtctttactcttttagtttgtttctttatttgtgtttttgaaattttgacgacccgaataatgttgagatttgagaagattgta

SEQ ID NO: 3836 - DNA, 2152 bp, Solanum tuberosum
ctattgaaaaaacaaaaagtgagtgtgtactgcgtaggtgccaggcatcaacaatggatgcagattacggcatacctcgagaactctctgatttgcagaagcttcggtctcactaccaccctgaacttcctccttgtcttcagggtactactgtccgggtagaactccgtgatgcaaccactgcagcagatccctctggtgaacacacaattaaacggttcttcccacacacttatggtcaaccattagcccattttcttagggcaactgccaaggtccctgatgctcagataattactgaacatcctgcaattagggttggggtgctattttgtggtagacaatctcctggaggacacaatgtcatatggggtcttcatgatgctcttaaggttcacaaccccaaaaatatcttgcttgggtttttaggtggttctgaaggtttatttgcacaaaaaactctagagatcaccgatgatgttcttgctacctataagaatcaaggtggatatgacatgctgggacggacaaaagatcagattagaacgactgagcaagtaaatgctgcaatggctgcatgcaaagctttgaaattggatggccttgtcatcattggaggagtgacatcaaacaccgatgctgctcatctggcagaaaaatttgcagaaacaaaatgccttacaaaagtggttggtgttcctgttacattaaatggggatctcaagaatcagtttgttgaagcgaacgttggttttgacacaatctgcaaggttaactcccaactaattagcaatgtatgcactgatgcactctcagctgagaagtattactatttcattagactcatggggcgaaaggcatcacatgttgcattagagtgcactctgcagtcacatcctaatatggtgattcttggagaggaggtagctgcatcaaagcttactatttttgacatcacacaacaaatttgtgatgcggttcaggctagggctgaacatgataaaaatcatggtgttatcctgttgcctgaggggcttattgaaagtattcctgaagtatatgctctattgcaggaaattcatggtttactcaggcaaggtgtttctgctgataagatttcctctcaactatcaccatgggcttctgcacttttcgaatttttgccgcattttatcagaaagcagcttctcctacacccagaatcagatgactctgctcagctatcacagattgagaccgagaaacttatagctcatctcgtggaaacagaaatgaacaagcgattgaaagaaggaacttacaaaggaaagaaatttaatgctatttgccatttctttggttatcaagcacggggatcattgccatcaaagtttgattgtgactatgcctacgttcttggtcatgtttgctaccatattttagctgctggtcttaatggttacatggctactattaccaacctgaagaatcctgccaacaagtggcattgtggtgctgcccctatatctgcaatgatgactgttaagcgttacggtcgtggtcccggtaaagcatcaattggggtacctgctttgcatcctgctactgtggatttgaggggcaaatcatatgagctgttgagtcaaaatgcaacaaagtttttgttggatgatgtttatagaaacccaggtcccctccagtttgatggccctggtgcagatgccaaggccgttagcctttgtgttgaagaccaggattacattggccgtattaagaaattgcaggaatacctagacaaggtgcgtacaattgtgaagcctggttgctcacaagacgtcctgaaggctgcattaagtgccatggcttctgtgactgacattctttcagtgatatcgtcaccctcaagtgtgagcacaccattttagatgagaacccatcatcttttaacattgaaaagatttggaggaactcttgcttttgcggctgtttgcttagttgtttttgtgcatttttcttttttcaatcttgtaaaagccaaataatgttgagaagattatactactttctgagagtttgttgagggatccaaatattcctgtgcgttaataaactattacagtacgtacatatactccttcaaatcatttttcttggacagtaaaaaatacttatt

SEQ ID NO: 3837 - DNA, 2187 bp, Solanum phureja
gagcgagaaacacaaacagagtgagtgagtgtgtgtagtaggtgaacaatatcacaaatggatgcagattacggcatagctagagaactctctgatctgcaaaagcttcgatctcagtatcaacctgaacttcctccttgtcttcagggtactactgtgcgggttgagctaggtgatgcaaccactgcagcagatcactctggtgaacatgtaataagtcggtcttttcctcacacttatggtcagccattggcccattttctcagggcaactgccaaagtctctgatgctcagataattaccgagcatccagcgaagagggttggaattgttttctgcgggagacaatctcctggtggacataatgtgatatggggtattcatgatgcccttaaaattcacaatcctaacagtactttgcttggttttctgggtggttctgaaggtttatttgcacagaaaaccctagagatcaccaatgatattcttgccacctataagaatcaaggtggttatgacatgctgggtcggacaaaagatcaaattagaacaaccgagcaagttaatgccgcaatggctgcatgcaaagctttgaaattggatgcccttatcattattggaggggtaacatcaaacactgatgctgctcaactggccgaaacatttgccgaagcaaaatgccaaacaaaagtggttggagttcctgttacattaaatggagatctaaagaatcagtttgttgaaacaaacgtcggttttgacacaatatgcaaggttaattcccaactcattagcaatatgtgcactgatgcgctctcggcagaaaagtactactatttcatccgactcatggggcgaaaggcatcacatgttgccttagaatgcactctgcagtcacatcctaatatggtaattcttggtgaggaggtagctgcatcaaagcttacactttttgacatcacaaacaaaatttgtgatacagttcaagctagggctgaacaagataaaaaccatggtgtgatcctgttgccagaggggcttattgaaagtattcctgaagtatatgctctactgcaggaaattcatggtttgctcacacaaggcgtttctactgataagatttcctctcaactatcaccttgggcatctgcactctttgagttcttgccgccctttataaaaaagcagctcctcttgcacccagaatcagatgattctgctcagctatcacagattgaaaccgagaaacttatagctcatctggtggaaacagaaatgaataagcgattgaaagaaggaacttacaagggaaagaaatttaatgcaatttgccatttctttggttatcaagctcggggatcattgccatcaaagtttgattgtgactatgcatatgtacttggtcacgtctgctatcatatattggctgctggcctcaatggttacatggctacattgactaacttgaagaatcctgtcaacaagtggcgctgtggggctgctcctataactgctatgatgagtgtgaagcggtatggtcgtggtcctggcaaggcatcacttgggaagcctgctgtgcatccagccactgtagatttgaagggcaaatcatacgaattattgagtcaaaatgcgacaaagttcttgctcgatgatgtttacagaaacccaggccccctccagtttgatggccctggtgctgacgcaaaggctattactctttgcgttgaagaccaggattacatgggtcgtatcaagaaattgcaagagtatctggacaaggttcgtacaatcgtgaagcctggatgctcacaagatgtcctgaaagctgcacttagtgccatgtcttctgtcacagaaattctttctgtgatgacctctccttcaagcaacgtgaacacaccattctagatgagaacacccccttaacctcgcggatatttagaggcagacgtatttgtcaaacttaatagaattcatagcctccccccctccccccacccttttttcccctccaatcatcttttgcactttgcagaaactttatttagttacagaaatgttagtcggattgtgtgacattacagaggccttcaactgtctttactcttttagtttgtttctttatttgtgtttttgaaattttgacgacccgaataatgttgagatttgagaagattgtattta

SEQ ID NO: 3838 - DNA, 2168 bp, Solanum lycopersicum
gtgtttgttggttgtatcgcccccacactatatataaaatggaaggagggacggtcttttcagagttagaaactgacaaagagagtactattatattatattgaaacacacaaaaaagtgaggtaggcataaacaatggatgcagattacggcatagctcgagaactctctgatttgcagaaacttcgatctcactaccaccctgaacttccaccttgtcttcagggtactactgtccgggtagaactccgtgatgcaaccactgcagcagatccctctggtgaacacacaattaaacgcttcttcccacacacttatggtcaaccattagcccattttcttagggcaactgccaaggtccctgatgctcagataattactgagcatcctgcaattagggttggggtgctattttgtggtagacaatctcctggaggacacaacgtgatatggggtcttcatgatgctcttaaggttcacaaccccaataatatcttgcttgggtttttaggtggttctgaaggtttatttgcacaaaaaactctagagatcaccgatgatgttcttgctacctataagaatcaaggtggatatgacatgctggggcggacaaaagatcagattagaacgactgagcaagtaaatgctgcaatggctgcatgcaaagctttgaaattggatggtcttgtcatcattggaggagtgacatcaaacaccgatgctgctcatctggcagaaaaatttgcagaaacaaaatgccctacaaaagtggttggtgttcctgttaccttaaatggggatctcaagaatcagtttgttgaagcgaacgttggttttgacacaatctgcaaggttaactcccaactaattagcaatgtatgcactgatgcactctcagctgagaagtattactatttcattagactcatggggcgaaaggcatcacatgttgcattagagtgcactctgcagtcacatcctaatatggtgattcttggagaggaggtagctgcatcaaagcttactatttttgacatcacacaacaaatttgtgatgcagttcaggctagggctgaacatgataaaaatcatggtgtcatcctgttgcctgaagggcttattgaaagtattcctgaaatatatgctctattgcaggaaattcatggtttactcaggcaaggtgtttctgctgataacatttcctctcaactatcaccatgggcttctgcacttttcgaatttttgccgcattttatcagaaagcagcttctcctacacccagaatcagatgactctgctcagctatcacagattgagaccgagaaacttatagctcatctcgtggaaacagaaatgaacaagcgattgaaagaaggaacttacaaaggaaagaaatttaatgctatttgccatttctttggttatcaagcacggggatcattgccatcaaagtttgattgtgactatgcctatgtgcttggtcatgtttgctaccatattttagctgctggtcttaatggttacatggctactattaccaacctgaaaaatcctgccaacaagtggcattgtggtgctgcccctatatctgcaatgatgactgttaagcgctacggtcgtggtcctggtaaagcatcaattggggtacctgctttgcatcctgctactgtggatttgaggggcaaatcatatgaactgttgagtcaaaatgcaacaaagtttttattggatgatgtttatagaaacccaggtcccctccagtttgatggtcctggtgcagatgccaaggctgttaccctttgtgttgaagaccaggattacattggacgtattaagaaattgcaggaatacctagacaaggtgcgtacaattgtgaagcctggttgctcacaagacgtcctgaaggctgcattaagtgccatggcttctgtgactgacattctttcagtgatatcgtcaccctcaagtgtgagcacaccattttagatgagaacctatcatcttttaacattgaaaagatttggaggaactcttgcttttgcggctgtttgcctagttttttttttttcaatcttgtaaaagccaaataatgttgagaagattatacttctttttgagagtttgttgaaggatccaaatattcctgtgcgttaatacatatcattttt

SEQ ID NO: 3839 - DNA, 2219 bp, Solanum lycopersicum
atcgcccccacactatatataaaatggaaggagggacggtcttttcagagttagaaactgacaaagagagtactattatattatattgaaacacacaaaaaagtgaggtaggcataaacaatggatgcagattacggcatagctcgagaactctctgatttgcagaaacttcgatctcactaccaccctgaacttccaccttgtcttcagggtactactgtccgggtagaactccgtgatgcaaccactgcagcagatccctctggtgaacacacaattaaacgcttcttcccacacacttatggtcaaccattagcccattttcttagggcaactgccaaggtccctgatgctcagataattactgagcatcctgcaattagggttggggtgctattttgtggtagacaatctcctggaggacacaacgtgatatggggtcttcatgatgctcttaaggttcacaaccccaataatatcttgcttgggtttttaggtggttctgaaggtttatttgcacaaaaaactctagagatcaccgatgatgttcttgctacctataagaatcaaggtggatatgacatgctggggcggacaaaagatcagattagaacgactgagcaagtaaatgctgcaatggctgcatgcaaagctttgaaattggatggtcttgtcatcattggaggagtgacatcaaacaccgatgctgctcatctggcagaaaaatttgcagaaacaaaatgccctacaaaagtggttggtgttcctgttaccttaaatggggatctcaagaatcagtttgttgaagcgaacgttggttttgacacaatctgcaaggttaactcccaactaattagcaatgtatgcactgatgcactctcagctgagaagtattactatttcattagactcatggggcgaaaggcatcacatgttgcattagagtgcactctgcagtcacatcctaatatggtgattcttggagaggaggtagctgcatcaaagcttactatttttgacatcacacaacaaatttgtgatgcagttcaggctagggctgaacatgataaaaatcatggtgtcatcctgttgcctgaagggcttattgaaagtattcctgaaatatatgctctattgcaggaaattcatggtttactcaggcaaggtgtttctgctgataacatttcctctcaactatcaccatgggcttctgcacttttcgaatttttgccgcattttatcagaaagcagcttctcctacacccagaatcagatgactctgctcagctatcacagattgagaccgagaaacttatagctcatctcgtggaaacagaaatgaacaagcgattgaaagaaggaacttacaaaggaaagaaatttaatgctatttgccatttctttggttatcaagcacggggatcattgccatcaaagtttgattgtgactatgcctatgtgcttggtcatgtttgctaccatattttagctgctggtcttaatggttacatggctactattaccaacctgaaaaatcctgccaacaagtggcattgtggtgctgcccctatatctgcaatgatgactgttaagcgctacggtcgtggtcctggtaaagcatcaattggggtacctgctttgcatcctgctactgtggatttgaggggcaaatcatatgaactgttgagtcaaaatgcaacaaagtttttattggatgatgtttatagaaacccaggtcccctccagtttgatggtcctggtgcagatgccaaggctgttaccctttgtgttgaagaccaggattacattggacgtattaagaaattgcaggaatacctagacaaggtgcgtacaattgtgaagcctggttgctcacaagacgtcctgaaggctgcattaagtgccatggcttctgtgactgacattctttcagtgatatcgtcaccctcaagtgtgagcacaccattttagatgagaacctatcatcttttaacattgaaaagatttggaggaactcttgcttttgcggctgtttgcctagtttttttttttttcaatcttgtaaaagccaaataatgttgagaagattatacttctttttgagagtttgttgaaggatccaaatattcctgtgcgttaatacatatcatttttctggacgactgactatgtttagacaatatttggcccaacttgacagtaaagattacttagtatta

SEQ ID NO: 3840 - DNA, 2207 bp, Solanum phureja
tatatataaacggagggagggacggtcttttcagagttagaaactgacaacgagtgagtgtgtagtacattatattgaaaaaacaaaaagtgagtgccaggcatcaacaatggatgcagattacggcatacctcgagaactctctgatttgcagaagcttcggtctcactaccaccctgaacttcctccttgtcttcagggtactactgtccgggtagaactccgtgatgcaaccactgcagcagatccctctggtgaacacacaattaaacggttcttcccacacacttatggtcaaccattagcccattttcttagggcaactgccaaggtccctgatgctcagataattactgaacatcctgcaattagggttggggtgctattttgtggtagacaatctcctggaggacacaatgtcatatggggtcttcatgatgctcttaaggttcacaaccccaaaaatatcttgcttgggtttttaggtggttctgaaggtttatttgcacaaaaaactctagagatcactgatgatgttcttgctacctataagaatcaaggtggatatgacatgctgggacggacaaaagatcagattagaacgactgagcaagtaaatgctgcaatggctgcatgcaaagctttgaaattggatggccttgtcatcattggaggagtgacatcaaacaccgatgctgctcatctggcagaaaaatttgcagaaacaaaatgccttacaaaagtggttggtgttcctgttacattaaatggggatctcaagaatcagtttgttgaagcgaacgttggttttgacacaatctgcaaggttaactcccaactaattagcaatgtatgcactgatgcactctcagctgagaagtattactatttcattagactcatggggcgaaaggcatcacatgttgcattagagtgcactctgcagtcacatcctaatatggtgattcttggagaggaggtagctgcatcaaagcttactatttttgacatcacacaacaaatttgtgatgcggttcaggctagggctgaacatgataaaaatcatggtgttatcctgttgcctgagggccttattgaaagtattcctgaagtatatgctctattgcaggaaattcatggtttactcaggcaaggtgtttctgctgataagatttcctctcaactatcaccatgggcttctgcacttttcgaatttttgccgcattttatcagaaagcagcttctcctacacccagaatcagatgactctgctcagctatcacagattgagaccgagaaacttatagctcatctcgtggaaacagaaatgaacaagcgattgaaagaaggaacttacaaaggaaagaaatttaatgctatttgccatttctttggttatcaagcacggggatcattgccatcaaagtttgattgtgactatgcctacgttcttggtcatgtttgctaccatattttagctgctggtcttaatggttacatggctactattaccaacctgaagaatcctgccaacaagtggcattgtggtgcttcccctatatctgcaatgatgactgttaagcgttacggtcgtggtcccggtaaagcatcaattggggtacctgctttgcatcctgctactgtggatttgaggggcaaatcatatgagctgttgagtcaaaatgcaacaaagtttttgttggatgatgtttatagaaacccaggtcccctccagtttgatggccctggtgcagatgccaaggccgttagcctttgtgttgaagaccaggattacattggccgtattaagaaattgcaggaatacctagacaaggtgcgtacaattgtgaagcctggttgctcacaagacgtcctgaaggctgcattaagtgccatggcttctgtgactgacattctttcagtgatatcgtcaccctcaagtgtgagcacaccattttagatgagaacccatcatcttttaacattgaaaagatttggaggaactcttgcttttgcggctgtttgcttagttgtttttgtgcatttttcttttttcaatcttgtaaaagccaaataatgttgagaagattatactactttctgagagtttgttgagggatccaaatattcctgtgcattaataaactattacagtacgtacatatactccttcaaatcatttttcttgacagtaaaaaatatttatt

SEQ ID NO: 3841 - DNA, 2074 bp, Ocimum basilicum
gcacgcggtatactttcgaggagttctgaaatcgcagaaatattcgtggagatggattctgattacggagtacagagagaactttccgatctgcagaagcttcgatctcaatatcaacccgaactacctccctgccttcagggaactactgtccgcgtggaatttggtgatgttactacagctgctgatcccttaggtgctcataccataagtagaacttttcctcacacgtatggtcagccattagctcatttcttgagggcaaatgctaaggttccagatgcacaaataataacagagcatcctgctgttagggttggagttgtcttttgtggtagacagtctcctgggggacataatgttatttggggtcttcatgatgccatcaaagttcacaatcccaagagtgttttgcttggatttcttggtggttcggatggtttatttgcacaaagaactctagagattacagatgacattctttcaacgtacaaaaatcaaggtggatatgacttgcttggacggacaaaagatcaaattcgaacaactgagcaggttaatgcagcacttaatgcttgcaccagtttgaagttggacgctctcgttattattggaggtgtgacatcaaatacagatgctgcgcatcttgccgaaacctttgctgaaagaaaatgccctacaaaggttgtgggtatacctgttacattaaatggtgatcttaaaaaccaatttgttgagacaaatgtgggctttgacacaatatgtaaggttaattctcagctgattagcaatgtctgcacggatgcactctctgctgagaagtattattattttatccgactcatgggcagaaaggcatcacatgttgccttagagtgcactctccagtcgcatcccaatatgatcattcttgctgaagaggttgctgcatcaaagcttacactttttgatatcacaaaacaaatatgcgatgcagttcaagccaggggcgagcaagataagtatcatggtgtcatcctgttgccagaggggctcattgagagcattcctgaagtctatgctctattgcaggaaattcaccgtttgctcagggaaggtgtctctgctgataaaatttctagccagctgtcaccttgggcatctgcattgtttgaatttctgccagtgtttatacgaaagcagcttcttctgcatcctgaatccgatgactcagcccaactttctcagattgagacagaaaagctccttgcctatctcgttgaagtagaaatgaacaagaggctgaaagaagggacctacaagggcaagaagttcaatgctatttgtcatttctttggttatcaagctcggggctcgttgccatcaaagtttgattgtgattatgcctatgtacttggttctattggttaccatgtaattgcagctggtttgaatggctacatggcaactgtcacaaatttgaagaatcccgtaaacaagtggcgttgtggtgctgctcctattacagctatgctaactgttaaacgctatggccgtggtcatggtgatacaaatcttggacgaccagctttgcatccagcgactgttgatttgaagggaaaggcttatgagttgttgaggcaaaatgcaaccaagtttctgttggacgacgtatacagaaatccaggacctcttcagtttgatggcccaggtgccgactccaagcctgtttctctgtgcgtcgaagatcaagactacatgggtcggataaagaaattgcaggaatacctggacaaggtccgctcgattgtgaaaccgggatgctctcaagatgttctcaaagctgctttgagcgccatggcttcggtaactgacattctgtcggtgatctcgacaccgaccagtggaaatatccccatatagattgaattttcgcatttgcagtctattttggattagaattgacttgaaaccaggttttgttttatggttacgttcgttcctttttatgcaaggctgaggaataaattaagaggatttcgttgcaatgtatgacaaaaacacgctgattttataatttgggtgaattcatttt

SEQ ID NO: 3842 - DNA, 2277 bp, Olea europaea
gtaccgcaaagcacttgtgtagtagtaggtgaaatcgcaactggagatggattcagatttcggagttccaagagaactttctgatcttcaaaaacttagatctcagtatcgacctcaactcccgccctgccttcagggaactactgttcgcgtagagtttggggatgcaaccacagtggctgacccctcaggtgcccataccataagtaggtcatttcctcacacttatggtcaacctttagcacactttatgagggaaactgccaaggctcctgatgcccaaataattaccgaacacccagcaatcagagtgggagttgttttttgtggaagacaatctcccggaggacataatctcgtttggggtctccttgacgctctaaaagtacataatcccaagagtactttgcttggatttttgggtggttctgaaggtttatttgctcagaaaactttagaggtcactgatgatgtccttgcaacctacaaaaatcaaggcggttatgatttgctgggaagaacaaaagatcaaattagaacaactgagcaggttaatgctgcactggatgcatgtataaatttgaagttggatggtcttgtgattattggaggagtgacatcaaatacagatgctgctcagcttgcagaaacctttgcagaaaggaaatgcccaacaaaggtggttggtgtacctgttaccttaaatggagatctaaagaaccagttcgttgagaccaacgttggttttgacacgatatgtaaggttaattcccagcttattagcaatgtctgtactgatgctctctctgcagagaagtactattattttatccgactgatgggtcgaaaagcatcacatgttgccctggagtgcactctccaatcacatcccaatatggttattcttgctgaagaggtggctgcatcaaagcttaccctttttgacatcacaaaacaaatatgtgatgcagtgcaggccagggctgaacaagataactaccatggtgttatcctattgccagagggtcttattgaaagcattcctgaagtgtatgctttattgcaggaaatccatggtttgctcaggcaaggtgtctctgcggataacatttcttctcaattgtcaccttgggcgtctgcattgtttgaattcttgccacctttcataagaaaacagctacttctccacccagaatcagatgactctgcacaactatcacagatagagacagaaaagctcttggttcatcttgttgaagcagaaatgaacaagcgattgaaagaaggaacctacaagggaaagaaattcaatggcatctgccacttcttcggttatcaagctcgtggatcattgccatcaaagtttgattgtgactacgcatatgtccttggtcatataggctaccacatacttgctgcaggtttgaatggttatatggcaactgtaactaacctgaagaaccctgtgaacaagtggcgttgtggtgctgctcctataacaagcatgatgaccgttaagcgctatggtcgtggccatggggctgcaacactgggaaaaccggctctgcatccagcagctgtggatttgaagggcaagtcatacgggctgttgagacaaaatgcaaccaaatttttgatggacgacgtctatacgaaacccacggaccccttcagttcgaaggtcctggggctgattcaaagcccgtaaccctgtgtgttgaggaccaagattacatgggtcgtatcaagcaattgaaggaacacctcgataaggtgcgttcgatagtgaaaccagggtgttctcaagatgttctaaaagctgctttgagtgctatggcttctgtgactgatattctgtccgtgatatcctcaccttcaagcgggagcactccctactaattattctctcgtccttccttcgaactcttgcacactaaattgggattttacagaatctgttcatctcttttcttgttttgcttgcgattcttatgtaggattaaggattagactatggtaataaacttaattttgtttctgtaattttgtcgtcgaaataatgtttgagaattgcctctgtgatgtaacgcaaagatttttgtctaagctgtgaagagaatgaattatggtttagaagggaggattactgtctcatattagttattacctctattatctcctgcatttcttctcgtgaagatatttttgcttgtaaaacaaattgtcatccacagtagaaccagattaaataatacgaaaacccactgtggcctgact

SEQ ID NO: 3843 - DNA, 2335 bp, Catharanthus roseus
gacctatataaaccgttgttttagcagcaaccattattactgaagctggttgagatttgagattcgagagagaagagcgccacattgttgattgaattagtcctttttaattattattggtttattcactgcctgcgataatcactaatggattcagattatggaataccaagagaactttctgatctgcagaagcttcgtgctcagtacaagcctgagcttcctccatgccttcagggaacaactgtccgggtagagttaagcgatgctactattgctgcagatccaatgggtgcccacaccataagtcggtcatttcctcacacttatggtcagccattagctcactttcttagaccaactgcccaggtccctgatgctcagataattactgatcacccagcaattagggtgggtttggttttctgcggtagacaatctcctggaggacataatgtcatttggggactctatgatgctatcaaaagtcacaatgctaagagcactttgcttggatttctcggtggttctgagggtttatttgcgcagaagactttagaaataacagatgatgtcctcgcaacatacaaaaatcaaggtgggtatgatttacttggacgaacaaaagatcaaattagaaccactgagcaggtcaatgctgcgatggctgcctgcaaggcattaaagttagatggcctcgttgttgttggaggggtaacatcaaacacagatgctgcatatcttgctgaaacttttgcagaagcaaaatgtacaacaaaggttgtgggtgtccctgtcactctaaatggagatctcaagaataagtttgttgaaacaaatgttggttttgacacaatatgcaaggtcaattcccagctcattagcaatgtttgtacagatgctctgtctgctgaaaagtattattatttcatccggctcatgggtcgaaaggcatcacatgttgctctagaatgcactctccaatcgcatccaaatatggtaattcttggtgaggaggtcgctgcttctaagcttactctttttgacatcacaaaacaaatttgtgatgctgttcaagctagatctgaacaagataaataccatggtgtcattctcttgccagagggccttatagaaagcattcctgaagtttatgctttattaaaggaaattcatgttttgcttaggcaaggtgtttctgctgataacattttctctcaactatcaccttgggcatctgctctgttcgaatttctaccaccgttcatcagaaagcagcttctcctctatccagaatctgatgattccgcacagttatcccagattgagacagagaagcttctagctcatctcgtggaagaagaaatgaacaaacgactgaaagaaggaacttacaagggaaagaaatttaatggtatatgccacttctttggttatcaagctcggggatcattaccgtcaaaatttgactgtgattatgcctatgttcttggttatatctgttatcatattctggcagctggattaaatggttatatggctactgtaactaacctaaaaaatccgttgaacaaatggcgatgcggagctgctccaatcacagctatgttgaccgttaagcgttatggtcgcggccctggagccgcttaccttggtaaacctgctctgcatcccgcaactgtggatttgaaaggcaaatcatacgagttgttgagacaaaatgcaacaaagtttttgctggatgatgtctacagaaacccaggaccccttcaatttgatggtcctggtgctgactctaaggctgtgaccttgtgtgttgaagaccaggactacatgggtcgtatcaagcaattgcaggaatatcttgacaaggtgcgcaacattgtgaagccaggctgctcgcaggatgttctgaaagctgctctgagtgccatgtcttccgtgactgacattctatctgtgatatcatcaccatcaaacagcgggagcactcccttttagaagtagatgatgccattcctgcaagggaaggaaattttttggtgacctttgatcatcagctgcaagtgcaggagggaggactcttgatattcctatcccgtgcctccgttcccatccggagtgtgcttgggcgcagtacattttgacgttggacaataaaaacattgcctggtttttttttggtggggtcttcgccctgctctcttttctgactaaaatgtgagaaataatttatgggagtttctcttgccggtctgtggactgatgtgattttgttttctgctacaatgaagaggatttttttttttccggcttgataatattttgtacaatt

SEQ ID NO: 3844 - DNA, 2098 bp, Plantago ovata
cggccgggggggactactgaaaaaaaaccgcagacacagaaagtaaagtaaaagcatagtcctaaatcgtcaacacatacttgcaaatggattcggatttcggtattgctcgtgaactttccgatttgcaggagcttcgatctcaataccagcctgagcttcctccttgccttcagggaactacagtgcgagtcgagttgggtgatggaactacagcagcagacccatcaggctcccacaccattagtaggtcatttccgcatacttatggtcaacctatagctcacttcctccggacaactgctcaagttcctgatgcccaaattattactgagcatcctgccacaagggtgggagtggttttctgtggaagacaatctcccggagggcataatgtaatctggggtcttcttgaagctctaaaagttcacaatcctaagagtgctttgcttgggtttttgggtggttctgaaggtttatttgcacagaaaactttggagattacagatgacatactagcttcttataaaaaccaaggcgggtatgatttgctgggccgtacaaaagatcaaattagaacaactgagcaagtcaatgcatctcttgatgcatgcaatgctttgaagttggatgctcttgtcattattggaggagttacatcaaacacggacgctgcccagcttgcagaaacctttgctgagagaaagtgccccacaaaggtggtcggtattcctgttacattaaatggagatctgaagaaccaatttgttgagaccaatgtgggctttgacacaatatgcaaggttaactctcagctgattagcaatatgtgcactgatgctctctctgcagagaagtattattattttatccgtctcatggggcggaaggcatcccatgttgcactggagtgcactctccaatcccatcccaatatggtaattcttgcagaagaggtagctgcatcaaagcttacactttttgatataacaaaacaaatatgtgatgcagttcaagcaaggggtgaacaagataagaaccatggtgtgatactcttaccagaggggctcattgaaagtattcctgaggtctatgctctgctgcaggaaattcatagtttgctcaggcaaggtgtcactgccgacaacatttcgacgcaactgtcaccttgggcatcggcattatttgaatttttgccaccatttattagaaaacagcttctactacaaccagaatcagatgactccgcacagctctctcagattgagacagagaagctctttgctcatcttgttgaagaagaaatgaacaagcgactgaaagaaggaacctacaagggaaagaaattcaacgcaatctgccatttctttggctatcaagctcgcggttcactgccatcaaagtttgactgtgattatgcttatgtgcttggccatgttgcttatcacataattgctgctggtctgaatggttatatggcaactgttactaacttgaaaaatccagtgaacaagtggaagtgcggtgctgctcctatcacagcaatgatgacagttcaacgctatggccgtggtcacaaggcattaacaattggaaaaccagctcttcatccagcaactgttgatttgaagggcaaagcatatgagttgctgagacaaaatgctaccaagtttttgatggatgatgtgtatagaaaccctggaccacttcagtttgagggacctggcgctgatgcaaagcctgtatctctttgtgttgaagatcaagattacatgggccgcatcaaaaagttgcgggagcatcttgacaaggtgcgctcaatggtcaaaccaggatgttcccaggatgtcctgaaagcggctttaagtgctatgtcttctgttacggacgttcttacattgatgtcctcgccttcgagtgggagcactcccttttagaatgaatgttagtactgtttcttgtttgatgtaacttcaagttgcagcaactcccaggatacttgttcttgtttattgtaactttgagaaatgacttatgtcggctcatattttttgttatatggacagagtggcattttcctgttcccgccaaaaggctg

SEQ ID NO: 3845 - DNA, 2318 bp, Mimulus guttatus
atatatatatatatgtagagtgagaaacagagttgaagtagtaggtgactgtgtgtagtagtagtataatcacatacatttcacttccgtgcagagattaaatcaattgagtagagagatggattccgattacggaacagcgagagaactttctgatctgcagaagcttcgatctcactaccaaccagaacttcctccttgcctccagggtactacagtttccgtagagtttggtgatgtcaccacagctgcggaccccttaggtgcccatacaatcagtaggtcgtttccccacacttatggtcagcctatagcgcatttcctaagggcatctgctaaggttcccgatgcacaaataattactgaccatcctgcagttagggtgggggttgttttctgtggtagacaatctcctggaggacacaatgttatttggggtcttcttgacgcactaaaagttcacaatcccaagagtacattgttagggtttcttggtggttctgaaggtttatttgcacagaaaacgttggagatcactgatcagattcttgcgacctacaaaaatcaaggcggttatgatttgctgggacggacaaaagatcaaattagaacaaccgagcaggtgaatgcatcgcttaaggcgtgcacaacattgaagctggacgcccttgtaattattggaggtgtgacatcaaatacggatgcagcccagcttgcagaaacttttgcagaaagaaagtgcccgacaaaggttgtcggcattcctgttactttaaatggagatctcaaaaaccaatttgttgagacaaatgtgggttttgacacaatatgtaaggttaattcccagctaattagcaatgtctgcactgatgcactctctgcagagaagtattattattttatccgactaatgggccgaaaggcatctcatgttgccttggaatgtactcttcagtcccatcccaatatggtcattctcgctgaagaggttgcttcatcgaagctcacactttttgacattacaaaacaattatgtgatgcagttcaagcccggggtgaacaagataagcaccatggtgtcatccttttgccagagggacttatagaaagcattcctgaagtatatgctttattgcaggaaattcatggtttgatcaaggtaggtgtctctgctgataatatttctgctcaactgtcaccttgggcatctgcgttgtttgaattcctcccgccatttataagaaaacagctccttctccacccggaatcagatgactctgcacagctgtctcagattgagacggaaaagctcctagctcatctcgttgaagcagaaatgaacaagcgattgaaagaaggaacctacaaaggcaaaaaattcaatgccatttgccatttcttcggttatcaagcccgtgggtcattgccatcaaagtttgactgtgactacgcctacgtgctcggtcatattggctatcacataatcgctgctggtttgaatggttacatggctactgtaaccaatttgaagaatcctctcaacaagtggcgttgtgctgctgctcctataacggctatgctgactgttaaacgctacggccgtggtcatggggcttcgaaccttggaaaaccagctcttcatccagcaactgttgatttgaaggggaaggcctacgagttattgagacaaaatgcaaccaagtttttgatggacgatgtatacagaaacccgggacctctacagtttgatgggcctggtgctgatgcgaagccagttactctctgtgtcgaagatcaggattacatgggccgtatcaagaaattacaagaatacctcgataaggtgcgttcgatagtgaaaccaggatgttcgccggacgttcttaaagctgctctatgcgcgatgacttctgtgactgatatactttctgtgatgtcgtcaccttctagcggaacgacccccttctagaagaaatgcacgcacttattcacgttttgaggcgctacgactaccactatttgccaatcttggaatttgagatgccgttttattcattcagtttcgtcattttgtcggacccaagtttgaaatccatctagtcctttagaacgagtcgactgactgactgtaataaactcagttttgtttcaagaattccaatttatttattttcttgttttgttgtaaaattgagaaaataagttattgcagtaagaggcgtgtgctcattgtttgattcaatataaaaatcgtaaaattaaaataaatgtcgaaaaatcgaattttacctaataaaattaaattttttgtttgcttt

SEQ ID NO: 3846 - DNA, 2135 bp, Orobanche aegyptiaca
tctttcttgtaaccaaagaaatctcagagttcagagaaaatcgattgatcgagctatggattcagattatggaatacctagagaactttccgatctgcaaaagcttcgatctttgtacaagcccgaacttcccccttgccttcagggaactgcggtccgtgtagagtttggcgatgtagcgatagccgcggaccccacaggtgcccataccataagtaggtcttttcctcacacttatggtcaacctatagcacatttccttagggctaccgctaaggttccggatgctcaaattattacggaacttcctgcagtcagggtgggagtcgttttttgtggtagacaatctcctggaggacataatgttatatggggtctttttgacgcgctcaaggttcataatcctagaagtaccttactcggatttcttggtggttcagacggattatttgcacaaaagactttagagattactgacgacattcttgcaacctacaaaaatcaaggtggatatgatttgctcggacggactaaagatcaaattagaacaaccgagcaggttaatgcagcgcttaatacatgcaccgctttgaagctggatgctctcgttattattggaggtgtgacatcaaatacagacgcttcccagcttgcagaaacttttgccgacagaaagtgccctacaaaggtggttggtattcctgttactttgaatggagatcttaaaaaccaatttgttgagacaaatgttggtttcgacacaatatgcaaggttaattctcagctgattagcaatgtctgcaccgatgcactctctgcggagaagtattactactttatccgactcatgggacgaaaagcatctcatgttgccttagaatgcactctccaatcccatcccaatatggtaattcttgctgaagaggtggctgcatcaaagcttactcttttcgacatcacgaaacaaatatgtgatgccgttcaggccaggggcgaacaagataagcaccatggtgtcatccttttgccggagggccttatagaaagcattcctgaagtgtatgctctattgcaggaaattcatcttttgctgagggaaggtgtgtttgccgataatatttctgctcagttgtctccttgggcatctgcgttgttcgatttccttccaccgttcataagaaagcagctccttctccacccagaatcagatgactctgcacaactatctcagatcgagacagaaaagctcttagctcatcttgttgaagcggaaatgaacaagcgattaaaagaaggaacctataagggcaagaaattcaatgccatttgtcatttcttcggttatcaagctcgagggtcgttgccatcaaagttcgattgtgactatgcttatgtgcttggtcatatcggctatcacgtaatagccgctggcttgaatggttatatggcaactgtaaccaatttgaagaatcccgtcaacaaatggaagtgtggtgccgctccgataactgctatgttgaatgttaagcgctatggtcgtggccacggggctttaacactcggaaagccagctttgcatccagcgagtgtcgatttgaagggcaagtcttatgagttgttgagacaaaacgcgaccaagtttttaatggacgacgtttatagaaacccgggacctcttcaatttgacgggcctggcgccgatgcaaagcccgtcaccctttgtgtcgaagatcaagattacatgggtcgtataaagaaattgcaggaatacctcgacaaggtgcgttcgatagtaaaaccgggatgttcgcaagatgttcttaaagctgctttaagtgcaatgtcttcggtcaccgacgttctttctattatgtccgcaccgtctagcgggagcacccccttttaaaaaatgtattaaaaaaattacctcatgacggaggtcctcgagatggcatagcggttacgtgtttaagagccgtaatttgtttttttaacccaataatgaaaatattttgtagagaattttatttgagtttcgtgaacagatcactatttgtaaggaatttgtgtaattgagcgttcaattttgtgtatggaaaagttatgttgatgtccttaccaaaaaaaaaaaaaaa

SEQ ID NO: 3847 - DNA, 2205 bp, Triphysaria pusilla
gtcgagtggtaggtgaatttgtgtcgtgtaaccaaagaaactcagagagaatatcgatttagctgatggattctgattatggaattgcaagagaactttctgatctgcagaagctccgatctctgtaccagcccgaacttccgccgtgccttcagggaactgcagtccgtgtagagtttggtgatgtggccactgctgcggactcctctggtgcccataccataagtaggtcttttcctcacacttatggtcaacctatagcgcatttccttagggcaacagctaaggttcccgaagctcagattattacagagcttcctgcagtcaaggtgggagttgttttctgtggtagacagtctcctggaggacataatgtgatatggggtctttttgatgcactgaaggttcataatcctaaaagtactttgctaggatttcttggtggttctgatggattatttgcacaaaaaactttagagataactgatgaaattcttgcaacctacaaaaatcaagggggttatgatttgctcggacggacaaaagatcaaattaaaacaactgagcaggttaacgcagcacttaagacatgcacgactttgaagctggatgctctcgttattattggaggtgtgacatcaaatacagacgctgcccagcttgcagaaacttttgcagaaagaaagtgcccaacaaaggtggttggtgttcctgttactttaaatggagatcttaaaaaccagtttgttgagacaaatgttggttttgacacaatatgtaaggttaattcccagctgattagcaatgtctgcaccgatgcactttctgcagagaagtattattactttatccgactcatggggcggaaagcgtctcatgttgccttggaatgcactctccagtcccatcccaatatggtcattcttgctgaagaggtggctgcatcaaaacttactctttttgacatcacaaagcaaatatgcgatgcagttcagtccaggggtgaacaagataagcatcatggtgttatccttttgccagaggggcttatagaaagcattcccgaagtttatgctctattgcaggaaatttttggtttgcttagggaaggcgtctctgctgataatatttctgcccagctatctccttgggcatctgctttgtttgagtttttgccacctttcataagaaaacagctcctactccacccagaatcagatgattctgcacagctatctcagattgagacagaaaagctcctagctcatcttgttgaagcagaaatgaataagcgactgaaagaaggaacctacaagggcaagaaattcaatgccatttgccatttctttggttatcaagctcgggggtctttgccatcgaaatttgattgtgactatgcctatgtgctcggtcatattggttatcacatagttgctgctggcttgaatggttatattgcaactgtaacaaatttgaagaatcctgtgaacaagtggaagtgtggtgctgctccaataagcgctatgctgactgttaagcgctatggtcgtggtcatggggcttcgacccttggaaagcctgctctgcatccgggaactgttgatttgaagggaaagtcctacgagttattgagacaaaacgcaaccaagtttttgatggacgatgtatatagaaacccgggaccactccagtttgatggccctggtgctgatgccaagcctgtcactctttgtgtcgaagatcaggattacatgggccgtattaagaaattgcaggagtacctcgacaaggtgcgttcgatagtaaaaccgggatgctcccaagatgttcttaaagctgctttgagctccatgtcctctgtcacggaaattctttctattatgtcggcaccttctagcggtggcacaccgttctaaagattgtttgcttgtccctaatttttggtacccatttagagacaaaattggaattgttttgtactttttttccttccatttataaacttgttagctcagttgcggaaaataatgtcagtgagtgactagactgatgatggttagagttttattttatggtaaaagatttcgtgtcctttatttaaaacttggagagttaaagcattgtccgtcttttgttttggtggtgtatgaaaaaatatgttgcggtcctagtgacccttttgagcgaaaaaaaaaaaaaaaaaaa

SEQ ID NO: 3848 - DNA, 2285 bp, Aristolochia fimbriata
agtatcgctggagctaataaaaaatacgaaagacagaagcctccctgccgcccgagaaagtgtaacagaaaacagcggaagagaagccgccggcaggaaaagaaatcgatggattcggattacggcgtgccgagggaactatcagccctacagaaacaccggacgctgtatcacccggagcttcctccgtgccttcagggtacaactgtgagggtagaatttggtgatgcgaccactgcagcagatcttgctggtgcccacacaataagtagagcttttcctcacacatatagccagccactggctcattttctaagagctaatgctgttgttcctgatgctcaaattataactgaacatccttctattagggttggtgttgttttctgtggtagacagtctcccgggggtcataatgtcatctggggtctgtatgacgccattaagcttcacaatcccaagagtactctgctcggttttagtggtggaacagatggtttgtttgcacagaaaacccttgaaatcacagaagaagttcttgcttcctacaaaaatcaaggtggttatgatatgctcggacggacaaaagatcaaataagaacaactgagcaggttaatgctgcattagcttcttgtcaagcattgaagttggatggtcttgtcattattggaggtgtcacatctaatactgatgctgctcagcttgcagagacttttgcagaatccaaatgtccgacaaaggtagtgggggttcctgttactttgaatggcgatctgaagaaccagtttgttgagactaatgttgggtttgacacaatctgcaaggttaattcccagcttattagcaatgtctgcacagatgctctatctgcagaaaagtattactattttattcgactcatgggccggaaagcatcacatgttgctttggaatgcacactccagtctcatcctaatatggttatccttggtgaggaggttgcagcttctaagcttacactttttgatcttacaaagcaaatctgtgatgcagttcaagcaagagcagaacaagataagtatcatggtgtcattctattacctgagggactcattgagagtattcctgaagtatatgctcttttgcaggaaattcatggcctgcatagagaagggatttctgctgataacatttctgcacatttgtcaccttgggcgtccgcattgatagaatttttaccccttttcatacggcgacagctccttcttcacccagaatcagatgactctgcacagttgtctcaaattgagactgaaaagcttctagctcagttggtggagacggaaatgaataagcgaatgaaagaaggaacctataagggaaaaaaattcaatgcaatctgtcacttctttggctatcaggctcgtggttcattgccctcaaaatttgattgtgactatgcttatgttcttggccacatttcttatcacatcttagctgctggtttgaatggatatatggctactgttaccaacctgaagagtcccgtaaacaagtggcggtgtggtgctgctccaattacggctatgatgactgtaaagcgatggtcacgtggtcctaaggctacttcaattggaaaacctgctgttcatcctgctgcagtggatttgaaaggaaaagcatatgaattgctgagacaaaatgccacaaagcttttaatggatgatgtgtacaaaaaccctggccctcttcagtttgatgggccaggcgctgatattaaggccgtgacgctggctgttgaggatcaagactacatgggccggatcaagaagctgcaagagtatcttgacaaggtgcggagcatggtgaaaccaggttgctcgcaggatgtcctaaaggctgctctaagcgcaatggcttctgtgacggacgttctgagtgtcatgtctgctccttctttcagtaatcaatatccatctaatttatgagaagtctcacaatcagggaacgggttcatgtttggtacttggatccttatctgttttgctctcttgtatgtttttttttaggttctttatgagtctgggtttgtgagtgacctgtgtactatcagcgggaatcaacttgaaataaacatatttttggctttagagaggagaaagacgttagagttctaacttgtctctggttgttaagcactctgggtgcaggcatctctaccttgtcggttctagtttggattgctagccgaccttatttatgttgttgtatggggatgctggcgggcattgcttctgttgtcaag

SEQ ID NO: 3849 - DNA, 2246 bp, Mimulus guttatus
ggaaaaagaaattaactagtgaaagaggaaactaaaaggaaaaaagcggcgaaatagttggtgagtgtgtgtttattatcacagaggagagtacagagttcagaatcgcagggactgagcagatggattctgattacggaattgcaagagaactttctgatctgcaaaagcttcgatctcattaccaacccgaactccctccctgccttcagggaaccacagttcgtgtgcattttggtgatgctactgcagctgcagatcccacaggcgcccacaccataagcagatcttttcctctcacttacggccaacctttagcacacttcctgaggtcaaccgctaaggttcctgatgctcaaataattaccgagcatgctgcggttagggtaggagtagttttctgtggtagacaatctcctggaggacataatgttatttggggtcttcatgaagctttaaaagtccacaaccccaaaagtgttttgcttggatttttgggtggttctgatggtttatttgcacagaaaactttagaggttactgatgaagttcttgcaacctacaaaaatcaagggggttatgatttactgggacggacaaaagatcaaattagaacaattgagcaagtaaatgcagcacttaatgcatgcacagccttgaagcttgatgcactcgtcattattggaggtgtgacatcaaacacagacgctgcccaacttgcagaaacatttgcggaaagaaaatgcccaactaaggtggttggtattcccgttactttaaatggagatctaagaaaccaatttgttgagacaaatgtgggttttgacacaatatgcaaggttaattcccagttgattagcaatgtctgcactgatgcactatcggcagagaagtattattattttatccgactcatggggaggaaggcatctcatgttgcattggagtgcactctccagtctcatcccaatatggtcattcttgccgaagaggtggctgcatcgaaacttacaatttttgacatcacaaatcaaatatgtgatgcagttcaagctagggctgaacaagataaataccatggggtcattcttctgccagaaggactcatagaaagtttccctgaagtttttgctctgttgcaggaaattcatgctttgctcagacaaggtgtctctgctgataacatttctgcccaactgtcaccttgggcatctgcattgttcgagttcctgcctccatttataagaaaacagctccttcttcatccagaatccgatgactctgcgcagctatcgcagattgaaacagaaaagctcttagctcatcttgttgaagcagaaatgaacaagcgaacgaaagaaggaacctacaagggaaagaaattcaatgcaatttgccatttcttcggttatcaagctcggggatcattgccatcaaaatttgattgtgactatgcctacgttcttggtcatattggctatcacataattgctgctggtttgaacggttatatggcaacattaaccaacttgaagaatcctgtgaacaagtggcgatgtgctgctgctcctataacagctatgatgactgttaaacgctatggccgtggtcatggagcttcaatccttggaaaaccagctttacatccagcaactgttgatctgaaaggcaaatcctacgagttattacgacaaaattcgaccaagtttttgatggacgacgtatatagaaacccaggaccacttcagtacgacggtcctggtgcagatgccaaggcagtaactctctgtgttgaggatcaggattatatgggccgcatcaaactacttcaggaacacctagacaaggtgcgttctatagtgaaaccagggtgttcgcaagatgttctgaaagccgcattgtcggccatggcttctgtgaccgagattctctctgttatgtctgcagcttctggtgggagtactcccttctagaacacttctttgcttatttatatttttctgatatttctgctgcagttaaaactaacttctctaaagtttgtgtgagggttcagaaatggtgacagacccagttttggtttcttcatgatttgcacttttgttaaatttattatatttattatataataatgttttaacatgagaataatgtttggttggaattggaattggaattggaatccagcacttcgttaggtacatttttttggtcaccatccggcttaaataaagacatatttcaat

SEQ ID NO: 3850 - DNA, 2041 bp, Plantago ovata
cggccgggggccgtgggactgaagaaaaaccaacagctaaagcttcctcaatttctcaaccactctcttcaccaactaaactactcttccttctgctctaattgcaaacatagcaatggattcggattatggaattgcaagagaactctctgatctccagaagctacgatcactttaccagccacaattaccgccgtgccttcagggtaaaactgttcgtgtagaatatggtgatgcaacgacagcttcagaccccccaggctctcatgccataagtagatcatttcctcacacttttggtcaaccgatagcccacttcctgagagcaactgccattgtagctggggctcaagtgatttctgagcttcctgctacgagagtgggagtggttttttgtgggcgacaatcccctggaggacataatgttatttggggtctatatgatgctctaaaggttcacaatcccaaaagtacattgctcggtttcttgggtggttctgaaggtttgtttgcacaaaagactttggagataacggatgacattctcgccacctacaaaaatcaaggcggttatgatttgttgggaagaacaaaagatcaaattaggacgaccgaacaagtcaatgcagctctagatgcatgcttggctttgaagttggatgctcttgttattattggaggtgttacatcaaacacagatgctgcccagcttgcagaaacctttgcagaaagaaagtgcccaacaaaggttgttggtattcctgttacattaaatggagaccttaaaaaccaatttgttgagacaaatgtgggttttgacactatatgtaaggttaattctcagctgattagcaatgtctgcactgatgcactctcagcagagaagtattactattttattcgactaatgggccggaaagcatctcatgttgctttggaatgcacacttcaatcccatcccaacatggtcattctaggagaagaggttgctgcatctaagcttacactttttgacataacaaaacaaatatgtgatgcagttcaagcaaggagtgaaaaagataagcaccatggtgtcattctcttgccagaggggcttatcgaaagcattccggaagtttatgctctattgcaagaaatacatggattgctcagagaaggtgtgcatgctgatcagatatctgctaaactgtcaccttggtcgtctgcgttgtttgaattcttaccactatttataaagaaacagctccttctccatcctgaatcagatgactcggcacagctatctcagattgagacggaaaagctcctggctcaccttgttgaagaagaaatgaataagcgactgaaagaaggaacctacaaggggaaaaaattcaatgccatttgtcatttctttggttatcaagctcgtggatcgttgccgtcaaaatttgattgtgactatgcctatgtgcttggacatatcggctatcatgtaattgctgctggtttgaatggttatatggcaactgtaaccaacttaaagaaccctgtaaacaagtggaaatgtggtgctgctccaataacagctatgatgaccgttaaacagtatggccgtggtcatggtgcattggtcattggaaaacctgcactccatccagcaactgttgatttgaagggaaaagcttatgagttactgagacaaaacgccaccaagttcctaattgaagatatttatagaaaccctggaccccttcagtatgatggccctggtgctgatagcgaagccagtaactctgtgtgttgaagatcaggattacatgggtcgtatcaaggaattgcaggaatacctcgacaaggttcgttctatggtgaagccaggatgctcccaagatgttctccgagctgctttgagcgctatggcttcggtcactgacgtactatgtgtcatgtcctctccttcaaatgggagtggcactctcatttaagagtttaaaaattctggttcttctcacccgagtagcaccattcgtggtgcccattatctatcaaattggga

SEQ ID NO: 3851 - DNA, 2052 bp, Brassica napus
aaaagccaatggattcagatttcggaatcccaagagagctctctcctcttcagcaactccgttctcagtaccaccccgagcttcctccttgtctccagggaactactgtgcgcgtggagtttggtgatggaaccactgtggctgaggcttctgattcccatatcgttgctcgtgccttccctcataccttaggccagcctttggctcacttcctcagggaagctgccaaagtttccgatgctcacatcattactcagcttccttctatcagagttggaatcgtgttttgtggaaggcaagctcctggtggacacaatgtaatctggggtctttacgaggctctcaaggtgcacaacgcaaacagcacattgcttggctttttgggtggctcggaaggtctgtttgctcaaaagactctggagatcactgatgatatactccagacttacaaaaaccaaggtggctatgatttgctgggaagaaccaaggatcagatcagaaccactgagcaggttaacgctgctctcaaagcttgcacagatttgaagctagatggccttgttatcattggaggtgtaacatcaaacacagatgccgctcatcttgctgaatttttcgctgaagcaaaatgctcaacaaaggtagttggtgttccagtcactacaaatggagatctcaagaatcagtttgtggaggcaaacgttggttttgacaccatatgcaaggtgaattctcagctcattagcaatgcctgcaccgatgctctatctgcagagaagtactattattttatccgtctcatgggtcggaagcactctcatgttgcccttgagtgtaccctccagtctcatccaaacatggtgatactgggagaggaggtcgcagcatctaagctcaccatttttgacatttctaagcagatctgtgatgcagttcaagcaagagcaggacaagacaagaatcatggagtcatcctcattcccgaagggatcatagagagtattcctgaagtttacgctctgttgaaggaaattcatgggctacttagggagggtgtagctgctgataagatttctactcagctctcaccttggtcatctgctttgtttgaattccttcctccattcattaagaaacagctactcctccatcctgagtctgatgattctgctcagctatcccaaattgagactgagaagcttctcgcgtatctggtggagactgaaatgaacaagcgcttgaaagaaggcacatacaaggggaagaagttcaatgctatatgtcacttctttggttaccaagctcgtggatctctcccatcgaagttcgattgtgattatgcatacgtgcttggacatatatgttaccacatcctagcagctggtttgaatggttacatggcaacagtgagcaacctaaaaagtcctgtaaacaagtggaaatgtggtgctgcacctattacagcgatgatgacggtgaagaactggtcccaaaatgctagttctacttcaacttcaattggtagacctgcaattcacccggcaatggtggatctgaaaggcaaagcatacgagctgttgagacagaacgcagataaattcttgatggaagatctgtacagaaacccaggaccgcttcagtacgatggtccaggtgcagatgctaaagcagtgagtctctgcgttgaagatcaagactacatgggacgtatcaagaagctccaggaatatctagaccaggtgaggacaatagtgaagccaggatgttcacaagacgtactgaaagcagcactgagcgtgatggcttcagtgactgatgtgcttactaccatttcttcatcttcaaatggtggtcaacagttcgcttaaaaagcaaaagctctctttattaagcgtccatgaaactttgtttaaaccctttcaaccattccacatttcatgttctctttttttttttttaattcctttgcgatgtgtaacttttgctgttgttgttgctgttgttgagtttcgaaacgagagattaataaacaagtttgggattcacaatatc

SEQ ID NO: 3852 - DNA, 2169 bp, Brassica napus
cacacacttacttccacacttgagaaaaccaaaaagccaatggattcagatttcggaatcccaagagagctctctcctcttcagcaactccgctctcagtaccagcccgagcttcctccttgcctccagggaactaccgtgcgcgtggagtttggtgatggaaccactgtggctgaggcctctgattcccatatcatagctcgcgccttcactcataccttaggccagcctttggctcacttcctcagggaagctgccaaagtttctgatgctcacatcattactcagcttccttctatcagagttggaatcgtgttttgtggaaggcaagctccgggtggacacaatgtaatctggggtctttacgaggctcttaaagtgcacaacgccaaaagcaccttgcttggctttttgggtggctcggaaggtctgtttgctcaaaagactctggagatcacagatgatatactccagacttacaaaaaccaaggtggctatgatttgcttggaagaaccaaggatcagatcagaaccactgagcaggttaacgctgctctcaaagcttgcactgatttgaagctagatggccttgttatcattggaggtgtaacatcaaacacagatgccgctcatcttgctgaatttttcgctgaagcaaagtgctcaacaaaggtagttggtgtaccagtcactacaaatggagatctcaagaatcagtttgtggaggcaaacgttggttttgacaccatatgcaaggtgaattctcagctcattagcaatgcctgcactgatgctctctctgcagagaagtactattacttcatccgtcttatgggtcgaaagcactctcatgttgcccttgagtgtaccctccagtctcatccaaacatggtgatactgggcgaggaggtcgcagcatctaagctcaccatttttgacatttctaagcagatctgtgatgcagttcaagcaagagcaggacaagacaagaatcatggagtcatcctcattcccgaagggatcatagagagtatccctgaagtctacgctctgctaaaggaaattcatgggctacttagggagggtgtagctgctgataagatctctactcagctctcaccttggtcatctgctttgtttgaattccttcctccattcattaagaaacagctacttcttcatcctgagtctgatgattctgctcagctatcccaaattgagacggagaagcttctggcgtatctcgtggagactgaaatgaacaagcgcttgaaagaaggcacatacaaggggaagaagttcaatgctatttgtcacttctttggttaccaagctcgtggatctctcccatcgaagttcgattgtgattatgcatacgtgcttggacatatttgttaccacatcctcgcagctggtttgaatggttacatggcaacagtgagcaacctgaaaagtcctgtaaacaagtggaagtgtggtgctgcacctattacagcgatgatgacggtgaagaactggtcccaaaatgctagttctacttcaacttcaattggtagacctgcaattcatccagcaatggtagatctgacaggcaaagcatacgagctgttgagacagaacgcagataaattcttgatggaagatctgtacagaaacccaggaccgcttcagtacgatggtccaggtgcagatgctaaagcagtgagtctctgcgttgaagatcaagactacatgggacgtatcaagaagctccaggaatatctagaccaggtgaggacaatagtgaagccaggatgttcacaagacgtactgaaagcagcactgagcgtgatggcttcagtgactgatgtccttactaccatttcttcatcttcaaatggtggtcaacagttcgcttaaaaagcaaaagctctttattaagcttccatgaaactttgcttaaactctttcaaccattccacatttcatgttctctttttttttttattcctttgcgatgtaacttttgttgttgatgttgctgttgtgagtttcgaaacgagagattaataaacaagtgtgggattcacaatatcttcttttttttttgtcaactggattcatagtgtccagctacatgtatttcgacttgcactacttaattctccaaatctacaatttgttcatatg

SEQ ID NO: 3853 - DNA, 2221 bp, Lactuca sativa
agtgtgtgtttttaggtgaagaaagcagagtgagtgctgtttgttcttggtgagagaaagagagagagagagagattcacgcacgaatcgctaggtaaaacttagaatttctgtgtagcaatggattcggattatggagttccaagagagctttctgatctgcaaaagaatcgatctctgtacaaacctgagcttcccccttgtcttcagggaacaactgtgcgagtagaatttggtgatgcaactgctgcagctgatccttcaggtgctcatgccattgctcgttcttttcctcacacttatggtcaaccattggctcatttcctcagagcaacagctaaaggatctaatgctcagatcattaatgagcaccctgcagtaaaggttgggctggttttttgtggtagacaatctcctggaggacataatgttgtttggggacttcatgaagctctcaaaagtcacaaccctaaaagcactttgcttggatttcttggtggttctgaaggtttatttgctcaaaaaactcttgagatcacagacgatattcttgcaacctacaaaaatcaaggtggttatgatctattgggaagaacaaaggaccaaataagaaccacagagcaagtaaattctgccatggctgcatgcaaggccttgaatttagatggtttagtcattgttggaggtgtaacatctaacacagatgctgctcaacttgctgagacttttgctgaagcaaagtgctctacaaaggtggttggagtacctgttaccttgaatggagatcttaagaaccaatttgttgaagcaaatgttggttttgatactatctgtaaggttaactctcaactcatcagtaatgtctgcacagatgctctttctgctgaaaagtactactattttatccgactcatgggtaggaaggcatctcatgttgctgtggagtgcactctccagtcacatcctaacatggttattcttgctgaagaagttgctgcttcaaagcttaccatttttgacataacaaaacagatttgtgatgccgtgcaagctagggcagaacaaggcaagaatcatggagtcatcctactcccagaaggacttatcgaaagcattccagaagtttatgcacttttgcaggaaattcatagtcttttgagacagggagtttctgctgataaaatatcaacacaactctcaccttgggcttctgctttgtttgaatttttgccaccctttattaggaaacagattctcctccaccctgagtcagatgactcagctcagttgtctcagattgaaacagaaaagcttcttgcagaacttgtggaagcagaaatcaacaagcgactgaaagaaggtacatacaaggggaagaagttcaacgccatctgtcacttttttgggtatcaagctcgaggttctttaccatcaaaattcgattgtgactatgcctatgtgctcggacatagttgttaccatattctagcatctggtttaaacggttacatggcaactgtcactaacctcaagaatccttcaaacaaatggcgttgtggtgctgctccaataacagctatgatgacagtgaagcattatgggcgtgggtcagggtcaggggccataacacttgggaaacctgtagtccatcctgctactgtggacttgagaggcagagtatacgagttgcttagacaaaatgcaacaagattcttgatggatgatgtgtacagaaaccctgggccccttcagtttgatgggccaggtgctgattctaaagctgtcagcttgtgtgtggaggatcttgattacatgggtcgtattaaggaattaaacgaatatcttgacaaggtgagaacgatagtgaaaccagggtgttctcaggatgttttgaaggcggctttgagtgccatgtcatcagtgacagatattctatctgtcatgacctcacagcggttggagtagtggaagtagtacaagttgaggatcttttcaactcattgtgtgtactcttctttcaggttttctatattttctcaaaattttagtgagtatgagttttcttttcagttttaaaggcaaaacagttagattgcaactacttggttttcgttatgtttttgtgtggaatctttataattacaattaatgtttgacattttttttggtcaatttcttgtgtggttaataatttcgggtgacaagatattaatgggagatc

SEQ ID NO: 3854 - DNA, 2183 bp, Cichorium intybus
acagagtgagtgctgttcttggtgtgagagcgagatacgcacacaaatcacaaggaaaatcagagaatttctgcgtagaaaatggaatcagattatggagttccaagagagctttctgatctgcaaaagaatcgatctttatacaaacctgagcttcccccttgccttcagggaactactgtgagagtagagtttggtgatgcaactgctgcagctgatccttcaggtgctcatgcaattgctcgatcatttcctcacacttatggtcaaccattggctcattttctcagagcaactgctaaagtatccaatgctcaaaccattaatgagcatcctgctgtaaaggttggactggttttctgtggtagacaatctcctggaggacataatgttgtttggggtcttcatgaagctctcaaaagtcacaaccctaaaagcactttacttggatttcttggtggttctgaaggtttgtttgctcaaaaaacacttgagatcacagacgatgttctagcaacctacaaaaatcaaggtggttatgatctattgggaagaacaaaggatcaaataagaaccacagaacaagtgaactctgccatggctgcatgcaaggccttgaagttggatggtttggtcattgttggaggtgtaacatctaacacagatgctgctcaacttgctgagacttttgctgaagcaaaatgctccacaaaggtggttggagtacctgttaccttaaatggagatcttaagaaccaatttgttgaagcaaatgttggttttgataccatctgtaaagttaactctcaactcatcagtaatgtatgcacagatgctctttctgctgaaaagtattactattttatccggctcatgggtaggaaggcatctcatgttgctgtggagtgcactctccaatcacaccctaacatggttattcttgctgaagaagttgctgcttcaaagcttaccatttttgacataacaaaacagatttgtgatgctgtgcaagccagggcagaacaagacaagaatcatggtgtcatcctacttccagaagggcttatcgaaagcatccctgaagtttatgcacttttgcaggaaattcatagtcttctcagacaaggcgtttctgctgataaaatatcaacacaactatcaccttgggcatctgcattgtttgaatttttgccaccttatttcaggaaacagcttcttctccatcccgagtcagatgactcagctcagttgtctcaaatcgagacagaaaagcttcttgctgaacttgttgaagcagaaattaacaagcgtctgaaagaaggtacatacaaggggaagaaattcaacgccatctgtcacttttttgggtatcaagctcgaggctctttgccatcaaaattcgattgtgactatgcctatgttcttggacatagttgttaccatatactcgcagctggtttaaatggttacatggcaactgtcactaacctcaagaatccttcaaacaagtggcgctgtggtgctgctccaatcacagctatgatgacagtgaagcattatggtcgtgggtcagggtcaggggcgataacactcgggaagcctgtggtccatcctgctactgtggacctgagaggcagagtatacgagctgcttagacaaaacgcaacaagattcttgatggacgatgtttacagaaacccgggaccgcttcagtttgatggtcccggtgctgattctaaagctgttagtttgtgtgttgaagaccttgattacatgggtcgtatcaaggaattgaatgaatatcttgaaaaggtgagaacgattgtgaaaccggggtgttcacaggatgttttgaaagcggctttgagcgccatgtcatcggtgacagacattctatctgttatgacctcacagcgtttggagtaattgaatttttaagatgattgtgtgtactctgtgacccccttttggttttattctttattttcttaaatttttagcgagttctcttcaaggtttaaaggcaaaacagttagattgcagttacttggtcgttgttatgttggttttttttgttgggggttgtttgtggaagctttataatgagatacatttttgtttgggtcaaaagggggggcccggtaccctcattcgtcccttaggattcaagatccatcacttcc

SEQ ID NO: 3855 - DNA, 2186 bp, Artemisia annua
ctcgcgtgtcgataacacaaacaaacacattcacaccttccttcactcacctgctctgttttcatcacccaataaaaaaaacacacactcaaaacacacacacacaaatcaatcaaatcaatggattccgactatggtgtcccaagagagttatctgatctacaaaaagacagatctttataccaacctgaactccctccttgtcttcagggaacaactgtgcgagtagagtttggtgatgctactgctgccgcagatccttctggtgctaatgctattgctcgatcatttcctcacacttatggtcaacctttggctcattttttcagagaaaaatctaaaacacccaatgctcagactatcagtgagcacccagcagtaaaggttggattggttttctgcggtagacaatctcctggaggacacaatgttgtatggggtcttcatgaggctcttaaaattcacaaccctaagagtacattgcttggatttttgggtggttctgaaggtttatttgctcagaagaccctcgaaatcacagatgatgttcttgcaacctacaaaaatcaaggtggttatgatctgttgggacgaacacaggatcaaattagaaccacagaacaagtaaattctgccatggcagcatgcaaggctctgaatttggatggcctagtcattgtcggaggggtaacttccaacacagatgcagctcagcttgctgaaacttttgcagaagcaaaatgcgctacaaaggtggttggagtacctgttaccttgaacggagatcttaagaaccagtttgttgaagccaatgttggttttgatactatatgcaaggttaactctcaacttatcagcaacgtctgcactgatgctctttctgctgagaagtactactattttatccggctcatgggtaggaaggcatctcatgttgctgtggagtgcactctgcagtcacatcctaacatggttatccttgctgaagaagttgctgcttcaaagcttaccctctttgatataaccaaacaaatttgtgacgccgtgcaagccagggcagaacaagacaagaatcatggtgtcattatacttccggaaggtcttattgaaagcatcccagaagtttttgcactattgcaggaaattcatagtcttttgcgagaaggtgtctctgctgataatatatcgacaaaattgtcaccctgggcatccgccttgtttgaatttatgccgccctttatcaggaaacagcttctcctccatcctgaatcagatgactcagcccagctgtctcagattgagactgagaagcttcttgctgaacttgtggaagccgaaatcaacaagcgactgaaagaaggtacatacaaggggaagaaattcaatgccatctgccactttttcggctaccaagctcgtggttctttgccttcaaagtttgattgtgactatgcatatgttcttggacattgctgttaccatatcttggcagctggtttgaatggttatatggcaactatcactaacctaaagagtccttcgaacaaatggcgatgtggtgctgctccaataacagctatgatgacggtaaagcattatggtcgtggatcaggtgcaggagctaccacaattgggaagcctgtagtccatcctgctgccgttgatttgagaggcaaagtatacgagttgcttagacaaaatgcaacaagattcttgatggatgatatttacagaaaccccggtccccttcagtttgaaggtcctggtgccgattctaaagccgttagcttgtgtgttgaggacctggattacatgggccgtattaaggaattgaacgattatcttgacaaggtaagaacaattgtgaaaccaggttgttctcaagacgttctgaaagctgcattgagtgccatgtcatctgtgaccgacattctttcggtcatgacctcacaacgccttgaatagtaacaccactcagtgattggatttttatggttcttccacagattaatagtactcgaacctccttcagattttcttttttattttcaagattttgtgatgagcttgttttttttcttaaggcaaacaattagaattccgctacttgatcaaactgtttttgttttcgggtctacgtttgtggaagtttaatataacgaggaataatgcttgacataaatatt

SEQ ID NO: 3856 - DNA, 2067 bp, Fagopyrum esculentum
acgaagaaaaatggattcagatttcggtatcgcgagagaactctccgatcttcaaaaacaacgatctttctatcaaccggagctcccaccttgcctccaggggactactgtgagagtagaatttggtgatgcaactactgtctccgatcccactgatgcatccgccataagtagatactatcctcgcacttatggccagcgtttggttcattttcttagagcaactgctaaagttgctgatgctaagattattaccgagcatcctcccattagggtcgggttagttttctctgggagacagtctcctggtggtcataatgtcatttggggccttcatgaagctctcaagattcacaactccaacaatgtgctaattgggtttctcggtggtactgaaggattgtttgcacagaaagctcttcagatcacagacgatgtactttctacatacaaaaatcaaggtggttatgatttgttgggaaggactaaagatcagatcagaactactgaacaagttaatgctgcattagcagcttgcaatgctttgaagctggatggtcttgttgttattggaggggtgacctctaatacagatgctgctcagcttgcggaattttttgcagaggctaattgtgcaacgaaggttgttggagttcctgtcactttgaatggtgatctgaagaatcagtatgtcgaaactgatgttggttttgacaccatctgtaaggtcaactctcaacttattagcaacatgtgcactgatgctttgtctgcagagaagtattattatttcatcaggctcatgggacgcaaagcatcacatgtttctctggaatgtgctctccaatcacatcccaacatggtcattcttggtgaagaggtggctgcttcaaagctgaccctttttgacttgacaaaacaactttgtgatgctattcaagctcgggctgaacaagacaagtatcacggtgtcatactacttccggagggtctaattgaaaacatacctgaagtatatgctttgttacaggaaattcacggccttcttaggcaaggagtctctgctgataagatttcgtcgcaactttcaccttgggcatccgccttgtttgagtttttgcctccattcattaaaaaacagctgcttcttcatcctgagtcagataattctgctcagttatcacagatcgagaccgaaaagctattggcacaccttgtcgaagaagaaataaacaagcgcgtgaaagcaggcacatacaaggggaagaagttcaatgcaatatgccacttctttggttatcaagctcgaggatccttaccgtcgaaatttgattgtgattatgcatatgtacttggtcatatatgctaccatgttcttgctgctggtctgaatggatacatggcaacagtgacaaacctcaaaaatccttctaacaagtggaaatgtggcgctgctccatttacgacaatgatgactgtcaagcgccattctcgtggaccgggagcctcttttgtcggacatcctgcaattcacactgctacagtggatcttaaaggcaaagcttatgagttactgagacagaatgcatcgagattcttaatggaggacatatacagaaacccaggacctatccagtttgaaggtcccggttctgatgccaagtcggttagtctttgcgtagaggatcaggactacatgggtcgtatcaagaaactgcaggaatatcttgaccaggtgaagacaattgtaaaacctgggtgttcacaagacatcttgaaggctgctctaagtgccatgtcttctgtgaccgatattctctcagttatggcaggagcatcaaataacagccaaggtcgtttctgaagttgagtgatggtccctttttttgcctgaaaccagagttcttttcttttttgttattcaagatttggcagacaacaaacattagaacagtacccatgacgggatccaaatttcagatatttgcttatatgcgaaatgcacttaataaatcttcttgaatgtctgcttttaaggctctgtttgtaggagaattgggatttacc

SEQ ID NO: 3857 - DNA, 2103 bp, Aquilegia formosa
acacaactaccaaaccaaacacagaaaacagagcaacaaagaaaaagaagaagaagaaaatggattctgacttcggcgcaccaagagaactttcagatctacagaaacatcgaactctttacgaaccagaaattccaccatgtcttcagggaactacagtccgggtagagtttggcgatgctactagtactgccgatcagtccattagccactctttccctcacacgtatggtcagcctttggctcactttctaagggcaactgctcagattcctgacgctcaggtcataaatgaacatcctgctgtcagggtgggagcagtcttttgtgggagacaatctcctggaggacacaatgtagtatggggaattcacaatgctcttaagttgcacaactctaacaatgttttgcttggattccttggtgggtctgaaggtctgtttgcacagaagactttggaaatcaccgatgacgttctcgcatcctataaaaatcaaggtggttatgatttgctgggccgcacaaaggatcaaattaaaactactgagcaagttaatgctgcactagccacatgcaaggccttgaaattggatggtcttgttattattggaggtgtcacatcaaacaccgacgcagctcagcttgcagagacatttgcagaagcaaagtgccctacaaaggtggtcggagtacctgtcacattgaatggagacttgaggaatcagtttgttgaaactaatgttggttttgatacaatttgtaaggtcaattcccagctcatcagtaatgtctgcacagatgctctctctgccgagaagtattactattttatcagactcatgggtcgaacggcatcacatgttgctttggaatgcacacttcagtcacatccaaatatggttgtccttggggaggaggtggcttcatctaagcttactttgtttgatctgacaaaacaaatatgtgacgcagttcaagcaagggcagaacaagataagaatcatggggtcatccttcttcccgaggggttagttgaaagcattcccgaagtatatgcacttctgcaggaaattcatgaattgcacagacagggtgtttctattgacaacatgtcctcaaatctttcaccttgggcatctgcattgtttgaattcttgccgcccttcatcaagaaacagctgcttcttcatcccgagtcagatgattccgcacagttatcccagatcgagacagagaaacttctagcagatttagtggagacagaaatgaccaagagattgaaagaaggcacatacaaggggaagaagttcaatgccatctgccacttctttggttatcaggctagaggatctttaccatcaaaatttgactgcgattatgcttatgttcttggacacatctgctatcacattttagctgctggtcttaacggttacatggcgactgtaacaaacttgaaaaatcctgtgaacaagtggcgttgtggtgctgcaccaataacggcaatgatgactgtaaagcgatattcacgtggtcctgggacctcctcaataggaaagcctgctgttcatcccgcacaagttgatttgaagggcaaagcatacgagttgctgaggcaaaatgccacaaaattcttgatggatgatgtctacagaaacccaggtccacttcaatttgatggcgcaggggctgacaccaagactgtctccttgtgcgtcgaagaccaagactacatgggtaggatcaagaagttgcaggagtatcttgacaaggtacgaaacattgtgaaaccaggttgctcacaggatgttttgaaagcggctttgagtgccatgacatcagtgacagatattctttccataatgtctgcaccttcatccactggttcaacacctgtctaacttatgattgaaatgctctttgtgggtgaagctggtgtgctttaggctttttcaagatgaacattgacactattcagaatttttcatgtaggtttggaacttagatcattaatgatcacaatgagtgttttgattatatgaagaacaataatgagaaaattttggtaagctcgtgtagtatggatcattacacatatttttt

SEQ ID NO: 3858 - DNA, 2200 bp, Aquilegia formosa
ccaaaacacaaccaccaaaccaaacacagaaaacagagcaacaaagaaaaagaagaaagaagaaagaagaaaatggattctgacttcggcgcaccaagagaactttcagatctacagaaacatcgaactctttacgaaccagaaattccaccatgtcttcagggaactacagtccgggtagagtttggcgatgctactagtactgccgatcagtccattagccactctttccctcacacgtatggtcagcctttggctcactttctaagggcaactgctcagattcctgacgctcaggtcataaatgaacatcctgctgtcagggtgggagcagtcttttgtgggagacaatctcctggaggacacaatgtagtatggggaattcacaatgctcttaagttgcacaactctaacaatgttttgcttggattccttggtgggtctgaaggtctgtttgcacagaagactttggaaatcaccgatgacgttctcgcatcctataaaaatcaaggtggttatgatttgctgggccgcacaaaggatcaaattaaaactactgagcaagttaatgctgcactagccacatgcaaggccttgaaattggatggtcttgttattattggaggtgtcacatcaaacaccgacgcagctcagcttgcagagacatttgcagaagcaaagtgccctacaaaggtggtcggagtacctgtcacattgaatggagacttgaggaatcagtttgttgaaactaatgttggttttgatacaatttgtaaggtcaattcccagctcatcagtaatgtctgcacagatgctctctctgccgagaagtattactattttatcagactcatgggtcgaacggcatcacatgttgctttggaatgcacacttcagtcacatccaaatatggttgtccttggggaggaggtggcttcatctaagcttactttgtttgatctgacaaaacaaatatgtgacgcagttcaagcaagggcagaacaagataagaatcatggggtcatccttcttcccgaggggttagttgaaagcattcccgaagtatatgcacttctgcaggaaattcatgaattgcacagacagggtgtttctattgacaacatgtcctcaaatctttcaccttgggcatctgcattgtttgaattcttgccgcccttcatcaagaaacagctgcttcttcatcccgagtcagatgattccgcacagttatcccagatcgagacagagaaacttctagcagatttagtggagacagaaatgaccaagagattgaaagaaggcacatacaaggggaagaagttcaatgccatctgccacttctttggttatcaggctagaggatctttaccatcaaaatttgactgcgattatgcttatgttcttggacacatctgctatcacattttagctgctggtcttaacggttacatggcgactgtaacaaacttgaaaaatcctgtgaacaagtggcgttgtggtgctgcaccaataacggcaatgatgactgtaaagcgatattcacgtggtcctgggacctcctcaataggaaagcctgctgttcatcccgcacaagttgatttgaagggcaaagcatacgagttgctgaggcaaaatgccacaaaattcttgatggatgatgtctacagaaacccaggtccacttcaatttgatggcgcaggggctgacaccaagactgtctctttgtgcgtcgaagaccaagactacatgggtaggatcaagaagttgcaggagtatcttgacaaggtacgaaacattgtgaaaccaggttgctcacaggatgttttgaaagcggctttgagtgccatgacatcagtgacagatattctttccataatgtctgcaccttcatccactggttcaacacctgtctaacttatgattgaaatgctctgtgggtgaagctggtgtgctttaggctttttcaagatgaacattgacactattcagaatttttcatgtaggtcattaatgatcacaatgagtgttttgattatatgaagaacaataatgagaaaattttggtaagctcgtgtagtatggatcattacacatattttttgggttccaaataaaagagaagaccatttagggggtgtttggcaaaggttttgaaatatattaacatgttttgtgattgaatataaaagtttagaaaagt

SEQ ID NO: 3859 - DNA, 2115 bp, Helianthus annuus
gtgctttttaggtgaagaaaccaaagtaacaatcttctgtgtaaaatatggattcagattacggtgttccgcgagagctttctgatctgcagaagaatcgatctctctacacaccggagcttcctccgtgccttcagggaactactgtgagggtagaatttggtgatgcaactgctgcagcagatcctgctggcgctcacgcgattgcccgatcatttcctcacacttatggtcaacctttggttcattttttcagagaaaaatctaaaccagtcaatgctcagaccattagtgaacatcttgcagtaagggttggattggttttctgtggtagacaatctcctggaggacataatgttgtatggggacttcatgaagctctcaaaattcacaaccctaaaagtgttctgcttggatttctcggtggatctgacggtttatttgctcaaaaaaccctagagatcacagatgatgttcttgcaacctacaaaaatcaaggtggttatgatttattgggacgaaccaaggatcaaatcagaaccatagaacaagtaaattctgcaatggaagcatgcaaggctttgaagttggatgccttagtgattgttggaggggtaacatctaacacagatgctgctcagcttgctgagacttttgcagaagcaaaatgctccacaaaggtggttggagtacctgtgaccttgaacggtgatcttaaaaaccagtttgttgaagcaaatgttggttttgatactatctgcaaggtgaactctcaactcatcagtaacgtctgcactgatgccctttctgctgaaaagtattactattttatccggctcatgggtaggaaagcatcccatgttgctgtggaatgcacacttcagtcacatcctaacatggttatccttgctgaagaagttgctgcttcaaagcttaccatttttgacataaccaaacagatttgtgatgccgtgcaagccagggcagaacaagacaagaatcatggtgtcattctacttccagaagggcttatagaaagcatccctgaagtttatgcactgttacaggaaattcatagtcttcttcgacaaggtgtttcggctgacaatatatccacacaactgtcaccttgggcatccgccttgtttgaattcatgcctccttttattaggaaacagcttcttcttcatcctgagtcagatgactctgcccagctgtctcagatcgaaaccgagaagcttcttgctgaacttgtggaagcagaaattaacaagcgactgaaagaaggaacatacaaggggaagaaatttaatgccatctgccacttctttggctaccaagctcgtggttctttgccatcaaaatttgattgtgactatgcctatgttcttggacatatttgttaccatattttggctgctggtttaaatggttatatggccactgtcaccaacctcaaaagcccttcaaacaaatggcgctgtggtgcagctccaataacggctatgatgaccgtcaagcattatggtcgcgggtcagggtcaggggctacaacacttgggaaaccttttgttcatcctgctgccgtagatttgagaggcaaagtatacgagctgcttagacaaaatgcaacaagattcttgctggatgatgtctacagaaaccccggcccccttcagtttgacgggccaggtgctgattccaaagctgtcagcttgtgtgtagaggacttggattacatgggccgcatcaaggaattgaatgactatcttgagaaggtaagaacaattgtgaaaccaggttgttcacaggatgttctaaaagctgctttgagtgccatgtcatctgtgacggacattctttctgtcatgacctcacaacgcctcgactaatcaatactccatgtagcttgctgatctggcaaaatcaaactctttggtgcttcctcaactcaatactcaacactttctgattttccttcattttcttgattttgtgatgagtttcttttttattattcgaaggcgaacaattagatttcagttaatcatcattacgcttgttttggttttcgggtcttgtttgtggaagctttataatgagaaataatgcttg

SEQ ID NO: 3860 - DNA, 2172 bp, Arnica chamissonis
gccccactctgtgctttttaggtgaagaacacaaagcgactgctattcttgttgcgagaaaaacacacagatttgaacgaaaatcaaacaatttctgtgtagaagatggaatcggattatggagttccaagagagctttctgatctgcaaaagaatcgatctctatacacacctgaacttcccccttgccttcagggaactactgtgagagtagaatttggtgatgcaaccgctgcagcagattcttccgatgctcatgccattgcccgatcatttcctttgacttatggtcaacctttggtccattttttcagagaaaagtctaaagcagtcaatgctcagaccattgttgagcatcctgcagtaagggttggattggttttctgtggtagacaatctcctggaggacataatgttgtatggggacttcatgaagctctcaaaattcacaaccctaaaagtattttgcttggatttttaggtggatctgatggtttatttgctcaaaaaactctccagatcacagatgatgttcttgcaacctacaaaaatcaaggtggttatgatttattgggacgaaccaaggatcaaatcagaaccacagaacaagtaaattctgcaatggcagcatgcaaggctttgaatttggatgccttagtgattgttggaggggtaacatctaacacagatgctgctcagcttgctgagacttttgcagaagcaaaatgctctacaaaggtggttggagtacctgtgaccttgaacggtgatcttaaaaaccagtttgttgaagcaaatgttggttttgatactatttgcaaggttaactctcagctgatcagtaacgtctgcacagatgctctttctgctgaaaagtattactattttatccggctcatgggtaggaaagcatctcatgttgccgtggaatgcacacttcagtcacatcctaacatggttatccttgccgaagaagttgctgcgtcaaagcttaccatttttgacataaccaataagatatgtgatgccgtgcaagccagggcagagcaagacaagaatcatggtgtcattctacttccagaagggcttatagaaagcatccctgaagtttatgccctgttacaggaaattcatagtcttcttcgacaaggtgtttctgctgataagatatccacacaactgtcaccttgggcttccgccttgtttgaatttatgcctccttttattaggaaacagcttcttctccatcccgagtcagatgactcagcccagttgtctcagattgaaaccgagaagcttcttgctgaacttgtggaagcagaaattaacaagcgactgaaagaaggtacatacaaggggaagaaatttaacgccatttgccacttttttggctatcaagctcggggttctttgccatcaaaatttgattgtgactatgcctatgttcttggacatatttgttaccatattctggctgctggtttaaatggctatatggcaactgtcactaacctgaaaagaccttcaaacaaatggcgatgtggtgctgctccaataacggctatgatgactgtcaagcattacggtcgcgggtcagggtcaggtgctgcaacgcttgggaaacctgtagttcatcctactaccgtagatttacgaggcaaagtatacgatctgcttaaacaaaatgcaacaagattcttgttggatgatgtttacagaaaccccggcccccttcagtttgacgggccaggtgccgattctaaagctgtcagcttgtgtgtagaggacttggactacatgggccggatcaaggaattgaatgattatcttgacaaggtaagaacaattgtgaaaccaggttgttctcaggatgttctaaaagctgctttgagtgccatgtcatctgtgacagacattctttctgtcatgacctcacaacgcgccgagtgatactccacttggcttgctgacctggcaaagtcgaactttatggtgctttctctagttgatactccgaacctctttcaggtttcatttattttctcgattttgggatgagtttctttttattaattccaaggcaacaatcagatttcggatacttgatcatcactgtgattgtctttgttttcgggtcttgtttgtggaagttttataacaaggaacattgct

SEQ ID NO: 3861 - DNA, 1770 bp, Fragaria vesca
caaccaattccaattctctcactactcatggattccgactacggcattccccgggagctctccgccgtccagaagctccgatctcaataccagccggaccttcctccttgcctccagggaactactgtaagagttgaatttggggacacaaccacagcggcagaccccacagatgccaataccattagccgatactttccaaacacttatggtcagcctttggctcactttctgagggcaactgcaaaagttgctggtgctcaggttatttcagagcatccggctatgagggttggaattgtcttttgtgggagacaatctcctggaggacacaatgtcatctggggacttctcaaggctctcaaaactcataaccccaacagtaccttacttgggtttttgggtggatctgaaggtttatttgcacagaaaactcttgagataacagatgatgttcttgccacctacaaaaatcaaggtggttatgatttgcttggacggacaaaagatcaaattagaacaaaggagcaagtcaacgctacgttaactgcatgcaatgctttgaagttggctggccttgtcataattggaggggtgacatcaaacactgatgctgctcagcttgcagagacattcgcagaagcaaaatgccagacaaaggtggttggagttcctgtcactatgaacggagatcttaaaaaccagtttgtggaagctaatgttggttttgatacagtatgcaaggtcaattcccagctcatcagcaatatgtgcacagatgctctttctgctgaaaagtattattatttcattcgactcatgggccggaaagcatcacatgttgccttggagtgcacccttcaatctcatccaaacttggtaattcttggtgaggaggtggctgcatccaagctaacgctttttgacattgcaactcgaatctgtgatgccgtccaagaccgtgccgcacaagacaagaatcatggtgtcatcctattaccagaaggacttatagaaagcattcctgaagtgtatgccctcctgaaggaaattcatggtttgtataggcaaggagtttctgctgataagattttgtctcaactctcaccatgggcatctgctttgtttgaatttttgccacattttatcaagaaacagctgcttcttttgcctgaatcagatgactctgcacagttatctcagattgagacagagaaacttcttgcacatcttgtggaggtggagatgaacaagcgccaaaaagaaggcacatacaaggggaagaagttcaatgctatctgccactttttcggttatcaggctcgggggtctttaccatcaaagttcgattgtgactatgcctatgttcttgggcacatctgctaccacatgcttgcagctggtttgaatggttacatggcaactgtaactaatctgaaaatcctttgacagtggcgttgtggtgctactcatttacggccatgatgtccgtaaagcgctggtctcaaaatcctgggtctgctgcatctattggaaaacctggcatatttcctgctaccgtagatttgaaaggcaaagcatacgagctattgaggcaaaacgctacaaaattcctgctggatgatatctacagaaatccagggcctctccaatttgaaggtcctggtgccgattccaaggctgtaacactctgcgttgaagaccaggattacatggggcgcatcaagaaattgcaggaatatcttgaccagattcgaaccattgtgaagc

SEQ ID NO: 3862 - DNA, 2196 bp, Hordeum vulgare
actgagccagccaccaccaccaccaacacccaaaaaaacacatcgacgatacaaacgacgcagccgcccctcgccggcgacgagtgccgggccatggattccgactacggcgtgccgcgcgagctctcggaggtgcagcagaagcggactctctaccagcccgagcttcccccctgcctccagggcactactgtgagggtggagtatggtgatgtggcgatcgctgccgatcctgctggcgctcatgtgatcagccacgcgttcccccatacatacgggcagccactggctcatttcctcaggaaggcggctaatgtccctgatgctaaagtcatatcagagcaccctgccgtcagggttggtattgtattctgtggaaggcagtccccgggaggccacaatgtcatctggggactccatgaggccatcaaagctcacaacctgaacagcaaacttattggtttccttggaggaactgacggtcttcttgcacaaaaaactttggagatcacaaatgaagttctttcttcctacaaaaaccaaggtggttatgatatgcttggtcggactaaggatcaaatcagaacaacggagcaagtcaatggtgcaatggctacttgccaggctttgaagctggatgctctggtaataatcggaggtgtcacatcgaatacagatgcagctcaacttgccgagacttttgctgaggcaaagtgcgcaacaaaggttgtaggtgtccctgtaactttgaatggggaccttaagaaccaatttgttgagacaactgttggtttcgataccatatgcaaggtgaactcacaacttataagcaatatgtgcactgatgctctatctgctgagaagtattactatttcatccgtatgatgggaaggaaggcatctcatgtggcattggagtgtgctcttcaatcacatccaaacatggttatccttggtgaggaggttgctgcatcaaaactcacaatttttgatatcacaaagcagatatgtgatgcagttcaggcgagagctgaaaaagacaagaatcatggggttatacttattccggagggccttgtggagagtattcctgaattatatgctcttctacaggaaattaatggcctccacggtaaaggtgtttccgttgagaatatctcttctcagctttcaccttgggcatctgcgctgtttgagtttttgccccaattcattaggcagcagctgcttctccgccctgaatctgatgactcagctcaactttctcagattgaaaccgaaaagcttctagctcaattggttgagaccgaaatgaacaaacgtttgaaggaaggaacttacaaaggaaagaagttcaatgcaatttgtcacttctttggctaccaagctaggggtgcaatgccatcgaagtttgactgtgattatgcctatgttctgggacatgtgtgttaccacatcttggcagctggtttgaacggttacatggctactgtgacaaatcttaagagtcctctaaacaagtggcgatgtggtgctgctcctatttcgtccatgatgaccgtgaagcgatggtcacgtggccctgcaaccacacaaatcgggaagccagctgtgcatatggctagcgtcgatttgagagggaaagcatacgagatgttgaggcagaattcgtccagctgtctgttagaagacatctacagaaaccctggaccactccaatttgaaggaccaggtgcggatgccaagcctatttcactgtgcgtcgaggatcaagactacatgggcaggatcaagaaattgcaggaatacttggagaaggtgaagagcatagtgaagcctgggtgctcgcaggatgttctcaaggcggcgctgagtgccatgtcttccgtgacggagacactggctatcatgacttcctcctccactggccagcccccactctgagggtcaagcacttatgtgggttatgaatctattatgcgtttcccgattctcttttgccccatctgacggttgggattagagacagtgatattgtgatcccatggtttattcttttcctagtttttgggagagttttattacgtatcatttttggctctgatagtgtattggggtttacttttggcggggttgaactttgaataatttggatcaaactgtcggttgtgatctattaataatctaaattttgag

SEQ ID NO: 3863 - DNA, 2193 bp, Hordeum vulgare
cagccaccaccaccaccaacacccaaaaaaacacatcgacgatacaaacgacgcagccgcccctcgccggcgacgagtgccgggccatggattccgactacggcgtgccgcgcgagctctcggaggtgcagcagaagcggactctctaccagcccgagcttcccccctgcctccagggcactactgtgagggtggagtatggtgatgtggcgatcgctgccgatcctgctggcgctcatgtgatcagccacgcgttcccccatacatacgggcagccactggctcatttcctcaggaaggcggctaatgtccctgatgctaaagtcatatcagagcaccctgccgtcagggttggtattgtattctgtggaaggcagtccccgggaggccacaatgtcatctggggactccatgaggccatcaaagctcacaacctgaacagcaaacttattggtttccttggaggaactgacggtcttcttgcacaaaaaactttggagatcacaaatgaagttctttcttcctacaaaaaccaaggtggttatgatatgcttggtcggactaaggatcaaatcagaacaacggagcaagtcaatggtgcaatggctacttgccaggctttgaagctggatgctctggtaataatcggaggtgtcacatcgaatacagatgcagctcaacttgccgagacttttgctgaggcaaagtgcgcaacaaaggttgtaggtgtccctgtaactttgaatggggaccttaagaaccaatttgttgagacaactgttggtttcgataccatatgcaaggtgaactcacaacttataagcaatatgtgcactgatgctctatctgctgagaagtattactatttcatccgtatgatgggaaggaaggcatctcatgtggcattggagtgtgctcttcaatcacatccaaacatggttatccttggtgaggaggttgctgcatcaaaactcacaatttttgatatcacaaagcagatatgtgatgcagttcaggcgagagctgaaaaagacaagaatcatggggttatacttattccggagggccttgtggagagtattcctgaattatatgctcttctacaggaaattaatggcctccacggtaaaggtgtttccgttgagaatatctcttctcagctttcaccttgggcatctgcgctgtttgagtttttgccccaattcattaggcagcagctgcttctccgccctgaatctgatgactcagctcaactttctcagattgaaaccgaaaagcttctagctcaattggttgagaccgaaatgaacaaacgtttgaaggaaggaacttacaaaggaaagaagttcaatgcaatttgtcacttctttggctaccaagctaggggtgcaatgccatcgaagtttgactgtgattatgcctatgttctgggacatgtgtgttaccacatcttggcagctggtttgaacggttacatggctactgtgacaaatcttaagagtcctctaaacaagtggcgatgtggtgctgctcctatttcgtccatgatgaccgtgaagcgatggtcacgtggccctgcaaccacacaaatcgggaagccagctgtgcatatggctagcgtcgatttgagagggaaagcatacgagatgttgaggcagaattcgtccagctgtctgttagaagacatctacagaaaccctggaccactccaatttgaaggaccaggtgcggatgccaagcctatttcactgtgcgtcgaggatcaagactacatgggcaggatcaagaaattgcaggaatacttggagaaggtgaagagcatagtgaagcctgggtgctcgcaggatgttctcaaggcggcgctgagtgccatgtcttccgtgacggagacactggctatcatgacttcctcctccactggccagcccccactctgagggtcaagcacttatgtgggttatgaatctattatgcgtttcccgattctcttttgccccatctgacggttgggattagagacagtgatattgtgatcccatggtttattcttttcctagtttttgggagagttttattacgtatcatttttggctctgatagtgtattggggtttacttttggcggggttgaactttgaataatttggatcaaactgtcggttgtgatctattaataatctaaattttgagaggg

SEQ ID NO: 3864 - DNA, 2305 bp, Triticum aestivum
atagaacagttagtcatgggcggggctggtaccggtcttgcatccccggatatcgtcgacccacgcgtccgcaaaaaaacacgcatcgacgatacgagcaacgcagccgcccctcgccggcgacgagtgctaggccatggattccgactacggcgtgccgcgcgagctctcggaggtgcagcagaaccggactctctaccagcccgagctgcccccctgcctccagggcactactgtgagggtggagtatggtgatgtggcgatcgctgctgatcccgccggcgctcatgtgatcagccacgcgtacccccacacatacgggcagccactggctcatttcctcaggaaggcggctaatgttcctgatgctaaagtcatatcagagcaccctgccgtcagggttggtattgtattctgtggaaggcagtccccgggaggccacaatgtcatatggggactccatgaggccatcaaagctcacaacgtgaacagcaaacttattggtttcctcggaggaaccgacggtcttcttgcacaaaaaactttggagatcacaaatgaagttctttcttcctacaaaaaccaaggtggttatgatatgcttggtcggactaaggatcaaatcagaacaacggagcaagtcaatggtgcaatggctacttgccaggctttgaagttggatgctcttgtaataatcggaggtgtcacatcgaatacagatgctgctcaacttgctgagacttttgctgaggcaaagtgcgcaacaaaggttgtaggtgttcctgtaactttgaatggggaccttaagaaccagtttgttgagacaactgttggtttcgataccatatgcaaggtgaactcgcaacttataagcaatatgtgcactgatgctctatctgctgagaagtattactatttcatccgtatgatgggaaggaaggcttctcatgtggcattggagtgtgctcttcaatcgcatccaaatatggttatccttggcgaggaggttgctgcatcaaaactcacaatttttgatatcacaaagcagatatgtgatgcagttcaggcgagggctgaaaaagacaagaatcatggggttatacttattcctgagggccttgtggagagtattcctgaattatatgctcttctacaggaaattaatggcctccacggtaaaggtgtttccgttgagaatatctcttctcaactttcaccttgggcatctgcgctatttgagtttttgccccaatttattaggcagcagctgcttctccgtcctgaatctgatgactcagctcaactttctcagattgaaaccgaaaagcttctagctcaattggttgagaccgaaatgaacaaacgtttgaaggaaggcacttacaaaggaaagaagttcaatgcaatctgtcacttctttggctaccaagctaggggtgcaatgccttcgaagtttgactgtgattatgcctatgttctgggacatgtgtgttaccacatcttggcagctggtttgaacggttacatggctactgtgacaaatcttaagagtcccctgaacaagtggcgatgtggtgctgctcctatttcgtccatgatgaccgtgaagcgatggtcacgtggccctgcaaccacacaaatcgggaagccagctgtgcatatggctagcgttgacttgagaggaaaagcatatgagatgttgaggcagaattcatccagctgcttgttggaagacatctacagaaaccctgggccactccaattcgaagggccaggtgctgatgccaagcctatttcactgtgcgtcgaggatcaagactacatgggcaggatcaagaaattgcaggaatacttggagaaggtgaagagcatagtgaagcctgggtgctcgcaggatgttctcaaggcggcgctgagtgccatgtcttccgtgacggagacactggctatcatgacttcctcttccactggccagcccccactctgagggccaagcacttgagtgggttacgaatctactacgcgtttcctgattctcttttgctccatctgacggttgggattcgagacagtgatcttgtcatcccatggtttattcttttcctagattttcggagagttttattatcatttttggctctgatagcgtatgcgggtgtactgttggcgagattcagcttgaataattttgatcaaactgtcggctgtgatctattaataatctaaattttgagagggtccatctctagctctctctttgattcatacgagaaccaattctgatgagaaaaacaaatggcggccg

SEQ ID NO: 3865 - DNA, 2190 bp, Triticum aestivum
caccaccaccaacaacaaaaaaacacgcatcgacgatacgagcagcgcagccgtccctcgccggcgacgagtgctcggccatggattccgactacggcgtgccgcgcgagctctcggaggtgcagcagaagcggactctctaccagcccgagctgcccccctgcctccagggcactactgtgagggtggagtatggtgatgtggcgatcgctgctgatccagctggcgctcatgtaatcagccacgcgtatccccacacatacgggcagccactggctcatttcctcaggaaggctgctaatgttcctgatgctaaagtcatatcagagcaccctgccgtcagggttggtattgtattctgtggaaggcagtccccaggaggccacaatgtcatatggggactccatgaggccatcaaagctcacaacgtgaacagcaaacttattggtttcctcggaggaaccgatggtcttcttgcacaaaaaactttggagatcacaaatgaagttctttcttcctacaaaaaccaaggtggttatgatatgcttggtcggactaaggatcaaatcagaacaacggagcaagtcaatggtgcaatggctacttgccaggctttgaagttggatgctcttgtaataatcggaggtgtcacatcgaatacagatgctgctcaacttgctgagacttttgctgaggcaaagtgcgcaacaaaggttgtaggtgttcctgtaactttgaatggggaccttaagaaccagtttgttgagacaactgttggtttcgataccatatgcaaggtgaactcgcaacttataagcaatatgtgcactgatgctctatctgctgagaagtattactatttcatccgtatgatgggaaggaaggcttctcatgtggcattggagtgtgctcttcaatcgcatccaaatatggttatccttggcgaggaggttgctgcatcaaaactcacaatttttgatatcacaaagcagatatgtgatgcagttcaggcgagggctgaaaaagacaagaatcatggggttatacttattcctgagggccttgtggagagtattcctgaattatatgctcttctacaggaaattaatggcctccacggtaaaggtgtttccgttgagaatatctcttctcaactttcaccttgggcatctgcgctatttgagtttttgccccaatttattaggcagcagctgcttctccgtcctgaatctgatgactcagctcaactttctcagattgaaaccgaaaagcttctagctcaattggttgagaccgaaatgaacaaacgtttgaaggaaggcacttacaaaggaaagaagttcaatgcaatctgtcacttctttggctaccaagctaggggtgcaatgccttcgaagtttgactgtgattatgcctatgttctgggacatgtgtgctaccacatcttggcagctggtttgaacggttacatggctactgtgacaaatcttaagagtcccctgaacaagtggcgatgtggtgctgctcctatttcgtccatgatgaccgtgaagcgatggtcacgtggccctgcaaccacacaaatcgggaagccagctgtgcatatggctagcgttgacttgagaggaaaagcatacgagatgttgaggcagaattcatccagctgcttgctggaagacatctacagaaaccctgggccactccaattcgaagggccaggtgctgatgccaagcctatttcactgtgcgtcgaggatcaagactacatgggcaggatcaagaaattgcaggaatacttggagaaggtgaagagcatagtgaagcctgggtgctcgcaggatgttctcaaggcggcactgagtgccatgtcttcggtgacggagacactggctatcatgacttcctcttccactggccagcccccactctgaaggccaagcacttgagttggttacgaatctactacgcatttcctgattctcttttgctccatctgacggttgggtttcgagacagtgatcttgtcatcacatggtttattcttttcctagattttcgggaagttttatgatcatttttggctctgatagcgtatgcgggtgtactattggcgagattcagcttgaataattttgatcaaactgtcggctgtgatctattaataatctaaattttgagagggtccatctc

SEQ ID NO: 3866 - DNA, 2439 bp, Gossypium hirsutum
aaaccctatttttcggagttttacgtcttatagtatttctccagcagctcactgtagcaccaaatttccgtacgtccaaaccctagattcattttcaccttctctgatcctccctcgactaacggagatattgattctttttcgaatttaattttctttcttttgcattaattgcatttctagatttgttgtggtggttagatttcaagatggtgtccgacgcgagcaagaagaaggctgctcagaagaaggctgctgccgctgcgaagagaggagggaaggccgctgcatccgctgcatcttccaaggcgacagcttcagcgaccgcggagaatggcgttgataatgtttctgataaagttagcatgctccagatatccgatcggacctgtaccggtgttctctgctcgcatcctctttccagagatattcgtatagagtccttatcagttactttccacggacacgatcttattgttgattcaacattggagcttaattatggcagacgctatggtttgctaggattaaatggttgtgggaaatccacgctgcttactgcaatagggttgcgtgaacttccaattccggagcacatggatatctatcacctgacaagggagattgaagcttcagatatgtctgcattgcaggctgtcataagttgtgatgaagagaggttgaagttggagaaagaagcagaaatcttggcagcacaggatgatggtggtggagagacacttgaacgtatctatgagcgattggatgccttggatgcatcaactgctgagaaacgtgctgcggaaattttatttggcctcggtttcaacaagatgatgcaggcaaagaaaacccgagatttctctggtggttggagaatgaggattgcattggcacgggctctattcatgaatcccaccattcttttgcttgatgagccaaccaatcatttagatttagaagcttgtgtctggttggaagaaaatttgaagaaatttgatcgaatccttgtggtgatatcacattcacaggatttcctgaacggagtttgtacgaacattatccatatgcaaaacaaaaacttaagttgtacaccggcaattatgatcagtacgttcaaactcgttctgaattggaagagaaccagatgaaacaatacaagtgggagcaggaacagattgcttcaatgaaggagtacattgctcgcttcggtcacggatcagccaaactagcccggcaggcacagagtaaggagaagacattggcaaagatggagcgaggtggactcacggagaaggtagtcagggacaaggttctggtgtttcgatttgttgatgttggaaaacttcctccaccggtactgcagtttgtggaagttactttcggatacacgcctgagaatctgatctacaagaacttggactttggggtagacttggactcaaggatagcattagtaggacctaatggtgcagggaagagtacactgctgaaactgatgacaggtgaattgactcctattgatggaatggtccgacggcataaccatctgcgaattgcacaattccatcagcatttggcagagaaactggatatggaaatgtcagctctccagtacatgataagagaatatcctggaaatgaggaagagaagatgagaggtgcaatagggaagtttggattgtcagggaaagcgcaagtgatgccgatgaagaacctatctgatggacagaggagtcgagtcatcttcgcgtggttagcatttcgacaaccccacttgctgctgctagatgagcccactaaccatttggatatcgagacgattgattcactggcagaagcattgaacgagtgggatggtgggttggtattggtgagtcacgatttccggctgataaaccaggtagccgaggagatatgggtgtgtgaaaatcaagctgcaacacgatgggaaggggacatcatggacttcaagcagcatctcaagagtaaagctggtttatctgattgaaacaaagcagtaattaacatataacttaaagcaggtggtgtccaccaccccagatgagttattctcgcatggtggattaagcttagtagctgctatttagtctttttatagagcaggggtaacgaggaaaggctttgttattgtttgaagccatcgagttttcgtgccctctgtttggtgggtttagcaaagcaggatttgttgccatttggttttttaaacctgggtttgctttctcctaggggttggttgttcggtgatacctgttctaggtttaaagcttttgaggcattgtgctgctgaggatttggcatcatataatcagtcctatgctgtatttttcttgcattaacttggatttcagattgaacggtattatgcgtgtaatattttctattctctattttaaaaaagagggttatgaataa

SEQ ID NO: 3867 - DNA, 2361 bp, Gossypium hirsutum
tcgcttcaaaaacaaaactctctcctctcttctgaaagcttttataattcagaaaccctatttttcggagttttacgtctaattgtatctctccagcaacgcacagtagcaccaaattccgtacgcccaaacctttgatccattatcaccttctctgatcttccctcgactaacggaggtctgttgtggtggttagatttgaagatggtgtcggacgcgagcaagaagaaggctgctcagaagaaggctgctgccgctgcgaaaagaggagggaaggctgctgcagccgctgcatcttccaaggcggcagctgcggcgaccgcggagaacggcgttgataaggtttctgataaagttagtatgctccagatatccgatcggacctgtaccggtgttctctgttcgcatcctctttcccgagatattcgtatagagtccttatcagttactttccacggacatgatcttattgttgattcaacattggagcttaattatggcagacgctatggtttgctaggattaaatggttgtgggaaatccacgctgcttactgcaatagggttgcgtgaacttccaattccggagcacatggatatctatcacctgacgagggagattgaagcttcagatatgtctgcattgcaggctgtcataagttgtgatgaagagaggttgaagttggagaaagaggcagaaatcttggcagcacaggatgatggtggtggagaggcacttgaacgtatttatgagcgattggatgccttagatgcatcaactgctgagaaacgtgctgctgaaattttatttggactcggtttcaacaagatgatgcaggcaaagaaaacccgagatttctctggtggttggagaatgaggattgcattggcacgggctctattcatgaatcccaccattcttttgcttgatgagccaaccaatcatttagatttagaagcttgtgtctggttggaagaaaatttgaagaaatttgatcgtatccttgtggtgatatcacattccccaggatttcctgaacggagtttgtacgaacattatccacatgcaaaacaaaaaacttaagttgtacaccggcaattacgatcagtatgttcaaactcgttctgaattggaagagaaccagatgaaacaatacaagtgggagcaggaacagattgcttcaatgaaggagtacattgctcgcttcggtcacgggtcagccaaactagcccggcaggcacagagtaaggagaagacattggcaaagatggagcgaggtggactcacggagaaggtagtcagggacaaggttctggtgtttcgatttgttgatgttggaaaacttcctcaccggtactgcagtttgtggaagttactttcggatacacgcctgagaatctgatctacaagaacttggactttggggtagacttggactcaaggatagcattagtaggacctaatggtgcagggaaaaagacactgctgaaactgatgacaggtgaatggactcctattgatggaatggtccgacggcataaccatctgcgaattgcacaattccatcagcatttggcagagaaactggatatggaaatgtcagctctccagtacatgataagagaatatcctggaaatgaggaagagaagatgagaggtgcaatagggaagtttggattgtcagggaaagcgcaagtgatgccgatgaagaacctatctgatggacagaggagtcgagtcatcttcgcgtggttagcatttcgacaaccccacttgctgctgctagatgagcccactaaccatttggatatcgagacgatcgattcactggcagaagcattgaacgagtgggatggtgggttggtattggtgagtcacgatttccggctgataaaccaggtagccgaggagatatgggtgtgtgaaaatcaagctgcaacacgatgggaaggggacatcatggacttcaagcagcatctcaagagtaaagctggtttatctgattgaaacaaagcagtaattaacatataacttaaagcaggtggtgtccaccaccccagatgagttattctcgcgtggtggattaagcttagtagctgctatttagtctttttatagagcaggggtaacgaggaaaggctttgttattgtttgaagccatcgagttttcgtgccctctgtttggtgggtttagcaaagcaggatttgttgccatttggttttttaaacctgggtttgctttctcctaggggttggttgttcggtgatacctgttctaggtttaaagcttttgaggcattgtgctgctgaggatttggcatcatataatcagtcctatgctgtatttttcttgcattaact

SEQ ID NO: 3868 - DNA, 2429 bp, Theobroma cacao
atctgattcggatacggaagcctggaagggggaagattcaggtccgtttaaaaacgaactgagtggcgatatcaccgtacacgtgtcaccttctccttccctcttccttataaatacttagaacctccccctttcccaaaacccttcgtctcagaaccctatttttcggagttcacccaattgtttctctccagcggcacactgtagcacctaaactctgtacctctaaaccctagatccaccttcaccttctgcgatcttccctcaggattgaagatggtgtcggacgcgagcaagaagaaggcagcgcagaagaaggcagctgccgctgcgaagagaggagggaaggcagctgcagctgctgcatcttccaaggcggcggctgctgcggcggcgtccgataccggggtggataaggtttccgatggagttagtgcgctccagatatccgatcggacttgtaccggcgttctctgctcgcatcctctttcgagagatattcgtatagagtccttatcggttactttccacggacatgatcttattgttgattcaatattggagcttaattatggcagacggtatgggttgcttggattaaatggttgtggcaaatccacactgcttactgcaataggattgcgtgaacttccaattccagagcacatggatatctatcatctgaccagggagattgaagcttctgacatgtctgcattggaggctgtcataagttgtgatgaggagaggttgaaattggagaaagaagcagaaaccttggccggacaggatgatggtggtggagagcaacttgaacgtatctatgagcgattggaagccatggatgcatcaactgctgagaaacgtgctgctgaaattttatttggtcttggtttcaacaagaagatgcaagcaaagaaaacccgagatttctctggtggctggagaatgaggattgctttagcacgggctctattcatgaatcccacaattctgttgcttgatgagcctaccaatcatttagatttagaagcttgtgtctggttggaagaaaatttgaagaaatttgatcgtatcctcgttgtggtatcacattcccaggatttcctgaatggagtctgtacaaatattatccacatgcagaacaaaaaacttaagctgtacactggcaactatgatcagtatgttcaaacccgtgctgaattggaagagaaccagatgaaacagtacaagtgggagcaggaacagattgcttcgatgaaggagtacattgctcgcttcggtcatgggtcagccaaactagcccgacaggctcagagtaaagaaaagacattggcaaagatggagcggggtggactcacagagaaggtagtgagagacaaggttctggtcttccgatttgttgatgttggaaaacttcctccaccagtactgcagtttgtggaagttacatttggatatacacctgataatctcatttacaaggacctggactttggagtagacttagactctaggatagcactagtgggacctaatggtgcagggaagagtacactgctgaagctgatgacaggggacttaggtcctattgatggtatggtccgacggcataatcatctgcgaattgcacaattccatcagcacttggctgagaaacttgacttggaaatgtctgccctccagtatatgataaaagagtaccctggaaatgaggaagagaggatgagagctgcaattgggaagtttggattgtcagggaaagcacaagtgatgcctatgaggaatctgtctgatggacaaaggagtcgggtcatctttgcctggttagcatttagacaaccccacttactgctgctggatgagcccactaaccacttggatattgagacaatagattcactggctgaggcattgaatgagtgggatggtggcttggtacttgtcagccatgatttcaggcttataaaccaggtagcggaggagatctgggtgtgtgaaaatcaaaccgtaacacggtgggagggtgacattatggacttcaaggagcatctcaagagtaaagctggtttgtctgattgaagcaagcattaattattataacttccaacttatggttaccaaacccaggatgagtctcctcctgtggtggattaagatgataagtatctatagaacagaggataacgagagctttgttattgtttgaagctatcgggtttccatatcctctgttggggttagtaggtggtatttgttgtcattgcttttaaaccttggtttgttcaccgaggccttacttagcgatatttctttaactctaagatgtgaggcttcgcgccagtgagttgttgcatcatatattcaatcctatgttgtacttgagttatcctgaattcgaatatattggttttttatctgttttttta

SEQ ID NO: 3869 - DNA, 2335 bp, Ricinus communis
aaccctctttcaatagaaccctaaaaatcgggttttattattaagctgaaaaaaaaccccgaatccacatcgaacccacgaaaccctagatccacacacactcttcagatcaagatggtgtccgacgcgagcaagaagaaggcagcgcaaaagaaggcggcggcggcagcgaagagaggcgggaaggcatctgcgtcttctaaagctgctgctgctgcgacggcggcggctgataatggaagtgtagacaagttatcgaatggaataggggctatgcagatttcagatcgaacttgtaccggtgttttatgctcacatcctctctctagagatattcgtattgagtctttatcagtgacttttcatggacatgatctcattgttgattctgtgcttgagctcaactatggcagacgatatggattacttggtttaaatggatgcggaaagtcaacactgttaactgcaattggttgccgtgagcttccaattccagaccacatggatatttatcacctcaccagagaaattgaagcttctgacatgtcttcacttcaggctgttattagctgtgatgaggagaggttgaaattggagaaggaagttgagattttggcagctcaggatgatggaggtggagagtctcttgaacgtatttatgagcgtttggaagctatagatgcatccactgcagaaaaacgtgctgctgagatcttgtttggtcttggttttagcaagcagatgcaggcaaaaaaaactcgtgatttttctggtggatggaggatgaggattgcattagctagggctctgttcatgaaccctactatcctcttgcttgatgaacctaccaatcatcttgatttggaagcctgtgtctggttggaggaaactctgaagaaatttgaacgcattttagtggtggtgtcgcattctcaggattttttgaatggtgtctgcacgaatattatacacatgcaaaacaagacattgaagatctacactggaaattatgatcaatatgttcagactcgttctgaactggaggaaaatcagatgaaacaatacaagtgggagcaggagcagattgcttcaatgaaggagtacattgccagatttggacatggttcagcaaagttggctcgtcaagcacagagcaaggagaaaacccttgcaaagatggagcggggtgggcttacggagaaggtagttagagacaaggtgctagtcttccgttttgttgatgttggaaagctcccaccaccagtgcttcagtttgtggaagttgcatttggctacactcctgagaatatcctctacagaaaccttgattttggggtagatttggactctaggattgctttggtggggcccaatggtgctggaaagagcacactgctgaagctcatgacaggggatttggttcctgttgatggcatggttcggcgacacaatcatttgaggattgctcagtttcatcagcacttggctgagaaacttgacttagacatgtctgccctacattttatgatcagagagtatccagggaatgaggaagaaaagatgagagcagcaattgggaagtttggcttaaccggcaaagcccaggtgatgcccatgaagaatttgtccgacggtcagaggagccgggtcatttttgcttggttggcttataggcagccccacatgctgctgttggatgaaccaacgaaccatttagatattgagacaatcgactcgctggctgaggcattgaatgaatgggatgggggtttggttctagttagccatgatttcaggcttataaatcaggtagcagaagagatatgggtgtgtgaaaatcaagctgtaacccgatgggaaggcgacatcatggacttcaaggaacacctcaagagaaaggctggattatctgattaaatcagatgagaggatggatgcaaagattattattattttacgatcatcgtgctgcctttgcctatggttgtgaattatagtactctctctgagtcagaacataaggcaggcgacagcgtcatccatatgatgttagcctggggagaattaagaaaaagacgaaagagagcagagatggggtaacagaaagaaaggcttggttattgtttcagctgaatggtaccctgccaggtattaggtaatatttttgtcttgttttttctttattatttatgtttacgcattcttatcattattatatacaatgatttgatacgaacatctaatctgtgtgctttgttatattcgagtatatgttgtactttgagaactcgaaaaaggggcaggcctaaattcttatgtattacatttggttcta

SEQ ID NO: 3870 - DNA, 2545 bp, Cucumis melo
gagggttataaaagcaagtcccagcctcctgaatcacagaacctcgaacccttgatccgcatcgcattacgaattacgcgtcgcgggtctaaagagcacaacaaaagcgccgtgagagacgaagagcgatctcttcaagccctagatctgcttcctcttctcactcgctctgtcggtcttgcttctccttcgatcttctttctccatctaaggttaagtatggtttccgacgcgagtaagaagaaagcggctcagaagaaggcggctgcggcagccaagcgtggaggaaaagcagcggcggcggctgcttcttccaaggcggcagcggcggcggctgaatcacagaatggagttgataagttggccaatggagttgacgctcttcagttatctgatcggacttgtactggtgtgctttgttcacatcctctctccagggatatccgaatagaatctttatcagttacctttcatgggcatgatcttattgttgattctgagctggagctcaattatggcagacgttatggtttgcttggattgaatggatgtggtaaatctacacttcttgcggcaataggttgtcgagagcttcctattccagaacacatggatatatatcatctttcacgagagattgaagcttctgacatgtcttcacttgaggctgttataagttgtgacgaggagaggttgaagttggagcaggaggcagaatccttggctgcacaagatgatggaggtggggagcagcttgatcgtatctatgagcgtttggaagcattggatgcagccactgcagaaaaacgtgctgctgaaatcctttatggtcttgggtttaacaagcagatgcaagcgaagaaaactcgagacttttctggtggttggaggatgaggattgccttagctcgtgccttattcatgaatcccactgtgctcctactggatgaaccaactaatcatctagatctagaggcttgtgtctggctggaagaaaatttgaagaagtttgaccggatcctggttgtggtttcgcattcccaggactttcttaatggtgtctgcacaaacattattcacatgcagaacagaaagttaaagatctataccggtaactatgatcagtatgttcagacccgttctgaactggaagagaatcagatgaaaatgtataagtgggaacaggatcagattgcttccatgaaagagtatattgcaagatttgggcacgggtcggcaaaattagctcgtcaggcgcaaagtaaggagaaaacgctggcaaaaatggagaggggtgggcttactgaaaaggtggtgagagacaaggttcttgtgttccgctttgttgatgttgggaagcttcccccaccggttctccagtttgtggaagtaacgtttggctatacccctgacaatctcatctacaagaatcttgactttggagttgatttggattctcggatagctttggttggacccaatggtgctggaaagagtaccctgttgaagctgatgacaggggacctggttcctctagatggcatggtccgacgacacaaccacctcagaattgcccagtttcatcaacatttagccgagaaactggacttggaagtgtctgctctccagtttatgatacgagagtacccaggaaatgaagaagagaagatgagaggagcaattgggaagtttgggctctccggcaaagctcaagtgatgccaatgaagaatttgtctgatgggcagaggagccgtgttatatttgcctggttagcatggagacaaccccacctattattgcttgatgaacccacaaatcatttggatatcgagaccatcgattcattggctgaggcactgaatgaatgggatggaggtatggttcttgtaagtcacgattttaggcttataaaccaagtggccgaggagatatgggtgtgcgagaatcaagctgtaaccaaatgggagggtgacattatggacttcaaggcacatttgaagatgaaggctggattagctgattaaagctgtaaaatcgtgagtttaccttattaaaatctctataccatagaccgtggcttaattgtgtctcatcatatttcgccgcagctcggccagcatgtgtgcttgatgtgccgacacaacaagccaaaggtcttgaacactgatgatggatggggcttggttattgtttcgagccaggaattttaatgggcgtagtaggtaattaatgtttttgtttaatcattcaatgttaccccctatatctttcagttggtttttgaaccaactagatagagctatatgatgtctaattatttatgtttagacagacagcatgcgactacaaacagacagagtcttatatttttggttttgatttcttattttgtccaatttgattcacccgagcttacctaagtaatgtagcaaagcgagcttgtaatcaataatattttgagatttttgccatatgtgggtcggaattttggtgtgccatgaaagctctattgtttttaccatctcttggatggaaagaaacgac

SEQ ID NO: 3871 - DNA, 1904 bp, Cucumis sativus
tatggtttccgacgcgagtaagaagaaagcggctcagaagaaggcggctgcggcagccaagcgaggaggaaaggcagcggcggcggctgcttcttccaaggcggcagcggcagcggctgaatcacaaaatggagttgataagttggccaatggagttgacgctcttcagttatccgatcggacttgtactggtgtgctttgttcacatcctctatccagggatatccgaatagaatctttatcagttacctttcatgggcatgatcttattgttgattctgagctggagctcaattatggcagacgttatggtttgcttggattgaatggatgtggtaaatctacacttcttgcggcaataggttgtcgtgagcttcctattccagaacacatggatatatatcacctttctcgagagattgaagcttctgacatgtcttcacttgaggctgttataagttgtgatgaggagaggttgaagttggagcaggaggcagaatccttggctgcacaagatgatggaggtggggagcaacttgatcgtatctatgaacgtttagaggcattggatgcagccactgcagaaaaacgggctgctgaaatcctgtatggtcttgggtttaacaagcagatgcaagcgaagaaaactcgagacttttctggtggttggaggatgaggattgccttagctcgtgccttattcatgaatcctactgtcctcctactggatgaaccaactaatcatttagatctagaggcttgtgtctggctggaagaaaatttaaagaaatttgaccggatcctggttgtggtttcgcattcccaggactttcttaacggtgtctgcacaaacattattcacatgcagaacagaaagttaaagatctatacaggtaactatgatcagtatgttcagacccgttctgaactggaagagaatcagatgaaaatgtataagtgggaacaggaccagattgcttccatgaaagagtatattgctagatttggtcacgggtcagcgaaattagctcggcaggcgcaaagtaaggagaaaacactggcaaaaatggagaggggtggccttactgaaaaggtggtgagagacaaggttcttgtcttccgctttgttgatgttgggaagcttcccccaccggttctccagtttgtggaagtaacgtttggctatacccctgacaatctaatctacaggaatcttgactttggagttgatttggactctcgggtagctttggttggacccaatggtgctggaaagagtaccctgttgaagctgatgacaggggacctggttcctctagatggcatggtccgaagacacaaccacctcaggattgcccagtttcatcaacatttagccgagaaactagacttggaagtgtctgctctccagtttatgatacgagagtacccaggaaatgaagaagagaagatgagaggagcaattgggaagtttgggctctccggcaaagctcaagtgatgccaatgaagaatttgtctgatgggcagaggagccgtgttatattcgcctggttggcatggagacaaccccacctgttattgcttgatgaacccacaaatcatttggatattgagactattgattcactggcagaggcactgaatgaatgggatggaggtttggttcttgtaagtcacgattttaggcttataaaccaagtggccgaggagatatgggtgtgcgagaatcaagctgtaaccaaatgggagggtgacattatggacttcaaggcacacttgaagatgaaggctggattagctgattaaagctgtaaaatcgtggagtttaccttattaaaatctctataccatagaccgtggcttatgggccagcatgtgtgcttgatgtgcctgacacaacaag

SEQ ID NO: 3872 - DNA, 2174 bp, Glycine max
cttgctcgggattttactttactctctcacggtagcaccagacacacaactctagatctattgtttttcgattcaagatatttgagattgaagatggtgtctgacgccagcaagaagaaggctgcgcagaagaaggcggccgcagcggccaagagaggaggcaaagcagcagctgctgctgcttcgtccaaaacgacgtcgtcggagaagcttgccgacggaattagggacattcagatttccgatcgaacctgcaccggtgtcctctgctcgcatcctctttccagggatattaggatagaatctatgtcagttactttccatggacatgatttgatagttgattccgaattggagctaaattacggaagacgttatggcttgcttggattaaatggttgtgggaagtctaccctgcttacggcaataggttgtcgagagctacctattccagaccacatggatatttatcaccttaccagagaaattgaagcctctgacatgtctgcattggaggctgtcataagctgtgatgaggaaaggttgagtttggagaaagaagctgaagctttggcagcgcaggatgatgggggtggggaagctcttgaacgtatttatgaacgattggaagccattgatgcatcaactgcagaaaagcgtgccgctgaaaatttatttggtcttggtttcaacaagcagatgcaagcaaagaagacacgtgatttttctggtggctggagaatgaggattgctttagcacgtgctctatttatgaaccctaccattcttttacttgatgaaccaaccaatcaccttgacttggaagcttgtgtgtggctggaagagaatctgaagaagtttgaccgtattctggttgtggtttcacactcccaggatttccttaatggtgtctgcacaaatatcattcacatgcaaaacaagaagctgaagctctacactggtaattatgatcaatatgttcagacacgttctgaactggaagagaaccagatgaagcagtacaaatgggagcaggagcaaattgcctcgatgaaggaatacattgctcgatttggtcatggatcagcaaaactagctcgccaagctcagagtaaagagaaaactcttgcaaaaatggagcggggtggacttgcagagaaggtggtaagagacaaagttttggtattccgctttgttgatgtgggaaaacttcccccgcctgtcctccagtttgttgaggtgacatttgggtacacgccagataatctgatctacaagaagcttgactttggtgttgatttagactctaggattgctctggttggacccaacggagctgggaagagtacgttactgaagctaatgactggtgatttggaacctctagatggcatggttcgacgccacaatcaccttcggatcgcacaatttcaccagcacttggctgaaaagctagacttggaaatttctgccctccagtttatgataaaagaataccctggaaacgaggaggagaggatgagagcagccattgggaaatttggactatccggtaaagcgcaggtgatgcctatgaagaatttatctgatgggcagaggagccgcgtgatattcgcatggttagcttatagacagcctcacctgctacttttggatgagccaacgaatcatttggatattgaaacaattgactcattggccgaggcattgaatgaatgggatggtggcatggtgcttgttagccatgattttaggctcataaatcaggtggcccatgagatatgggtgtgtgctgatcaagctgtgaccagatgggaaggtgacattatggatttcaaggagcacctaaggtcaaaggcgggtttatctgactgaagaaaatagtgggacagggacactccagcatatgcatgtcatcaccatctaaggactacgttacgtactgtaagttaggtggatttctccatggcgattgtagtttttatttaaatggctctgcagagaaatcggtgtagaaatcatgtccttccccgttagattgtagtaatttgtattttcatcatttagttgcttggttgctgaccagcatgatagatagcaggggaccttatgtaatgtgaatgatatgtacctaccgagagttttatattgactgcactagtttcctctgcctc

SEQ ID NO: 3873 - DNA, 2081 bp, Glycine max
atggtgtctgacgccagcaagaagaaggctgcgcagaagaaggcggccgcagcggccaagagaggaggcaaagcagcagctgctgctgcttcgtccaaaacgacgtcgtcggagaagcttgccgacggaattagggacattcagatttccgatcgaacctgcaccggtgtcctctgctcgcatcctctttccagggatattaggatagaatctatgtcagttactttccatggacatgatttgatagttgattccgaattggagctaaattacggaagacgttatggcttgcttggattaaatggttgtgggaagtctaccctgcttacggcaataggttgtcgagagctacctattccagaccacatggatatttatcaccttaccagagaaattgaagcctctgacatgtctgcattggaggctgtcataagctgtgatgaggaaaggttgagtttggagaaagaagctgaagctttggcagcgcaggatgatgggggtggggaagctcttgaacgtatttatgaacgattggaagccattgatgcatcaactgcagaaaagcgtgccgctgaaaatttatttggtcttggtttcaacaagcagatgcaagcaaagaagacacgtgatttttctggtggctggagaatgaggattgctttagcacgtgctctatttatgaaccctaccattcttttacttgatgaaccaaccaatcaccttgacttggaagcttgtgtgtggctggaagagaatctgaagaagtttgaccgtattctggttgtggtttcacactcccaggatttccttaatggtgtctgcacaaatatcattcacatgcaaaacaagaagctgaagctctacactggtaattatgatcaatatgttcagacacgttctgaactggaagagaaccagatgaagcagtacaaatgggagcaggagcaaattgcctcgatgaaggaatacattgctcgatttggtcatggatcagcaaaactagctcgccaagctcagagtaaagagaaaactcttgcaaaaatggagcggggtggacttgcagagaaggtggtaagagacaaagttttggtattccgctttgttgatgtgggaaaacttcccccgcctgtcctccagtttgttgaggtgacatttgggtacacgccagataatctgatctacaagaagcttgactttggtgttgatttagactctaggattgctctggttggacccaacggagctgggaagagtacgttactgaagctaatgactggtgatttggaacctctagatggcatggttcgacgccacaatcaccttcggatcgcacaatttcaccagcacttggctgaaaagctagacttggaaatttctgccctccagtttatgataaaagaataccctggaaacgaggaggagaggatgagagcagccattgggaaatttggactatccggtaaagcgcaggtgatgcctatgaagaatttatctgatgggcagaggagccgcgtgatattcgcatggttagcttatagacagcctcacctgctacttttggatgagccaacgaatcatttggatattgaaacaattgactcattggccgaggcattgaatgaatgggatggtggcatggtgcttgttagccatgattttaggctcataaatcaggtggcccatgagatatgggtgtgtgctgatcaagctgtgaccagatgggaaggtgacattatggatttcaaggagcacctaaggtcaaaggcgggtttatctgactgaagaaaatagtgggacagggacactccagcatatgcatgtcatcaccatctaaggactacgttacgtactgtaagttaggtggatttctccatggcgattgtagtttttatttaaatggctctgcagagaaatcggtgtagaaatcatgtccttccccgttagattgtagtaatttgtattttcatcatttagttgcttggttgctgaccagcatgatagatagcaggggaccttatgtaatgtgaatgatatgtacctaccgagagttttatattgactgcactagtttcctctgcctc

SEQ ID NO: 3874 - DNA, 2209 bp, Glycine max
cacgtggtccgtggaagccgacacttctatatattcgaaacctcaccttcttcccactccaaccgaagcctgaagaaccctaagccctctcttgctcgggattttactctcacgagattagagattgaagatggtgtctgacgcgagcaagaagaaggctgcgcagaagaaggcggcggcagcggccaagagaggaggcaaagcagcagctgcttcgtcgaaaacgacgtcgtcggagaaggccgccgacaagcttgccaacggaattggggaaattcagatatccgatcgaacctgcaccggtgtcctctgctcgcatcctctttccagggatattaggatagaatctctgtcagttacttttcatggacatgatttgatagttgattccgaattggagctaaattatggaagacgttatggcttgcttggattaaatggttgtgggaagtctaccctgcttacggctataggttgtcgagagctacctattccagaccacatggatatttatcaccttaccagggaaattgaagcctctgacatgtctgcattggaggctgtcataagctgtgatgaggaaaggttgagattggagaaagaagctgaagctttggcagcgcaggatgatgggggtggggaagctcttgaacgtatttatgaacgattggaagccattgatgcatcaactgcagaaaagcgtgctgctgaaattttatttggtcttggtttcaacaagcagatgcaagcaaagaagacacgcgatttctctggtggttggagaatgaggattgctttagcacgtgctctatttatgaaccctaccatccttttacttgatgaaccaaccaatcaccttgatttggaagcttgtgtgtggctcgaagagaatctgaagaagtttgaacgtattctggttgtggtttcacactcacaggatttccttaatggtgtctgcacaaatatcatccacatgcaaaacaagaagctgaaactcttcactggtaattatgatcaatatgttcagacacgtgctgaactggaagagaaccagatgaagcagtacaaatgggagcaggagcaaattgcctcgatgaaggaatacattgcccgatttggtcatggatcagcaaaactagcccgccaagctcagagtaaagagaaaactcttgcaaaaatggagcggggtggacttgcagagaaggtggtaagagacaaagttttggtattccgctttgttgatgtgggaaaacttcccccgcctgtcctccagtttgttgaggtgacatttgggtacactcctgataatctgatctacaagaaccttgactttggggttgatttagactctaggattgctctggttggacccaatggagctgggaagagtacgttactgaagctaatgactggtgatttggaacctctagatggcatggttcgacgccacaatcaccttcggattgcacaatatcaccagcacttggctgagaagctagacttggaaatgtctgccctccagtatatgataaaagaataccctggaaacgaggaggagaggatgagagcagccattgggaaatttggactgtctggcaaagcgcaggtcatgcctatgaagaatttatccgatgggcagaggagccgtgtgatattcgcatggttagcttatagacagcctcacctgctacttttggatgagccaacgaaccatttggatatagaaacaattgactcattggctgaggcattgaatgaatgggatggtggcatggtgcttgttagccatgattttaggctcataaatcaggttgcccatgagatatgggtgtgtgctgatcaagctgtgaccagatgggaaggtgacattatggatttcaaggagcacctaaggtcaaaggcgggtttatctgactgaagaagatagtgggactgggacactccagcatatcaccatctaaggactacgttacgtactgctgcttgagttggatttctccatggtgattttttttatttaaatggctctgcagagtaatcgctttggaaatcatgtcctcccccgttagattgcagtaatttgtatttttatcctttagttgccgatcagcatgataaataacaggggaccttagatgtaatacctatctgtatgtgaatgatatgttgtacctagagtattatatttactgcactagtttcctctgcc

SEQ ID NO: 3875 - DNA, 2364 bp, Castanea mollissima
tagctctcccttctcttttatatataacctaataaacaccaccaacaaaatcctctttacctccactttttggcttctatttcatccaaaaccctagatctcatattcctcccaccacccacccccctcttctcgctcttcgcctcctcctcctccgatctccgcaacaaaggttgaagatggtgtcggacgcgagcaagaagaaggcggcgcagaagaaggcggcggcggcggccaagagaggaggaaaggcagccgcgacttcgtcgaaatcggcggcggcggcggcggattctcagaacggagcggagaagttggcgaatggggtcgaggcgcttctgatttcggatcggacttgcactggtgtgctctgctcgcatcctctctcccgagatatccgcatagagtctttgtctgttacttttcatggacatgatctaatagtggattctgagctggagcttaactatggcagacgttatggtttgcttgggttaaatgggtgtggaaaatctacacttcttactgcaataggatgtcgagagcttccaattcctgagcacatggatatttatcatctctcgagggagattgaagcttctgacttatcttcacttgaggctgtcatggaatgtgatgaggagaggttgaaattggaaagagaagctgaaactttggctgcacaggatgatgggggtggtgaagctcttgaacgcatttacgaacgtctagaagccatggacgcagcaactgcagagaaacgtgcagctgaaatcttgtttggtctgggattcaataagcagatgcaggcaaagaaaactcgcgatttttcaggaggatggagaatgaggattgctttagcacgggctctctttatgaatccaaccatcctgttgcttgatgaacctaccaatcatcttgatctagaggcttgtgtctggttggaggaaactttgaagaagtttgatcgcatcctggttgtggtatcacactcccaggacttcctgaacggtgtctgcacaaacattatccacatgcaaaacaaggcattgaagatttacactggtaactatgatcaatatgttcagacccgttctgaactggaagagaaccagatgaaacagtacaagtgggagcaggagcagatcgcgtcaatgaaggaatatattgctcgatttgggcacggatcagcaaaactagctcgacaagcacagagcaaagagaaaacattggcaaaaatggagcgaggtggacttactgagaaggttgcaagagacaaggtattggtcttccgctttgttgatgtcgggaagcttcctcctcctgtacttcaatttgtggaagtagcattcggttatacacctgataatctcatctacaagaaccttgactttggggtagatttggactcaagggtagctctggttggtcccaatggagctggtaagagtacactgctgaagctgatgacaggtgacgtggttcccactgatggcatggttcggcggcataatcaccttagaattgcacagttccatcaacatttggctgagaaacttgacttggagttgtctgcccttcagtatatgattagagagtacccaggaaatgaggaagagaaaatgagggcagcaattgggaaatttggactgactggtaaagcccaggtgatgcctatgaagaatttatcagatgggcaaaggagccgggtgatctttgcgtggttggcgtacagacaacctcagatgctgctgctggatgagccaactaaccacttggatattgagaccattgactcactggctgaggcattgaatgagtgggatgggggtttggttcttgttagccatgatttcaggcttattaaccaggttgcccatgagatatgggtgtgtgagaatcaagctgttacccggtgggagggtgatattatggacttcaaggcgcatctcaagcgaagggctggtttatctgattgaagcctttagggggggtggatccatcatttgagagtattattagtaaaccctagcttttacttaatattacggtttaagacagggattagcgcatctgagtgagttcttctcagtgtggcttttgctgaaagccaacgagcagaatgggtcatgaaggcttcgttattctgattattgtttcatgctgacaggttccatgaccccttgctcgtctaggtgatatttttgtatttcgtcatttatctttgtgcttctattattacttggttgttgaccaaatattttaacaatatttatttgtgatggtcataacgcatatttgaaccatcttgtacctgtggtttcctcgaggatgatatgtactggagagcgtatttgctatatt

SEQ ID NO: 3876 - DNA, 2529 bp, Quercus alba
atggggaggtgttgtgtttttatagagagagttgttgttgtggtgtcggtacttttttttatacaagtctttcaaaaagagacacccctcaagttctgagccacgtggaagtatcgcactcttatatatatacatcaatatcatcattccttaaccccatacccttctctcttccttatataacctaataaacaccaccaccaacaaatctctttacctccacttttggcttctatttcatccaaaccctagatctcaattccgagcccccctctctctctcgctcttcgcctcctccgatctccgccacaaaaggttgaagatggtgtcggacgcgagcaagaagaaggcggcgcagaagaaggcggcggcggcggccaagagaggaggaaaggcagccgcgacttcgtcgaaatcggctgcggcggcgtcggattcgcagaacggagcggagaagttggcgaacggggttgaggcgcttctgatttcggatcggacttgcactggtgtgctctgctcgcatcctctctcccgagatatccgcatagagtctttatctgttacttttcatggacatgatctaatagttgattctgagctggagcttaactatggcagacgttatggtttgcttgggttaaatgggtgtggaaaatctacacttcttactgcaataggacgtcgagagcttccaattcctgaccacatggatatttatcatctctcgagggagattgaagcttctgacttgtcttcacttgaggctgtcatggaatgtgatgaggagaggttgaaattggaaagagaagctgaagctttggctgcacaggatgatgggggtggtgaagctcttgaacgcatttatgaacgtctagaagccatggatgcagcaaccgcagagaaacgtgcagctgaaatcttgtttggtcttggattcgataagcagatgcaggcaaagaaaactcgggatttttcaggaggatggagaatgaggattgctttagcgcgggctctctttatgaatccaaccatcctgttgcttgatgaacctaccaatcatcttgatctagaggcttgtgtctggttggaggaaactttgaagaagtttgatcgcatcctggttgtggtatcacactcccaggacttcctgaacggtgtctgcacaaacattatccacatgcaaaacaaggcattgaagatttacactggtaactatgatcaatatgttcagacccgttctgaactggaagagaaccagatgaaacagtacaagtgggagcaggagcagatcgcgtcaatgaaggaatatattgctcgatttgggcatgggtcagcaaaactagctcgacaagcacagagcaaagagaaaacattggcaaaaatggagcgaggtggacttactgagaaggttgcgagagacaaggtattggtcttccgctttgttgatgttgggaagcttcctcctcctgtgcttcaatttgtggaagtagcatttggttatacacctgataatctcatctacaagaacctcgactttggggtagatttggactcaagggtagctctggttggtcccaatggagctggtaagagtacactgctgaagctgatgacaggtgacgtggttcctactgatggcatggttcggcggcataatcaccttagaattgcacagttccatcaacatttggctgagaaacttgacttggaggtgtctgcccttcagtacatgattagagagtacccaggaaatgaggaagagaaaatgagggcagcaattgggaaatttggactgactggtaaagcccaggtgatgcctatgaagaatttatcagatgggcaaaggagccgggtgatctttgcatggttggcgtacaggcaacctcagttgctgctgctggatgagccaactaaccacttggatattgagaccattgactccctggctgaggcattgaatgagtgggatgggggtttagttcttgttagccatgatttcaggcttattaaccaggttgcccatgagatatgggtgtgtgagaatcaagctgttacccggtgggagggtgatattatggacttcaaggcgcatctcaagcaaagggctggtttatctgattgaagcctttaggggggtggatccatcacttgagagagtattattagtaaaccctagcttttacataatattacggtttaagacagggattagcgcatctgattgagttcttctcagagtggcttttgctgaaagccaacgagcagaatgggtcatgaaggcttcgttattctgattattgtttcatgctaacaggttccatgaccccttgctcggctaggtgatatttttgtatttcgtcatttatctttgtgcttctatttttacttggttgttgacccaagtattttaacaatatttatttgtgatggtcataacgcatatttgaaccatcttgtacctgtggtttcctcgagaatgatatgtactggagagcgtatttgctatattattttagccctatattccta

SEQ ID NO: 3877 - DNA, 2348 bp, Populus trichocarpa
aacccatctttacgggttctatcacaccaccgatacaaccatccgtcaagctacatcaaaccctagatacctccatctcccctcctcctatctctctaattgtttaatataaagatggtttcggaagccagcaagaagaaggctgctcaaaagaaggcggccgcggcggctaagcgaggtggcaaagcagcagcaacctcctcaaaaagggcagcggcgacggcggcgtctgattcgcagaatgaaggtgttgataagttgtcgaatggagctggagtccttcagatatccgatcggacttgtacaggcgtcctctgttcccatcctctttccagagatattcgaatcgagtcgttgtcagttacttttcatggacatgatctcattgtagattctgagctggagcttaactatggcagacgatacggactacttggtttaaatggatgtgggaaatcaaccctcctagctgccatagggtgtcgggaacttccaattccagaccacatggacatatatcacctcaccagggagatcgaagcctctgacatgtcttcacttgaggctgtgataagctgtgatgaggagaggttgaaattggagaaggaagccgaagtcttggcagcagaggatgatggaggtggagaagctcttgatcgtatttatgagcgtttggaggccatggatgcatcaactgctgggaaacgtgctgctgaaattttgtatggtcttgggtttaacaagaaaatgcaagaaaagaaaactcgagatttttctggtggctggagaatgagaattgcactagctcgggctttgttcatgaacccaactatcctcttgcttgatgagccaaccaatcatcttgatctagaagcctgtgtctggttggaggaaactttgaagaagtttgaccgcattctagttgtggtctcacattcccaggatttcttgaatggtgtctgcacaaacattatccatatgcaaaacaagaaattgaaaatctacactggtaacttcgatcagtatgttcagacccgttctgaactggaagaaaatcagatgaaacaatacaagtgggagcaggatcaaattgcttccatgaaggagtatattgcccgatttgggcatgggtcagcaaaattagctcgccaggcacagagcaaggagaaaactcttgcaaaaatggagcggggtggacttacagaaaaggttgcgagagacaagattctggtctttcgctttgtcaatgttggaaagctcccaccaccagtgcttcagtttgtggaagtaacctttggctacacacctgataatctcatctataagagtattgacttcggtgttgatctggactctaggattgcgctggttgggccaaatggtgctgggaagagtaccctactgaagcttatgacgggtgatttggttcctttagatggtatggttcggcggcacaatcacttgaggattgcacaatttcaccagcacttggctgagaagcttgacttggaaatgtctgccctccagtatatgattaaagagtatccagggaatgaggaggaaagaatgagggcagctattgggaagtttgggttgacaggcaaggcccaggtgatgcccatgaagaacttgtcagatgggcagaggagcagggtgatatttgcttggctggcgtataggcagccccacttgctactgctggatgagccaacaaaccatttggatattgagacgattgactctctggctgaggcattgaatgagtgggatgggggtcttgttcttgttagccatgatttcaggctcataaatcaggtagcagaggagatttgggtatgcgaaaatcaagctgttacccggtgggagggtgacattatggacttcaagaagcacctcaagatgaaggccggtttgtctgattaaagctagaacacaggatgtatttggagatcttatcgtattatccgcgtgctttggcctatggtttgtctatcactttctgtcccaacagctgcatattcgcaatgttgggttttctggatgacgacacatcccaggcagaatcgtgatgaatgcttgtagaggaggactggttaggtgacaagacttggttattgatttgagccaatgatcatcttatcctctgtgctcattaccagggagtatatttgttttccttgattacgattggcgccccgccctagtagacttggttgtttaccaagaagatacttatataggttagaggtgatgccaatgtgatcctgatccccttgtccgtgcctttgttatatgtgtatgtacttgaggaattgcttattatatggtaccttgtttcttgagttact

SEQ ID NO: 3878 - DNA, 2183 bp, Glycine max
acatctaactaccctccttcaaaactcatctcgaaaccctaagcactcgctcgggttcgtgtagtgccaaaccctagggctcattttccagatctattcagtttttctctcctctcttttccgatccaccgttggagatcgaagatggtgtccgacgccagcaagaagaaggccgcacagaagaaggccgccgccgccgccaagagaggtggcaaagctgccgccgctgccgttatggccgccacctcttccaaagccgccgacaaggtcgccaacggaatcgccgatattcagatttcggatcggacctgcaccggcgtcctctgttcgcatcctctctccagagatattcgaatagagtctctatccgtcacattccatggacatgatctcattgttgattctgaattggagctgaattatggaaggcgttatggcttactcggattaaatggttgtggaaaatctacactgcttacagccatcggttgtcgggaacttccaattcccgaccacatggacatatatcatctaaccagggagattgatgcctctgatatgtctgcattggaagctgtcataagctgtgacgaagaaagattgaaattggagaaagaagcagaagctttagctgcacaggatgatggaggtggtgaatcccttgaacgcatttatgaacgattggatgccctagatgcagccactgcagaaaagcgtgctgctgaaatcttacatggtcttggctttgacaagcaaatgcaggcaaagaagacacgtgatttttccggtggctggagaatgaggattgcattagcgcgagctctatttatgaacccaaccattcttctacttgatgaaccaaccaatcaccttgatttggaagcttgtgtgtggctggaggagagtttgaagaagtttgaacgtattctggttgtgatttcacactctcaggactttcttaatggtgtctgcacaaatattatccacatgcaaagcaaaaaactgaagctctacactggtaattatgatcaatatgttcagacacgttctgagctagaagagaaccagatgaaacagtacaagtgggagcaggagcagattgcctcaatgaaggaatacattgcccgatttggccatggttcggctaaactagctcgccaggcacagagtaaggagaaaacactggcaaaaatggaacgtggtggacttgcagagaaggtggtcagagacaaagttttggtatttcgttttactgatgttgggaaacttccccctccagttctccagtttgttgaggtgtcatttggttatactcctgataatctcatctacaagaacattgactttggggttgatttagattctcgggttgcgctggttgggcccaatggtgctgggaagagtacactactgaagctaatgacaggtgacttgatgcctagtgatggcatggtccgacgtcataatcatcttcgaattgcacaatatcaccagcatttggccgaaaagctagacatggaaatgtctgctctccagtttatgattaaagaataccctggaaacgaggaagagaagatgagggcggcgattgggaagtttgggctgtcaggtaaagcgcaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggacggtggcttggtgcttgtcagccatgattttaggctcataaatcaggtggcgcatgagatatgggtatgtgctaatcaatctgtgaccagatgggagggtgacattatggaattcaaggcgcatctaaagtcgaaggcgggtttatctgactgaaacaatacgagtgtggatgctgccggtgtgtagtagtattacattaaaaggttatgatttttgttcgagcagagatccgtaataattttttttagttactatttcttgtgcttatcatttatttgcctggttgttaacaagcgtggatgaatgggatttcaccttgaggaaacgaagcttattctacaaatgaactatttcaaccgagaatattattatttgtggtattataattacgttaattcctctct

SEQ ID NO: 3879 - DNA, 2182 bp, Glycine max
acatctaactaccctccttcaaaactcatctcgaaaccctaagcactcgctcgggttcgtgtagtgccaaaccctagggctcattttccagatctattcagtttttctctcctctcttttccgatccaccgttggagatcgaagatggtgtccgacgccagcaagaagaaggccgcacagaagaaggccgccgccgccgccaagagaggtggcaaagctgccgccgctgccgttatggccgccacctcttccaaagccgccgacaaggtcgccaacggaatcgccgatattcagatttcggatcggacctgcaccggcgtcctctgttcgcatcctctctccagagatattcgaatagagtctctatccgtcacattccatggacatgatctcattgttgattctgaattggagctgaattatggaaggcgttatggcttactcggattaaatggttgtggaaaatctacactgcttacagccatcggttgtcgggaacttccaattcccgaccacatggacatatatcatctaaccagggagattgatgcctctgatatgtctgcattggaagctgtcataagctgtgacgaagaaagattgaaattggagaaagaagcagaagctttagctgcacaggatgatggaggtggtgaatcccttgaacgcatttatgaacgattggatgccctagatgcagccactgcagaaaagcgtgctgctgaaatcttacatggtcttggctttgacaagcaaatgcaggcaaagaagacacgtgatttttccggtggctggagaatgaggattgcattagcgcgagctctatttatgaacccaaccattcttctacttgatgaaccaaccaatcaccttgatttggaagcttgtgtgtggctggaggagagtttgaagaagtttgaacgtattctggttgtgatttcacactctcaggactttcttaatggtgtctgcacaaatattatccacatgcaaagcaaaaaactgaagctctacactggtaattatgatcaatatgttcagacacgttctgagctagaagagaaccagatgaaacagtacaagtgggagcaggagcagattgcctcaatgaaggaatacattgcccgatttggccatggttcggctaaactagctcgccaggcacagagtaaggagaaaacactggcaaaaatggaacgtggtggacttgcagagaaggtggtcagagacaaagttttggtatttcgttttactgatgttgggaaacttccccctccagttctccagtttgttgaggtgtcatttggttatactcctgataatctcatctacaagaacattgactttggggttgatttagattctcgggttgcgctggttgggcccaatggtgctgggaagagtacactactgaagctaatgacaggtgacttgatgcctagtgatggcatggtccgacgtcataatcatcttcgaattgcacaatatcaccagcatttggccgaaaagctagacatggaaatgtctgctctccagtttatgattaaagaataccctggaaacgaggaagagaagatgagggcggcgattgggaagtttgggctgtcaggtaaagcgcaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggacggtggcttggtgcttgtcagccatgattttaggctcataaatcaggtggcgcatgagatatgggtatgtgctaatcaatctgtgaccagatgggagggtgacattatggaattcaaggcgcatctaaagtcgaaggcgggtttatctgactgaaacaatacgagtgtggatgctgccggtgtgtagtagtattacattaaaaggttatgatttttgttcgagcagagatccgtaataattttttttagttactatttcttgtgcttatcatttatttgcctggttgttaacaagcgtggatgaatgggatttcaccttgaggaaacgaagcttattctacaaatgaactatttcaaccgagaatattattatttgtggtattataattacgttaattcctctc

SEQ ID NO: 3880 - DNA, 2190 bp, Glycine max
gatcgaagatggtgtccgacgccagcaagaagaaggccgcacagaagaaggccgccgccgccgccaagagaggtggaaaggccgccgccgccgccgttatggaggcgtcttccaaagccgccaacaaggtcgccaacggaatcgccgatattcagatttcggatcggacctgcaccggcgtcctctgttcgcatcctctctccagagatattcgaatagagtctctatctgttacgttccatgggcatgatctcattgttgattctgaattggagctaaattatggaaggcgttatggtttacttggattaaatggttgtggaaaatctacactgctgacagccattggttgtcgggaacttccaattcccgatcacatggatatatatcacctaaccagggagattgatgcctctgacatgtctgcattggaagctgtcataagctgtgacgaagaaaggttgaaattggagaaagaagctgaagttttggctgcacaggatgacggaggtggtgaatcccttgaacgcatttatgaacgattggatgccctagatgctgccactgcagaaaagcgtgctgctgaaatcttgcatggtcttggctttgacaagcaaatgcaggcaaagaagacgcgtgatttttccggtggctggagaatgaggattgcgttagcacgggctttatttatgaatccaaccattcttctacttgatgaaccaaccaatcaccttgatttggaagcttgtgtgtggctggaggagagtttgaagaagtttgaacgtattctggttgtgatttcacactctcaggactttcttaatggtgtctgcacaaatattatccatatgcaaagcaaaaaactgaagatctacactggtaattatgatcaatatgttcagacacgttctgagctagaagagaaccagatgaaacagtacaagtgggagcaggagcagattgcctcaatgaaggaatacattgcccggtttggccatggttctgcaaaactagctcgccaggcacagagtaaggagaaaacgctggcaaaaatggaacgtggtggacttgcagagaaggtggtcagagacaaagttttggtattccgttttaccgatgttgggaaacttccccctccagttctccagtttgttgaggtgtcatttggttatactcctgataatctcatctacaagaacattgactttggggttgatttagactctagggttgcactggttggacccaatggtgctgggaagagtacactactgaagctaatgacaggtgacttgatgcctagtgacggcatggtaaggcgtcataatcatcttcgaattgcacaatatcaccagcatttggcagaaaagctagacatggaaatgtctgctctacagtttatgattaaagaataccccggtaatgaggaagagaagatgaggggggcaattgggaagtttgggctgtcaggaaaagcacaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggatggtggcttggtgcttgtaagccatgattttaggctcataaatcaagtggctcatgagatatgggtatgtgctaatcaatctgtgaccagatgggagggtgacatcatggaattcaaggcgcatctaaagtcaaaggcgggtttatctgactgaaacataccagtggatgctcttttcattttacaccttattttcctcctaactctccatcctctaaattttaaacatcccttctatatttcctgtaatatctcttctcagtttctataccacttagcaggttttgtttggttccaaggagggggaaagaaatttaatgagggaaggagatagattttaaataaacattctgtttgtttgcttgaggagaagagggacttgttaggagaggaaaaatagttattttcttatttgattcacaatgagaagagagttctaaaacttgttatcttaaatggtagtgcttctaatattcgagaaaacatattttagagatttatttcaatctcttaattctattcaatctatcgttcttaatatttttagttct

SEQ ID NO: 3881 - DNA, 2257 bp, Tripterygium wilfordii
taaccctcgccaccgggtcttgttttgcctactcttcggttttgtaattacacagcgccgaaacgaaaccctagatctaaccgctaggtcggaaatccacctccaccggttaaagatggtgtcggacgcaagcaagaagaaggcagctcagaagaaggccgcagccgccgccaagagaggcggtaaggccgccgcttcctctaaggccaagtctgcgtcggactctcagaacggaggtgttgacaaggtttccgacggacttgcgggtttccagatatctgatcggacttgtacgggcgtgctctgctcgcatccactatctagggatattaggattgagtctttatcagttacttttcatggacatgatctcatcgttgattcagaactcgaactgaattatggcagacgatatgggttgcttgggttaaatggatgtggaaagtcaactcttctaactgcaatagggtgtcgcgaactcccgataccagatcacatggatatttatcacctctctagagagattgaagcctctgacatgtcttcacttgaggctgtcataaactgtgatgaggagagattaaagttggagaaggaagctgaagttttagcagcacaggatgatggaggtggagaggccttggagcgtctatatgagcgtctggaagccatggatgcatcaactgccgagaaacgcgctgctgaaattttatacggtcttggtttcaacaaagagatgcaggcaaagaaaacacgtgatttttctggtggttggagaatgaggattgcattagctcgagctttatttatgaatccgacaattctgttgcttgatgagcctaccaatcatcttgatttggaagcttgtgtctggttggaggagacccttaagaactttgaccgcattttggttgtggtatcacactcccaggacttcctgaatggtgtctgcacgaatatcatacatatgcaaagcaggaagttgaagctctacagtggtaactatgatcagtatgttcagactcgttctgaactggaagagaatcagatgaagcagtacaagtgggagcaggagcagatttctaacatgaaggagtatattgcccgttttgggcatggttcagcaaaactagctcgacaggcacagagcaaagagaaaactcttgcaaaaatggagcggggtggtctcactgagaaggtggctagagaccaaattcttgtcttccgttttgttgatgttgggaaacttcctcctcctgtccttcagttttctgaagtaacttttggctatacacctgagaatctcatctacaagaatattgattttggggtagacttggattcaagaatagccctggttggacccaatggtgctgggaagagtacattgctgaagctgatgacaggggatttgcatcctcttgatggcatggtccggcgtcataatcaccttagaattgctcaataccatcagcacttggctgagaaacttgatttggagctgtctgctcttctgtatatgatgcgggaatacccaggaaatgaggaagagaagatgagggctgctattgggaaatttggactcactggcaaagcacaggtgatgccaatgaataatctgtctgatggacagaagagccgggtgatctttgcatggctagcatacaggcaacctcaattactacttctggacgaacctactaatcatttggatatcgagacaattgattctctggcggaggcgttgaatgaatgggatggaggcatggttcttgttagtcatgatttcaggctaatcaaccaggttgccaaggagatttgggtgtgtgaaaatcaagctgtcacccggtgggagggtgacattatggatttcaagcggcatctgaagagcaaggctggtttgtctgattgagccagataggaggagtttgaagattacagcacttctcagtgtgctgcatcctggcctacaagccatcaccgccaggtggggggatgaattctgaccacatctggatgatgcttacctggggttgattcgctgattgggaggctacaatagtattgtttggagctgacagatctcgctatatctctgctctgttagccgatggttttgttgttttgatttattttacatttgtcagcataacgtattattggatgttgagcaaggtgatatgaaccaagtatttatgatgatacacactatctagactgccgcagttaaattttagttatatttttgtactcttaa

SEQ ID NO: 3882 - DNA, 2497 bp, Citrus clementina
aacgaaaccctcatagcgggttttcaactttttgtgtttttgggcagtctttggtcctctcctcgcttctcaggtagcaccaaggtttccatacctctaaaccctagatctcggatctcgattatcgattcttaaccaagatggtgtcagacgcaagcaagaagaaggctttgcagaagaaggctgccgcggcggctaagagaggaggcaaggcggctgcggcggcggcgtcttctaaggccgctgcgttacagaatggaagtgctgctgataaagctgctagtgaaatggcagccatgcagatttcggatcgaacttgtacgggagtgctttgctcgcatcctctgtcaagagatattcgcatagagtcattatctgttacttttcatggacatgatctcatagtggattctgaactggagcttaactatggcaggcgttatggcttgcttggcttaaatgggtgtgggaaatctacgctcttgactgcaatagggtgtcgggagcttcctattccagatcacatggatatatatcacctttccagggagattgaagcttctgacatgtcttcattggaagcagtcataagttgtgatgaggagaggttaaaattggagaaagaagctgaaatcttgggagcacaggaagatggaggtggagaacaacttgaacgtgtttatgagcgtttggaagccttggatgcatcaactgcagaaaaacgtgctgctgaaatcttatacggtcttggttttaacaagactatgcaagctaagaaaacgcgtgatttctctggtggctggagaatgaggattgcattggcgcgcgcactctttattaacccaacgattctgttgctcgatgagcccacaaatcatctagatctagaagcttgtgtctggctggaagagaccttgaagaattttgaccgcatcttggtggtgatttcacactcccaggattttctgaatggagtttgcacaaacatcattcacatgcaaaacaagaaattgaagttctataccggtaattttgatcagtatgttcagactcgttctgaattggaagagaaccagatgaaacagtacaagtgggagcaggagcagattgcttcaatgaaagagtatatagctcgatttggtcatgggtcagcaaagctagctcgccaagcacagagtaaagagaaaacactggctaagatggagcgaggtgggcttacagaaaaggtggtgaaagacaaggttcttgtcttccgttttgttgacgtaggaaagctacccccaccagtactgcagtttgtggaagtgacatttggctacacacctgacaacctcatctacaagaaccttgattttggggtggacttggactcgagagtagctttggttggacccaacggtgctgggaagagtacgcttctgaagctgatgacgggggatttggttcctcttgatggcatggttcggcgacataatcaccttagaattgcacagttccatcagcacttggctgagaaacttgacatggatatgcctgccctccaatatatgataaaagagtaccccggcaatgaggaggagaggatgagggcagcaattgggagatttgggttgactggtaaagcccaggtgatgccaatgaagaatttatctgatgggcaaaggagtcgggtggtttttgcatggttagcatataggcaaccccacatgcttctcttggatgagccaactaatcatctggatattgagacaatcgactcgcttgctgaggcattgaatgagtgggatgggggtctggttctcgtcagccatgatttcaggctcataaaccaggtagcccatgaaatatgggtgtgtgaaaatcaagccgttacccggtgggagggtgacattatggactttaagcagcacctgaaggccaaggctggtctatctgattgaaagaagatcaccataggatgaatttgaagacaatgtaatagtgctgctatttttattacacatttggcttaagactgtagtaggcccaagtgatcgccaccactggttgatgttttccccaaggtggggattatgacgaaagttttatgtagcagcaggagggacgacggcttatttattgtatgccgctggttcattccataattatctgcgaagttgttaggtgatatttttgttcttggttacatttgcccttccttatcatattccttggttccttggccaagaagatgacatatggctaaacatatatttaggtttagacgcgaatgtttatgtgctattggacttttattatatgttgtactcgagagagattataatattttatgaaaagcggaatacgcaatgtttctttggccacccaactttttcgtcagtattactatcagaggtctgggtgtccctaaatagtgttcttttcttcagttgtttccctaatgggaagttgggtatcttaaatttttaataaaaatggttatggttatttggtgttt

SEQ ID NO: 3883 - DNA, 2494 bp, Citrus sinensis
aacgaaaccctcatagcgggttttcaactttttgtgtttttgggcagtctttggtcctctcctcgcttctcaggtagcaccaaggtttccatacctctaaaccctagatctcggatctcgattatcgattcttaaccaagatggtgtcagacgcaagcaagaagaaggctttgcagaagaaggctgccgcggcggctaagagaggaggcaaggcggctgcggcggcggcgtcttctaaggccgctgcgttacagaatggaagtgctgctgataaagctgctagtgaaatggcagccatgcagatttcggatcgaacttgtacgggagtgctttgctcgcatcctctgtcaagagatattcgcatagagtcattatctgttacttttcatggacatgatctcatagtggattctgaactggagcttaactatggcaggcgttatggcttgcttggcttaaatgggtgtgggaaatctacgctcttgactgcaatagggtgccgggagcttcctattccagatcacatggatatatatcacctttccagggagattgaagcttctgacatgtcttcattggaagcagtcataagttgtgatgaggagaggttaaaattggagaaagaagctgaaatcttgggagcacaggaagatggaggtggagaacaacttgaacgtgtttatgagcgtttggaagccttggatgcatcaactgcagaaaaacgtgctgctgaaatcttatacggtcttggttttaacaagactatgcaagctaagaaaacgcgtgatttctctggtggctggagaatgaggattgcattggcgcgcgcactctttattaacccaacgattctgttgctcgatgagcccacaaatcatctagatctagaagcttgtgtctggctggaagagaccttgaagaaatttgaccgcatcttggtggtgatttcacactcccaggattttctgaatggagtttgcacaaacatcattcacatgcaaaacaagcaattgaagttctataccggtaattttgaccagtatgttcagactcgttctgaattggaagagaaccagatgaaacagtacaagtgggagcaggagcagattgcttcaatgaaagagtatatagcccgatttggtcatgggtcagcgaagctagctcgccaagcacagagtaaagagaaaacactggctaagatggagcgaggtgggcttacagaaaaggttgtgaaagacaaggttcttgtctttcgttttgttgatgtaggaaagctacccccaccggtactgcagtttgtggaagtgacatttggctacacacccgacaacctcatctacaagaaccttgattttggggtggacttggactcgagagtagctttggttggacccaacggtgctgggaagagtacgcttctgaagctgatgacgggggatttggttcctcttgatggcatggttcggcgacataatcaccttagaattgcacagttccatcagcacttggctgagaaacttgacatggatatgtctgccctccaatatatgataaaagagtaccccggcaatgaggaggagaagatgagggcagcaattgggagatttgggttgactggtaaagcccaggtgatgccaatgaagaatttatctgatgggcaaaggagtcgggtggtttttgcatggttagcatataggcaaccccacatgcttctcttggatgagccaactaatcatctggatattgagacaatcgactcgcttgctgaggcattgaatgagtgggatgggggtttggttctcgtcagccacgatttcaggctcataaaccaggtagcccatgaaatatgggtgtgtgaaaatcaagctgttacccggtgggagggtgacattatggacttcaagctgcacctgaaggcgaaggctggtctatctgattgaaagaagatcactgtaggatgaatttgaagacaatgtaatagtgctgctatttttattacacatttggcttaagactgtagtaggccaagtgttcgccaccactggtcggtgtttttcccaaggtggattatgacgaaagttttatgtagcagcaggagggacgacggcttatttattgtatgccgctggttcgttccataattatctgcgaagttgttaggtgatatttttgttcttggttacatttgcccttccttatcatattccttggttccttggccaagaagatggcatatggctaaacatatatttaggcttagacgcgaatgtttatgtgctattggacttttattatatgttgtactcgagagagattataatattttatgaaaagcggaatatgcaatgtttctttggccacccaactttttcgtcagtattactatcagaactctgggtgtctctaaatagtgttcgtttcttcatttgtttccctaatgggaagttggatatcttaaatttttaataaaaatggttatggttatttggtgttt

SEQ ID NO: 3884 - DNA, 2250 bp, Cajanus cajan
ggggtccgcaactagctccttcaaaactcaaacctccaaccctaagccctcgctcggttcctcttcgctcccagatctgtttccttctctcctctccgatccaatcgttgcagatccaagatggtgtccgacgccagcaagatgaaggccgcgcagaagaaggccgccgccgctgccaagagaggcggcaaggccgccgccaagaaaggcgccacctcttccaaagccgccgataaggtcgccaatggaatcgccgatattcagatttcggatcggacctgcaccggcgtcctctgttcgcatcctctttccagagatattcggatagagtctctatctgttacattccacggacatgatctcattgttgattctgaattggagctcaattatggaaggcgttatggtttacttggattgaatggttgtggaaaatctacactgcttactgcaataggttgcagggaacttccaattcccgaccacatggatatctatcacctttccagggagattgaagcctctgacatgtctgcattggaagccgtcataagctgtgacgaagaaaggttacaattggagaaagaagctgaagagttggctgcacaggatgacggaggtggtgaatcccttgaacgtatttatgaacgattggatgccctagatgcagcaactgcagaaaagcgtgctgctgaaatcttacacggtcttggttttgacaagcaaatgcaggcaaagaagacccgtgatttttctggtggctggagaatgagaattgctttagcacgagctctatttatgaacccaaccattcttctacttgatgaaccaaccaatcaccttgatttggaagcttgtgtgtggctggaggagaatttgaagaagtttgaacgtattctggttgtgatttcacactctcaggactttcttaatggtgtctgcacaaatattatccacatgcaaaacaaaaaactgaagctctacactggtaactatgatcaatatgttcagacacgttctgagctagaagagaaccagatgaaacagtacaagtgggagcaggagcagattgcctcaatgaaggaatatattgcccgatttggtcatggttctgcaaaactagctcgccaggcacagagtaaggagaaaacactggcaaaaatggaaagaggtggacttgctgagaaggtggttagagacaaagttttggtattccgttttactgatgtgggaaaactgcctcctcccgttcttcagtttgttgaggtggcatttggttatactcctgataatctgatttacaagaacattgactttggggttgatttagattctagggttgcactggttggaccaaatggtgctgggaagagtacactactgaagctaatgacaggagagttgatgccttctgatggcatggtgcgtcgtcataatcatcttcggattgcccagtatcatcagcatttggctgaaaagctagacatggaaatgtctgctctccagtatatgattaaagaataccctggaaacgaggaagagaagatgagggcagcaattggaaagtttgggctctctggtaaagcccaggtaatgccaatgaagaacttgtctgatggacaaaggagccgagtgatatttgcttggttagctttcaggcagcctcaaatgcttcttttggatgagccaacgaatcatttggatattgagactattgactcattggcggaggcgttgaatgaatgggatggtggcatggtgcttgtgagccatgattttaggctcattaatcaagtagcccatgagatatggatatgtgctgatcaaagtgttaccagatgggagggtgacattatggaattcaagcagcatctgaaggcaaaagcgggtttatctgactgaagcaggtgtggggacattggctgcttctgatatcaccgtctaaggatttctcactgccagtaaacagtcggtacctccgtttctcaactttgacgattttcaatggcataatcggtttgtagtatacaaggttgttatattttttgtccgagccaagattccccgccctccaacggtttggactggtaataattttttctaattactttttgttgtgctagcttatcatttaattgctttggttgttaaccagcatggataaatgggactttcaccttgaggtagatgggtccctatctgaatctacaaacgaggctattatatttgtgttattataattgttagtta

SEQ ID NO: 3885 - DNA, 2341 bp, Prunus persica
cccaaccgcaccgggtttttccttctctcaccggagacagcacaacaatatctgtacaccttcacctgaaaactcaatcccagatctgatacccaccgccctcgctctcttcgccgatcgtcttctctctcctcaggttgatttttgataacgatggtgtctgacgcgagcaagaagaaggcggcacagaagaaggcggcggcggcggccaagagaggtggaaaggcggcggcgtcgtcgaagtcggctgcgaccgagtcgcagaacggagctgataagctatcgaatggcgtcggggcgatgcatatttcggatcgtaactgcaccggtgttctctgttcgcatcctctgtctagagatatccggatagagtctctaacagttaccttccatggacacgatctgatagttgattctgaactggagcttaattatggcagacgttacggtttgcttggtttgaatgggtgtggtaaatctaccctcctaactgcaataggctgccgagagcttccaattccagatcacatggatatctaccatctcagcagggagattgaagcttcagacatgtcttcacttgaggctgtcattagttgtgatgaggagaggataaggttggagaaagaagttgaagaactggcagctcaggatgatggtggtggagagcagcttgaacgcatttatgagcgccttgaagcattggatgcagcaactgcagagaagcgtgctgctgaaattctatatggtcttggttttgacaagcagatgcaagcaaagaaaactcgggatttttctggtggttggagaatgaggattgcacttgcacgtgctctgtttataaacccaaccatcctgttgctcgatgagcccaccaatcatcttgatttagaagcctgtgtgtggttggaggagaccttgaagaactttgagcgcatcctggtggtgatttcacactcccaggattttcttaatggtgtgtgcacaaacatcatccacatgcagagcaagaaactgaagatctacactggaaactatgatcagtatgttcagacccgttctgaactagaggagaaccagatgaaacagtataagtgggagcaggaacagatttcaaacatgaaggaatatattgctcggtttgggcacgggtcagcaaaattagctcgtcaggcacagagcaaagagaaaaccctagcaaaaatggagcgcggtggccttacggaaaaggtggccagagacaaggttctagtcttccgttttgttgatgtgggaaagctgccaccgcccgtacttcagtttgtagaagtcacatttggttacactcctgataatctgatctataagaacattgactttggggttgatttggactcgcgtatagctctggttgggccaaatggagctggaaagagtactctgttgaagctgatgacaggggagttgttccctagtgatggcatggtccggaggcacaatcaccttagaattgctcagttccatcagcacttggctgagaagcttgatatggaactgtctgcccttgcgtatatgatcaaagagtacccaggaaatgaggaagaaaagatgagggctgcaattggtaagtttggcctatcgggtaaggcacaggtgatggcaatgaagaatttatcagatggacagaggagccgtgtgatctttgcttggttggcatttaggcagccccaattacttttgttggatgagccaaccaatcacttggatatcgagacaattgactcactggctgaggcactgaatgagtgggacgggggtctggttcttgttagccatgatttcaggctcataaaccaggtagctcaggaaatttgggtatgtgaaaatcaagctgtgacccggtgggagggcgatattatggactttaagcggcacctaaaggttaaggctggtttaggtgaatgaggctgcggcggacacccacttccatcaaagtttgtagtagttcatttgttggccttgctttacacttgtatgagacaatgtagtgagggtactttttactatttctgagccatgtcttctcagactgactatgacggaagacgagcggaatgggcaaaaggcttggttattgtttcaagccggcagcagtttctatgcccttagcccgacgtgtaggtgggattttttgtttacattgcgcatgtttggacttctatattttgcttggttagtagccaagtcgattacattatagttattttaggtagatacattgcctatgtccttgttcttttcctggaaaatgttgtacctgcatattatttattatattggaaattctatcttggctggcctc

SEQ ID NO: 3886 - DNA, 2448 bp, Aristolochia fimbriata
cttgtgtaaaaggttcctcctcttattacaaaccgacaggatttttggcactgacaccggccgcctctcctcaagttcagacgcgtgtccgacgtgccgagtgcggactctctacaccaccgaaagccatcactcgccctataaatgctcccccccaccccacgggcacaaaccctctctccaacccttcctctgcgttgggtagctgctgtccgggcaaaccgaaataccgagcacaattctcgtcgcacacggaaaaaaataaaaaccctagcctgatctcctaagctgccactctacaaagatggtgtcggatgcgagtaagaagaaggccgcacagaagaaggccgcggcggctgcgaagagaggagggaaagttgcggcggcagcttcgtccaaggcgtcttccgcgtcggctgctgataacggagccgaaaagctgtcgaatggagtgtcgagcctgcagatatcggatcggacgtgtaccggaatcctctgttcgcatcctctctccagagatattcatattgaatccttatcagtaacttttcatggtcacgatttgatagttgattctgaattagagcttaactatggcagacgatatggtttactcggactgaatggctgtggaaagtctacgctgttaattgctttaggatgcagagagcttcccatccctgaccacatggatatataccatctctccagtgagattgaagcctctgacatgaccgcactacaggctgtcataagttgtgatgaggagaggctgcaattggagaaagaagctgaagcactggcatcacaggatgatggtggtggagaagccctagagcgtgtttatgagcgtttagaagccttggatgcagcaactgctgagaagcgtgctgcagaaattctatttggactgggctttaacaagaaaatgcaagccaaacaaacccgagatttctctggaggttggcggatgcgaattgcattggctcgtgcactatttatgaatcctactattcttttgcttgatgaacccacaaatcacctggacttggaggcatgtgtctggttggaagaaacactcaagaagtttgacaggattctggttgtgatctcccactctcaagatttcttgaatggtgtttgtaccaacataattcacatgcaaaataagaagctcaagctttacactggcaattatgaccagtatgttcaaactcgttctgaacttgaggaaaatcaaatgaaacagtatagatgggagcaggaacaaattgcatccatgaaggagtacattgcaaggttcgggcatgggtctgctaagcttgcacgtcaagctcagagcaaagaaaagacccttgcaaagatggaacgaggtgggctcactgagaaggtcgctcgagacaaaatcttggttttccgcttcacggatgtggggaaactccctccgcctgtactgcagtttgtggaagtaacttttgggtatacccctgataatctcatatacaagaaccttgattttggggtggacttggattcaagaattgcacttgtggggcctaacggggcagggaaaagcacactgctgaagctgatgacaggggatcttgttccactggatggtatggttcggaggcacaaccatttaagaattgctcagtttcaccaacacctgactgagaagcttgacatggagttgtcagctcttcagtttatgatcaaagaatacccgggcaacgaagaagagaggatgagagctgcaattggaaagtttgggttgactggtaaagctcaagtgatgccgatgaagaacttatccgacggtcagagaagcagggtgatctttgcgtggttagcttggaggcagcctcatatgctcttactggacgagccgacgaaccatcttgacattgagactattgattcgttggcggaggccctgaacgagtgggatgggggcttggttcttgttagtcatgacttcaggctgattaatcaggtggctcacgagatatgggtttgtgagaaccaggcggtatctcgttgggaaggggatatcatggacttcaaggagcacctgagaagcaagtccggactaatagactagggtgtctttcgggggtatttaggagtatattagagatatatcatgctctttccatttttgactttctttgtgtactaatgttattttctgctgatagcggatgttattgttatatgagagggttagattgatttagtattatcctgcggaccaggcatttttatgtttctggccagatgattctgccacactggtggagagatcctattgagatatttaagtgccgtatatggtgccttatttttaattaaatagaacatatttcatgtgcatatgtttcacgagttgtatttttgcgacgtgctacaaattaggcgctgtgatcaggtcagttgtaggtacta

SEQ ID NO: 3887 - DNA, 2491 bp, Citrus sinensis
cgaaaccctcatagcgggttttcaactttttgtgtttttgggcagtctttggtcctctcctcgcttctcaggtagcaccaaggtttccatacctctaaaccctagatctcggatctcgattatcgattcttaaccaagatggtgtcggacgcaagcaagaagaaggctttgcagaagaaggctgccgcggcggccaagagaggaggcaaggcggctgcggcggcggcgtcttctaaggccgctgcgttacagaatggaagtgctgctgataaagctgctagtgaaatggcagccatgcagatttcggatcgaacttgtacgggagtgctttgctcgcatcctctgtcaagagatattcgcatagagtcattatctgttacttttcatggacatgatctcatagtggattctgaactggagcttaactatggcaggcgttatggcttgcttggcttaaatgggtgtgggaaatctacgctcttgactgcaatagggtgccgggagcttcctattccagatcacatggatatacatcaccttactagggagattgaagcttctgacatgtcttcattggaagcagtcataagttgtgatgaggagaggttaaaattggagaaagaagctgaaatcttgggagcacaggaagatggaggtggagaacaacttgaacgtgtttatgagcgtttggaagccttggatgcatcaactgcagaaaaacgtgctgctgaaatcttatacggtcttggttttaacaagactatgcaagctaagaaaacgcgtgatttctctggtggctggagaatgaggattgcattggcgcgtgcactctttattaacccaaccattctgttgctcgatgagcccacaaatcatctagatctagaagcttgtgtctggctggaagagaccttgaagaaatttgaccgcatcttggtggtgatttcacactcccaggattttctgaatggagtttgcacaaacatcattcacatgcaaaacaagaaattgaagttctataccggtaattttgatcagtatgttcagactcgttctgaattggaagagaaccagatgaaacagtacaagtgggagcaggagcagattgcttcaatgaaagagtatatagcccgatttggtcatgggtcagcgaagctagctcgccaagcacagagtaaagagaaaacactggctaagatggagcgaggtgggcttacagaaaaggtggtgaaagacaaggttcttgtcttccgttttgttgatgtaggaaagctacccccaccagtactgcagtttgtggaagtgacatttggctacacacctgacaacctcatctacaagaaccttgattttggggtggacttggactcgagagtagctttggttggacccaacggtgctgggaagagtacgcttctgaagctgatgacgggggatttggttcctcttgatggcatggttcggcgacataatcaccttagaattgcacagttccatcagcacttggctgagaaacttgacatggatatgcctgccctccaatatatgataaaagagtaccccggcaatgaggaggagaggatgagggcagcaattgggagatttgggttgactggtaaagcccaggtgatgccaatgaagaatttatctgatgggcaaaggagtcgggtggtttttgcatggttagcatataggcaaccccacatgcttctcttggatgagccaactaatcatctggatattgagacaatcgactcgcttgctgaggcattgaatgagtgggatgggggtttggttctcgtcagccacgatttcaggctcataaaccaggtagcccatgaaatatgggtgtgtgaaaatcaagctgttacccggtgggagggtgacattatggacttcaagctgcacctgaaggcgaaggctggtctatctgattgaaagaagatcaccgtaggatgaatttgaagacaatgtaatagtgctgctatttttattacacatttggcttaagactgtagtaggccaagtgttcgccaccactggtcggtgtttttcccaaggtggattatgacgaaagttttatgtagcagcaggagggacgacggcttatttattgtatgccgctggttcgttccataattatctgcgaagttgttaggtgatatttttgttcttggttacatttgcccttccttatcatattccttggttccttggccaagaagatgacatatggctaaacatatatttaggtttagacgcgaatgtttatgtgctattggacttttattatatgttgtactcgagagagattataatattttatgaaaagcggaatacgcaatgtttctttggccacccaactttttcgtcagtattactatcagaggtctgggtgtccctaaatagtgttcttttcttcagttgtttccctaatgggaagttgggtatcttaaatttttacataaaaatgaatatcgttattaggtct

SEQ ID NO: 3888 - DNA, 1792 bp, Medicago truncatula
ggattgaaaatggtttctgaagccagcaagaaaaaagctgctcagaagaaggctgccgccgctgcaaagagaggagggaaggttgccgccgtgtcatcgaaaaaggcggtggatagtgttgctaacggaattggggatattcagatatctgatcggacatgcactggtgttctatgttctcatcctctttctcgggatattcggatagaatctttatcagttactttccatggacatgatctaatagttgattctgagttggagctaaattatggaagacgttatggtttgcttggattgaacggctgtggaaaatctacgctacttacagcaataggttgccgtgagcttcctattccagaccacatggatatttatcaccttagccgggaaattgaagcctctgacatgtctgcgttggaggctgtcattagttgtgatgaggaaaggttgaaattggagaaagaagctgaaattctgggggcacaggaagatggcggtggtgaagcacttgaacgagtttttgaacggctggaagctatggatgcatcaactgccgaaaagcgtgctgctgaaattttatttggtcttggtttcaacaagcagatgcaggcaaagaagacacgtgatttttctggtggatggagaatgaggattgctttagcacgagccctgtttatgaacccaaccattcttctacttgatgaaccaaccaatcaccttgatttggaagcatgtgtgtggctggaggagaatttgaagaagtttgaccgtattttggttgtgatttcacactcccaagatttccttaatggtgtctgcacaaatatcatccacatgcaaaacaaaaagctgaagttctatactggtaattatgatcaatatgttcagacacgtgctgaactggaagagaaccagatgaagcagtacaggtgggagcaggagcagattgcctcaatgaaggaatacattgcacgatttggccatggatcagcaaaactagctcgccaagctcagagtaaagagaagactcttgcaaaaatggagcgtggtggacttacagagaaggtggtaagagacaaaattttagttttccgctttgttgatgtggggaaacttcccccacctgttctccagtttgtggaggtgacatttggctacactcctgataatctcatctacaagaacatcgatttcggggtcgatttagactccaggattgctctggttggacccaatggagctgggaagagcacgttcctgaagcttatgacaggtgatttggttcccttagatggcatggttcgtcgccataatcaccttcgcattgcacaatttcaccagcacttgactgagaaactagacttggaactgtctgctctccagtttatgataaaagagtaccctggaaatgaggaagaaaagatgagagcagccattgggaagtttggattgtcgggtaaagcacaggtgatgcctatgagaaatttatcagatggacaaaggagtcgcgtgatttttgcatggttagcctatagacagccgcacttgctactattagatgagccaactaatcatttagatatcgagacaatcgactcgttagccgaggcattgaatgaatgggatggtggcatggttctagtcagtcatgattttaggctcataaatcaggtggcccatgagatatgggtgtgtgctgatcaaacagtgaccagatgggaaggtgatattatggatttcaagctgcacctaaaggaaaaggcaggtttatctgactgaaaagatagct

SEQ ID NO: 3889 - DNA, 2338 bp, Populus trichocarpa
ctctcacccataaccctcatatacgggttttctatcacacaccgaaacatccgttcgaaaccaaaccctagatccctctctctctaattacttgatataaccatggtttccgacgccagcaagaagaaggccgctcaaaagaaggcggcggccgctgccaagagaggtggaaaagcagctgcaacctcctcaaaagcagcggcggctgccgattcgcagaatggaggtgttgataagttgtcgaatggagttggagctcttcagatttccgatcggacttgtactggcgtcctatgctcgcatcctctttctagagatatccgcattgaatcattgtcagttacttttcatggacatgatctcattgttgattctgagctggagctaaactatggcagacgatatggattacttggtttaaatggatgtgggaaatcaacactcctagctgcaatagggtgtcgagagcttccaattccagagcacatggacatatatcacctcaccagggagatcgaagcttctgacatgtcttcacttgaggctgtgataagctgtgatgaggagaggttggagttggagaaagaagcagaggccttggctgcacaggatgatggaggtggagaagctcttgatcgtgtttatgagcgtctggaggccatggatgtggcaactgcagagaaacgtgctgctgaaattttgtttggtcttggatttaacaagcaaatgcaaacaaagaaaactcgagatttttctggtggctggagaatgaggattgcattagctcgggctttgttcatgaacccaactgtcctcttacttgatgagccaaccaatcatcttgacctcgaagcctgtgtctggttggaggaaactttaaagaactttgaacgcattctagttgtggtttctcactctcaggatttcttgaatggtgtctgcacaaacattatccacatgcaaagcaagaaattgaaaatctacactggtaactatgatcagtatgttcagactcgttctgaactggaagaaaaccagatgaaacagtacaaatgggagcaggatcagatttcttccatgaaggagtatattgcccgatttgggcatgggtcagcaaagttagctcgtcaggcgcagagcaaggagaaaactcttgctaagatggaacgcggtggacttacagaaagggttgcgagagaccaggttctggtctttcgctttgttgatgtggggaagctcccaccacccgtgcttcagtttgttgaagtaacctttggctacacacctgataacctcatttataagaatcttgactttggtgtggatctggactctagggttgcgctggttggccccaacggagctggaaagagtaccttgctgaagcttatgacgggtgacttggttcctttagatggcatggttcgccggcacaatcacttgaggattgcgcaatttcatcaacacttgactgagaaactagacttagaattgtctgctctcctttttatgattagagagtatccagggaatgaggaagaaaaaatgagggcagcgattgggaagtttgggttgacaggcaaggcccaggtgatgcccatgagtaatttgtcagatgggcagaggagcagggtgatttttgcttggctggcatttaggcaaccccaaatgctccttctggatgagccaaccaaccatttggatattgagaccatcgactccctggcggaggcattgaaagagtgggatgggggtctggttcttgttagccatgatttcaggctcataaaccaggtagcgcaggagatatgggtatgtgagaatcaagctgttacccgttgggagggcgacattatggaattcaaggcgcacctcaagaagaaggcagggttgttggattgagttgagatagatcacagggatgaattcggataatggttgggtatgacaaggccgagtgggtgattttggtttccccaggatgaagaaagcagcagcttgtagagaggaggggatgggtgacaaggaggcttgtttattgtttcgagccaaatgttcatcgtatcctttgctcggttactatggagtattatttttgttttccttaattacgattggcgttctactactagacttggtcctttaccaaggtgtgacaatatttatttagttcagaggcgatgctgatgtgatcctcttcttgttacatgtgtactctgaaaacatgttatgctactttctttcctatgctacttttattcctctctttttaatgtcttggtgtcgcccgctggatttgcatctgcatgatggtaataaaatgttcctcttgatttta

SEQ ID NO: 3890 - DNA, 2447 bp, Vigna unguiculata
tccaactcgaacacgcaaccaaagcggaagcccacacctcccttcctctctctctctctctatatatatctcaaacctcgcttcactctgtccacaactacctccttcaagaactcaaacctcgaaccctaagctttctctcgggttcagtttttatttctctttgttccgcgaaaccctagggtcattttttagatctatctccatctctcctttccgatccaaacttttgttcgtaattcgtattcgattagcgattaaggatggtttccgacgctagcaagaagaaggctgcacagaagaaggccgccgccgccgctaaaagaggtggaaaggccgccgccgctgccgtcgtcgctgctgcatcttccaaagctgccgataaggccgccaacggaatcgccgatatgcatatatcggatcggacctgtaccggagttctctgttcacatcctctttccagagatattcgaatagagtctttatctgttacattccatggacatgatctcattgttgattctgaactggagcttaattatggaaggcgttatggtttacttggattaaatggttgtggaaaatctacactgcttacagccattggtcagcgggaacttccaattcctgaacatatggatatctatcaccttacccgggagattgaagcctctgacatgtctgcattggaagctgtcataagctgtgatgaggaaaggttgaaattggagaaagaagctgaaattttggctgcacaggatgatggaggtggtgagtccctggaacgtgtttatgagcgattggatgccttagacgcagcaactgcagaaaaacgtgctgcggaaatcttatatggtcttggctttgacaagcaaatgcaggcaaaaaagacacgtgatttttctggtggttggagaatgagaattgcattagctcgagctctatttatgaacccaaccattcttctactcgatgaaccaaccaatcaccttgatttggaagcttgtgtgtggctggaggagagtttgaagaagtttgaacgtattcttgttgtgatttcacactctcaggactttcttaatggtgtctgcacaaatattatccacatgcaaagcaaaaaactgaagctctatactggtaactatgatcaatatgttcagactcgttctgagctagaagagaaccagatgaaacagtataagtgggagcaggagcagattgcctcaatgaaggaatatattgctcgatttggtcatggttctgcaaaacttgctcgccaggcacagagtaaggagaaaacattggcaaaaatggaacgtggtggacttgcagaaaaggtggttagggacaaggttttggttttccgttttactgatgttggaaaacttccccctcctgttctccagtttgttgaggtgtcgtttggttacactcctgataaccttatatacaagaacattgactttggggttgatttagattctagggtcgcactggttggacccaatggggctgggaagagtacactactgaagctaatgacaggtgatttgatgccttctgatggcatggttcggcgtcataatcatcttcggattgctcaatatcaccagcatttggctgaaaagctagacttggatatgtcagctctacagtttatgattaaagaatatcctggaaacgaggaagagaagatgagggcagcgatagggaagtttggtctatcaggtaaagcccaggtgatgccaatgaagaacttgtcggatgggcagaggagtcgggtgatatttgcttggttagcttggaggcagccacaaatgcttcttttggatgaaccaactaatcatttggatattgagacaattgattctttggctgaggcattgaatgaatgggacggtggcttggtgcttgtcagccatgatttcaggctcataaatcaggtggcccatgagatatgggtatgtgctaatcaaagtgtgactagatgggagggtggcatcatggaattcaaggcgcatttaaaggccaaggcgggtttatctgactaaagaaggtaaggtagtggggatttttcattgcccgagtatttctcactcgttgttcatgagtgggtggtaccgtttgagttggatttccctcaacttggacgatttccattggcataatcggtatatggtatagaaagtggttatgatttttcttctagccgagatgccgaggtttggactggtaatattttttttttcttatctactattactatttgttgtgcttatcatttatttgcttggttgttaaccagcatggataaatgggatatcaccttgaggtagacagtccctatctgaatatctacgattaagaggcttattctagaaatgaactatttgtacccagagtgttatatttttggtattataattactgttagttcactatttaca

SEQ ID NO: 3891 - DNA, 2032 bp, Aquilegia formosa
aaaaatggtttcagatgcgagtaagaagaaggcagcacagaagaaagcagctgctgcagcaaaaagaggaggaaaggttgcagcatctttgaagttgcagaataatgaaaatagtgttgataagttaagtaatagtgtcggttctttgcaaatatcggatcgtacttgtactggtgttctttgttctcatcctttatccagagatattcatattgagtctttatctgtaacattccatggacatgatctcatagtggattctgagcttgagcttaactatggcaggcgctatggtttgcttggattgaatggatgtggtaagtctactctgcttactgcaattgggtgtcgagagctccccattccagagcacatggatatatatcatttaagccgggagattgaagcttctgacatgtctgctctggaggctgttataaattgtgacgaggagaggctgaaattggagaaagaagcagaggctttggcagcagaggatggtggtggtggagaggctctggaccgcatatatgagcgactggaagccatggatgcagcaaccgctgagaagcgtgcggctgagatattgtttggtcttggtttcaacaagcaaatgcaagccaagaaaactcgagatttctctggtggctggcgaatgagaattgctttggcaagggccttattcatgaacccaaccatcttgttactcgatgaacccaccaaccatcttgatttagaagcttgtgtttggttggaagagaccttgaagaagtttgagcgaatcctggttgtggtgtctcactcacaggatttcctgaatggggtgtgcacaaatatcatccacatgcagaacaaaaaacttaaactctacactggtaactatgatcagtatgtacaaacccgtgctgaacttgaagagaatcagatgaagcagtacaaatgggagcaggagcagattgcgtcaatgaaggagtacattgctcgctttgggcatggttctgcgaagttggcccgtcaagcacaaagcaaggaaaagactttggcaaaaatggaaaggggtggattgacagaaaaggtggcaagggacaaaattcttgtgtttcgcttcactgatgttgggaagctgccaccgcctgttcttcagttcgttgaggttacgtttggttatacccctgaaaatttcatctataagaaccttgactttggggtggacttggattcaagagtagcactagtcgggcccaatggggctggtaagagcaccctgctgaagctgatgacaggagaactggttccttctgatggcatggtccgtcgacacaaccacctgagaattgcacaatatcatcaacatttggctgagaagctcgacttggagatgtctgctctccaattcatgatgaaggagtatcctggcaacgaggaagagaaaatgagggctgcgatcggaagatttgggctgactggtaaagcgcaggtgatgccaatgaaaaacttgtcagatgggcagaggagccgagtgatttttgcatggttggcgtggagacagccacacatgctactgttggatgagcctacaaatcatctggacattgagacaatcgactctttggcagaggcattgaacgagtgggatggtggcatggtacttgttagtcacgacttccgactcattaaccaggtggctcaagagatatgggtgtgtgagaatcaaactgtgaccagatgggaaggtggcattatgggcttcaaggagcatttaaggcaaaaggctggtctgtctgattaaagccagatggttcattggctggtatatactttttggctgttaagagtattactcttctgatattgttacaccttctgcttgtctctgattggtccacagatcaagggagtagcaggtgaagatggttattgccataagagttcgtaaggtttgatgatccctgctcgttggttgggagaaagcttttcaccactctggatagggttttatatctgggattgattagaagaaatgtaagccctt

SEQ ID NO: 3892 - DNA, 2342 bp, Humulus lupulus
tttctcctctgtttgggtgttgtctactcttttcacgaaacacaaccgttcatctatacaatcgcctagaaaaccctagatctgatcgtactcctccgttctccttcatcgccccacccagaacccatccctgcaatctacgaaggttataaggatggtttcggacgccagcaagaagaaggccgcacagaaaaaggccgcggcggcagccaagcggggaggcaaagctgctgcatcgtctgcttcatcaaaggcggcggccgtgtcgcagaatggagccgataagctggcgaacggggttggggcgcttgagatttcggatcggacttgcactggtgtgctctgctcgcaccctctctctagagatattcgcatagagtctttatcggttacctttcatgggcatgatctcattgtggattctgaattggagctcaactatggcagacgttatggtttgcttggattaaatgggtgtggtaagtctactcttctcaatgcaattgggcaccgagagcttcccgtacctgagcatatggatatctatcacctgtcccgagaaattgaagcttctgatatgtcttcacttgaggctgttataagctgtgatgaggagaagataaaattggagaaagaagttgaactcttgtcggcgcaggatgatggaggtggagaacagcttgaacgaatttatgaacgtctggaagccatggatgcagctacagcagagaaacgtgctgctgagatattgtatggtcttggttttgacaaggagatgcaggcaaaaaaaaccagagatttctcaggtggctggaggatgaggattgcgttggccagggcgctattcatcaatccaaccattttgttgcttgatgagccaaccaatcatcttgacttggaagcttgtgtgtggttggaggagaccttgaagaactttgagcgcattctggtcgtaatatcacattcccaggattttctaaatggagtgtgcacaaacatcattcacatgcaaagcaagaaactgaagatttacagtggcaattatgatcaatatgttcagacacgttctgaactggaggagaatcaaatgaaacagtacaagtgggagcaggaacagattgcttcaatgaaggagtatattgcacggtttgggcacggatcagcaaaactagctcgccaagcacaaagtaaagagaaaaccttggcaaaaatggagcgtggtggacttactgaaaaggttgccagggacaaggttttggtcttccgttttgttgatgtggggaagcttcctccaccagtgcttcaatttgtagaagtaacatttggttacacacctgataacctaatttacaagaacattgatttcggagttgatctggactcacgaattgctctggttggacccaatggagctgggaagagtacgcttctgaagctgatgacgggggaattatttccttcagatggcatggtccgacgacacaatcaccttagaatagcacagttccatcagcacttgactgagaagcttgacatggatatgtctgccttacagtatatgatcaaagagtatcctggaaatgaggaggagaagatgaggggctcaattggcaggtttggcctgacaggtaaggctcaggtgatggctatgaagaatctgtcagatggccaaaggagccgtgtgatctttgcttggctggcttttaggcaacctcatctgcttctactggatgaaccaactaaccatttggatatcgagacaattgactcgcttgccgaggccttgaacgagtgggatggaggtttggttcttgttagccacgatttcaggctcatcaaccaggtcgcccaggagatttgggtttgtgaaaatcaaactgtgacccggtgggagggtggtattatggactttaaggcgcatctgaagaaaaaggctggtttatctgactgaggccacatataacagtgcttaccgtctgtaaaggttggcttcatgctgtttgttgatgatatgatgcttcttggcattgccttttagctacggattaattcggaagccaatagattataaggaatgatcaggcttggtaattgtttcaaagtcgacatgagcagctatattattctatgctcggttagtagttggtattttttatttaattgtttttagtttgtttgcccactatttttattttgtgttgctatgaaagtgagtcgtgcattcacaaggactcggagctttttgtcaaacgatataatgttgtattgagatcataattatattagccttctaaaagactttaaaaagtttcataagaatgatgatatcatttattgattcc

SEQ ID NO: 3893 - DNA, 2049 bp, Platanus occidentalis
ttatagggtttcctcctcagactcaaataaaaagggaaaggcagccttcaaacgcaactaaaaagtgcgagacagggaagaactccaacaaaaccctagatctcattccaacaaccttcgcttcttcgcatatccgcatattcgaatccttcaaaggtagaagaatggtttccgacgcgagcaagaagaaggcggcccaaaagaaggctgcggcggctgcgaagagaggaggaaaggctgctgcggcggcatcatcgaagtcggcggcatcagatcctcaaaatggaggtgtcgttgataagttaaccaatggagtcgcttcgctccaaatatcggatcggaattgcactggtgtgctctgttctcatcctttatcgagagatatccatatagagtccttatcagttaccttccatggtcatgatctcattgtggattctgatctggagctaaattatggcagacgctatgggttgcttggattgaatggctgtgggaagtctacccttcttactgcaatagggtgccgagagcttcctattccagaacacatggatatctatcacctcagtagggagattgaagcttctgacatgtctgcccttgaggctgtaatatgctgtgatgaggagaggcttaaattggaaaaagaagttgaagccctggcagcagaggaaggtggtggtggagaagcccttgaccgcatttatgagcgcttggatgccttggatgcatcaaccgcagagaagcgtgccgctgagatcttgtttggtcttggttttgataagaatatgcaagcaaagaaaactagggatttctctggtggttggagaatgagaattgcattagcacgagctctgtttatgaagccaaccatccttttgcttgatgaacccactaatcatctagatttggaagcttgtgtttggttggaagagacattgaagaactttgatcgcatcctggttgtgatctcgcactcccaggacttcctgaatggtgtctgcacaaacattatccacatgcagaacaagaagctgaagctttacaccggtaactacgaccagtatgttcaaactcgttcagaactagaagagaaccagatgaagcaatacaagtgggagcaggagcagatctcatcaatgaaggagtacattgcccgttttgggcatgggtcagcaaagctggcacgccaagcgcagagcaaagagaaaacactagccaagatggagcggggtggtctcaccgataaggttgtgagggacaaggtccttgtcttccgtttcactgatgtggggaagcttcctcctccagtactccagttcgtagaggttacctttggctacacacctgaaaatctcatatacaagaacattgactttggggtggatctggactcgagggtagcattggtgggtcccaatggtgccggaaagagcacgctgctgaagctgatgacaggggatttggttcctcttgatggcatggtacggcggcacaaccacctgagaatcgcacagtttcatcagcacttgactgagaagcttgacttagagatgtctgcactcctcttcatgttgagggagtatcctggcaatgaggaagagaaaatgagagcagctataggaaagtttgggctgacgggcaaagcacaaattatgccaatgaagaacctatcagatggccagaggagccgggtgatatttgcttggttggcatggaggcagccacacatgctactgttggatgagccaacaaaccatttggacattgagacaatcgactcgctggcggaggctctgaatgagtgggatgggggcttggttctggtcagtcatgacttcaggctcatcaatcaggtggcacaagagatatgggtgtgcgagaagcaaactgtgacccgatgggaggggggcattatggacttcaagcagcacctcaagagcaaggctggattatctgattgaggcaggtagagaaatagggtatcagggctctctttcatttatatatttatatatgagatactgtttatgctatttgtataac

SEQ ID NO: 3894 - DNA, 2315 bp, Gossypium hirsutum
cctatttttcggagttttacgtctgattgtatttctccagcagcgcactgtagcaccaaatttccttctagatttgttgtggtggttagatttcaagatggtgtccgacgcgagcaagaagaaggctgctcagaagaaggctgctgccgctgcgaagagaggagggaaggccgctgcatccgctgcatcttccaaggcggcagctgcagcgaccgcggagaacggcgttgataatgtttctgataaagttagcatgctccagatatccgatcggacctgtaccggtgttctctgctcgcatcctctttccagagatattcgtatagagtccttatcagttactttccacggacatgatcttattgttgattcaacattggagcttaattatggcagacgctatggtttgctaggattaaatggttgtgggaaatccacgctgcttactgcaatagggttgcgtgaacttccaattccggagcacatggatatctatcacctgacgagggagattgaagcttcagatatgtctgcattgcaggctgtcataagttgtgatgaagagaggttgaagttggagaaagaagcagaaatcttggcagcacaggatgatggtggtggagagacacttgaacgtatctatgagcgattggatgccttggatgcatcaactgctgagaaacgtgctgctgaaattttatttggcctcggtttcaacaagatgatgcaggcaaagaaaacccgagatttctctggtggttggagaatgaggattgcattggcacgggctctattcatgaatcccaccattcttttgcttgatgagccaaccaatcatttagatttagaagcttgtgtctggttggaagaaaatttgaagaaatttgatcgtatccttgttgtggtatcacattcccaggatttcctgaacggagtttgtacgaacattatccatatgcaaaacaaaaaacttaagttgtacactggcaattacgatcagtatgttcaaactcgttctgaattggaagagaaccagatgaaacaatacaagtgggagcaggaacagattgcttcaatgaaggagtacattgctcgcttcggtcacgggtcagccaaactagcccggcaggcacagagtaaggagaagacattggcaaagatggagcgaggtggactcacggagaaggtagtcagggacaaggttctggtgtttcgatttgttgatgtcggaaaacttcctccaccggtactgcagtttgtggaagttactttcggatacacgcctgagaatctgatctacaagaacttggactttggggtagacttggactcaaggatagcattagtaggacctaatggtgcagggaagagtacactgctgaaactgatgacaggtgaattgactcctattgatggaatggtccgacggcataaccatctgcgaattgcgcaattccatcagcacttggcagagaaactggatatggaaatgtcagctctccagtacatgataagagaataccctggaaatgaggaagagaagatgagaggtgcaatcgggaagtttggattgtcagggaaagcgcaagtgatgccaatgaagaacctatccgatggacagaggagtcgagtcatcttcgcgtggttagcatttcgacaaccccacttgctgctgctagatgagcccactaaccatttggatatcgagacgatcgattcactggcggaaagcattgaacgagtgggacggtgggttggtactggtgagtcacgatttccggctgataaaccaggtagccgaggagatatgggtgtgtgaaaatcaagctgcaacacgatgggaaggggacatcatggacttcaagcagcatctcaagagtaaagctggtttatctgattgaaacaaagcagtaattagcatataactttaaagcagatggtgtccaccatcccagatgggttattctcgcgtggtggattaagcttagtagctgctatttagtatttttatagagcaggggtaacgaggaaaggctttgttattgtttgaagccatcgagttttcgtgacctctgtttggtgggtttagcaaagcaggatttgttgccatttggtttttaaacctgggtttgctttctccgaggggttggttgttcggtgatacctgttctaggtttaaagcttttgaggcattgtgctgctgaggatttggcatcatataatcagtcctatgctgtatttttcttgcattaacttggatttcagattgaacggtattatgcgtgtaatattttctattctctattttaaaaaag

SEQ ID NO: 3895 - DNA, 2381 bp, Malus domestica
cctccacaacccagtccaacgggtttttgctcctcttacctgacataccaccaaatatctgtacaccccaccacctgaaacgcaatcccagatctgacctcccccaccgccctccctctcttctccgatcgtcttctcttctccaaggttgatctttgaaaacgatggtgtcggacgcgagcaagaagaaggcggcgcagaagaaggcggcggcggcggcaaagagaggtgggaaggcggcggcggcagctgcttcgtcaaaggcggctgcggccgacaacggagccgataagctggccaacggagtcgggtcgatgcatatctcggatcggaattgcaccggcgtgctctgctcgcatccactttctagagatatccgcattgagtctctgtcagttaccttccatgggcatgatctgatagttgattctgaactggagcttaattacggaagacgctatggtttgcttgggttgaatgggtgtggtaaatccaccctcctaactgccatagggctccgagagcttccaattccggatcacatggatatctatcatctcagcagggaaattgaagcttcagacatgtcttcacttgaggctgtcattagctgcgatgaggagaggataaagttggagaaagaagttgaagaactggcagctcaggatgatggcggtggagagcagcttgaacgcatttatgagcgccttgaagcattggatgcagcaactgcagagaagcgtgctgctgaaattctttatggtcttgggtttgacaagcagatgcaagcgaagaaaactcgggatttttctggtgggtggagaatgaggattgcacttgcacgtgctctttttataaacccaaccatcttgttgcttgatgagcccaccaatcatcttgatctagaagcttgtgtgtggttggaggagatgttgaagaattttgagcgaatcctggttgttatttcacactcccaggacttcttgaatggtgtctgcacaaacatcatccacatgcagaacaagaaattgaagatctacactggaaactatgatcagtatgttcagacccgttctgaactggaggagaaccagatgaagcagtacaagtgggagcaggaacagatttctaacatgaaggaatatattgctcggtttgggcatgggtcagcaaaacttgctcgccaggcgcagagcaaagagaaaaccctagcaaaaatggagcgcggtgggcttacagagaaggtggcaagagacagggttctgatcttccgttttgtcgacgtgggaaagctgccgccaccagttcttcagtttgttgaagtctcatttggttacactccagataatctgatctacaagaacatcgactttggtgttgatctggactcgcgtatagctctggttgggccaaatggagctggaaagagtactctcttgaagctgatgacgggggagttgtttccttctgatggcatggtccggcggcacaatcaccttagaattgcccagttccatcagcacttggctgagaagcttgatatggaactgtctgccctagcgtatatgatcaaagagtacccaggaaatgaggaagagaagatgagggctgcaatcggtaggtttggactctcgggcaaggcacaagtaatgccaatgaagaatttatctgacgggcagaggagccgtgtgatctttgcttggttggcgtttaggcagccccagttactgttattggatgagccaacaaatcatttggatatcgagacaatcgactcgctggcggaggcattgaatgagtgggatgggggtctggttcttgttagccacgatttcaggctcataaaccaggtagctcaggagatatgggtgtgcgaaaatcaagccgtgaccaagtggaatggcgatatcatggacttcaagcagcacctgaagataaaagccggtttagccgattgagaccgatatagaagttccgtctcgagtttgtagtagttaatttgctggccttgcttacacttgtatgagacaatatagcgagggtgtttcgtatttccgagccgtcttcggagactcttgactacgacggaagacaagatcggaaacgggcgaaggcttggttattgtttcaagccggcggcagtttctattgccctttgcccggtttgtaggtggtatttttctctacataccctttccgcatattttacttggttagcagccaagttcgattaagattagtactattattatgagatagttgttattttaggtagacactgtttgcctatggtatgtttatgttatactattccctcgaactgaaagggtatgttgtacttatctgcattatttatttataaatactggaatttctatctt

SEQ ID NO: 3896 - DNA, 2248 bp, Euphorbia peplus
tatcatcctctgtttcacctcctacacttccatatcaagccctagctgagctcatctcatcagatccacactttcagctctcgaggatggtttccgacgctagcaaaaagaaggctgcccagaagaaggcggccgctgctgctaaaagaggcggtaaggctgcttctgcgtcgtcgaaacctgagaatggaagtgtcgataagttatcgaatgaggttgatgctcttcagatatccgatcgtacttgtactggtgtgctttgttcgcatcctatgtccagggatattcgtattgagtctttatcagttaccttccatggacatgacctaattgttgattccatcctcgagcttaattatggcagacgatacggattacttgggttaaatggctgtggaaaatcaacactcttaacttcaatagggtgccgtgaactaccaattcctgatcacatggatatttatcacctttcaagagaaattgaagcttctgatatgactgcacttgaatctgttattagctgtgatgaggagaggttgaaattggagaaggaagttgagatgttagcagcacaggatgatggaggtggtgagtctcttgatagaatatatgaacgattggaggctttggatgcagcaactgcagaaaagcgtgctgctgagatcttgtttggtctcggttttaacaagaagatgcaggcaatgaaaacccgagatttttctggtggttggaggatgaggattgcattagcccgggctctgttcatgaatccaacaatcctcttacttgatgaaccaacaaatcatctagatttggaagcctgtgtctggttggaggaaactctgaagaaatttgatcgcatcctagttgtggtatcacattcccaagatttcttgaatggtgtctgcacaaatattatacacatgcaaagcaagacattgaagatctacactgggaattatgatcaatattgtcagacacgtaatgacctggaggagaatcaaatgaagcagtacaagtgggagcaagagcagatttcttcaatgaaggagtacattgctcgatttgggcacggttcagcaaaattagctcgacaagcacaaagcaaggagaaaactcttgcaaaaatggagcgcggtgggcttacagagaaagtagcgagagacaaggttttgacctttcgctttgtggatgtggggaagctcccaccacctgtccttcagttcgtggaagtttcctttggttatacacctgacaatctgatatacaaaaatctcgactttggagtggatttggattccaggattgctttggttgggcccaatggtgccggtaagagtacactgctgaagcttatgactggggagttgggaccttctgaaggcatggttcgacgtcacaatcacttgaggattgctcagtatcatcagcacttggctgagaagctagacatggaaatgtctgctttactatatatgataagagagtatccagggaacgaggaagaaaaaatgagagcagcaatcggaaggttcggattgactggaaaagctcaagtgatgcccatgaagaatctctccgatgggcagagaagcagggtgattttcgcttggctagcctttaggcaacctcagttgcttcttttggatgaaccaactaaccatttggatatcgagaccatagactcactggctgaagcattgaatgaatgggatgggggtctggtcctggttagtcacgatttccggcttataaaccaggttgcacgtaatatatgggtttgtgaaaatcaagctataactccatggcagggtgatattatgcaatttaaggcacacctcaagaaaaaggctggcttgtccgattgagacatgagctctcattcatcgagttagtcgtatcgtgagcatggctgcctcctcttatggctgtgaatcgtagtatttggctttttgcctgttgaggatgatcttatggtctactaaagcagcagagaagagaggcgaaagggcgcaggcagcagctcgttatggtcatagtactttgctcggttcataatcgtattaggcggtatgttttttttctccattatttatgttttgcactatcaagtatattatatgaatacttggttctgctctaaacagacaattttacaaatatttatttatttagggttaaagagtttactattattacagacctcatttgtgcctttcttgttctaaattcaagtatatgttgtact

SEQ ID NO: 3897 - DNA, 2144 bp, Malus domestica
gcccaacccttgcgagcgggtatttgctgctattacctaacataacataccacaaaatatctgtacacccccacctgagatacaatcccagatctgacctccccaccgccctccctttcttccccgatcgtcttctcttctccaaggttgatctttgaaaacgatggtgtcggacgcgagcaagaagaaggcggcccagaagaaggcggcggcggcggccaagagaggtgggaaggcggcggcggcagctgcttcgtccaagtcgcctgcggccgagaacggtgctgataagcttgccaatggagtcggggcgatgcatatttcggatcggaactgcaccggcgtgctttgctcgcatccactttctagagatattcgcattgagtctctgtcagttaccttccatggacatgatctgatagtcgattctgaactggagcttaattatggaagacgctatggtttgcttgggttgaatgggtgtggtaaatccaccctcctaactgcaatagggctccgagagcttccaattccggatcacatggatatctatcatctcagtagcgagattgaagcctcagacatgtcttcacttgaggctgtcattagctgcgatgaggagaggatgaggttggagaaagaagttgaagaactggcagctcaggatgatggcggtggagagcagcttgagcgcatttatgagcgccttgaagcattggatgcagcaactgctgagaagcgtgctgctgaaattctttatggtcttgggtttgacaagaagatgcaagcaaagaaaactcgggatttttctggtgggtggagaatgaggattgcacttgcacgtgctctctttataaacccaaccatcctgttactggatgagcccaccaatcatcttgatctagaagcttgtgtgtggttggaggagatgttgaagaattttgagcgcatcctggttgttatttcacactcccaggattttttgaacggtgtctgcacaaacatcattcacatgcagaacaagaaactgaagatgtacactggaaactatgatcagtatgttcagacccgttcggaactggaggagaaccagatgaaacagtataagtgggagcaggaacagattgctaacatgaaggaatatatcgctcggtttggacacgggtcagcaaaactagctcgccaggcacaaagcaaagagaaaaccctagcaaaaatggagcgtggtgggcttacagagaaggtggcaagagacaagattttaatcttccgttttgtcgatgtgggaaagctgcctccaccagtgcttcagtttgttgaagtctcatttggttacactcctgataatttgatctacaagaacattgactttggtgttgatctggactcacgtatagctctggttgggccgaatggagctggaaagagtaccctcttgaagctgatgacgggggagttgtttccttctgatggcatggtccggcggcacaatcaccttagaattgcccagttccatcagcacttggctgagaagcttgatgtggaactgtctgccctagcgtacatgatcaaagagtacccaggaaacgaggaagagaagatgagggctgcaattggtaagtttggattatcgggtaaggcacaggtaatgccaatgaagaacttatctgacgggcagaggagccgtgtgatctttgcttggttggcgtttaggcagccccagttactgttgttggatgagccgaccaatcatttagatattgagacaattgactctctggcggaggcgttgaatgagtgggacgggggcctggttcttgttagccacgatttcaggctcattaaccaggtagctcaggagatatgggtatgtgaaaatcaagccgtgacccggtggggtggcgatattatggacttcaagcagcacctgaagataaaggctggtttagccgattgagaccgatattgaagttccatctcgagcttgttgtagttgatttgttggccttgctgacacctgtacgagacagtacagcgaggagggcgtttactgtttctgagacgtcttctcagactctccgactactatgacggaagacgagatcggaaatgggccgaggcttggttattgtttcaagccggcg

SEQ ID NO: 3898 - DNA, 2208 bp, Euonymus alatus
ccagacctttttattgccgactctagggttgtatacttttacagcaacgaaaccctagatctaaccgcaccgtcggaaatccacctccccaggttaaagatggtatctgacgcaagcaagaagaaggttgctcagaagaaggccgcggctgccgccaagagaggtggtaaggccgccggctcctctaaggctaaggctgcgtcggactcacagaacggaggtgttgccaaggtttccgacggacttgcggctttccatatatctgatcggacttgcacgggcgtgctttgctcgcatccactatctagggatattaggatcgagtctttatctgttacttttcacggacatgatctcatcgttgattcagaactcgaactgaattatggcagacgatatgggttgcttgggttaaatggatgtggaaagtcaacccttctaacggcaatagggtgtcgtgagctcccaataccagatcacatggatatttatcacctcagtagagagattgaagcttctgacatgtcttcacttgaggctgtcataaactgtgatgaggagagattgaagttggagagggaagctgaagttttagcagcgcaggacgatggtggtggagaggccctggagcgtctatatgagcgtttggaatccatggatgcatcaactgccgagaaacgcgctgctgaaattttgtttggtcttggtttcaacaaagagatgcaggcaaagaaaacacgtgatttttctggtggctggagaatgaggattgcattagcacgagctttatttatgaaaccgacagttctgttgctcgatgagcctaccaatcatcttgatttggaagcttgtgtctggttggaggagacccttaagaaatttgaccgcattttggttgtggtatcacactcccaggacttcctgaatggtgtctgcacaaatatcatacatatgcaaagcaggaagttgaagctctacactggtaactatgatcaatatgttcagactcgttctgcactggaagagaatcagatgaagcagtacaggtgggaacaggagcagatttcttccatgaaggagtatattgcccgttttgggcatggttcagccaaactagctcgacaggcacagagcaaagagaaaactcttgcaaaaatggagcggggtggtctcactgagaaggtggctagagacagtgttctggtcttccgttttgttgatgttgggaagcttccccctccagtccttcagtttgttgaagtaacttttggctatactcctgagaatctcatctacaagaatattgattttggggtggacttggattcaagaatagctctggttggacccaatggtgctgggaagagtacgttgctgaagctgatgacaggggatttgtttcctattgagggcatggtccggcgtcataatcaccttagaattgctcaataccatcagcacttggctgagaaacttgatttggaactgtctgctcttatgtatatgatgcgggaatacccaggaaatgaggaagagaagatgagggctgctattgggaagtttggactcactggcaaagcacaggtgatgccaatgaataatctgtctgatggacagaagagccgggtaatctttgcatggctagcatacaggcaacctcaattactactactggatgaaccaactaatcatttggatattgagacaattgattcactcgccgaggcattgaatgaatgggatgggggcatggttcttgttagtcacgatttcaggcttatcaatcaggttgctaaggagatttgggtgtgtgaaaatcaagctgtcaccaggtgggagggtgacattatggatttcaagcggcaccttaagagcaaggctggtttgtttgattgagccagataggacgagtttgaagattacagtacttctcaggctgctgcatcctggcctacaagccctctcctccatgtggggggttggataatttttaccaagggtggattagggtagtgatgagcgctgagtgggaggctacagtattgtttggagctgacagatgacattatcgtctgctctgttagcccatggttttgttgtttttgatttattttacgttcgtccgtattcttggatgttgaaccagattatatgaacaagtatttatcagttatattttatatgttgcactctaaagcatacttcatg

SEQ ID NO: 3899 - DNA, 2328 bp, Actinidia deliciosa
  misc_feature (1221)..(1221): n is a, c, g, or t
cctctctcttgtccccccctccccgagaagagaaaaggttcactgaaacagcgtaacaccaaaccctagatctatctgctctgtctccgaccgatcaccgatctctcctcagatctaatttctcaattcttcaagatggtgtcggacgcgagcaagaagaaggcggcgcaaaagaaggcagcggctgctgcgaagagaggcgggaaggctgcagcggctgccacctcgtcaaaggcggcggccgattcacagaacggaggcggcgttaatagcttagcgaatggggtggactcgcttcagatatcggatcggaattgtactggcgtcctctgttcacatcctctttccagagatattcggatagagtctttatctcttactttccatggacatgatcttatcgttgattctgaactggaactcaattatggaagacgttatggtttgcttggattgaatggctgtgggaaatctacccttcttactgcaattgggtgccgagaacttcctattccggaacacatggatatttatcacctctccagggagatagaggcttctgatatgtcctcacttgaggctgtcataagttgtgatgaggagaggttgaggttagagaaagaagctgaagctttggcaggacaggatgatggtggtggagaggctcttgaacgcctttatgagcgtttggacgccatggatgcatcaactgcagagaaacgtgctgctgagatcttgtttggtcttggatttaacaagaaaatgcaagaaaagaaaacacgtgatttctctggtggatggagaatgaggattgctttagcacgggctctgtttatcaacccaacaatcctgttactcgatgaacccaccaatcatcttgatttggaagcttgtgtctggttggaggaaactttgaagaaatttgaccgtattctggtggtggtttcgcactcccaggacttcttgaatggtgtttgcaccaatatcatccacatgcaaagcaagagcttgaagctttacacggggaactatgatcagtatgttcaaacccgttctgagcttgaagaaaaccaaatgaaacaatacaagtgggagcaggagcagattgcttcaatgaaagaatatattgctcgatttggacatggatcagcgaaactagctcgccaagcacagagcaaagagaaaaccttggcaaaaatggagcgaggcggacttacaganaaggttgccagagataaggttctggtttttcgattttctgatgtgggaaagcttcccccacctgtattacaatttgtggaagtcacatttggttacacacctgagaatctcatctacaagaatatcgactttggggtagatttggactcaagagtagctctagtggggcccaatggagctggaaagagtacgctgctgaagctgatgacgggggatttggttccccttgatggcatggtccggcggcacaaccatctcagaattgcacagttccatcagcatttgggtgagaaacttgacctagaattgtctgctctccattttatgattaaagagtacccaggaaatgaggaggagaagatgagggcggcaatagggaagtttgggcttacgggcaaagcccagatcatgcccatgaagaatctgtctgatgggcaaaagagccgggtgatttttgcgtggctggcgtggagacagccccagatgctgctgttggatgaacctaccaaccacttggatatcgaaacgatcgactcattggctgacgcattgaacgagtgggatggtggcctggttcttgttagccatgattttaggctcattaaccaggtggcccacgagatttgggtttgtgaaaatcaagctgtgacccgatgggagggggatattatggccttcaaggaacacttgaggagcaaggctggtctatctgattgaagctgattttatgatgcctcgtttcatttatatttagtagcagtgtaccttgggcaatggttctaggcactgcaacgtaggacccgggatccttcaacgtgttctctcctggtggattatgacgaaacctaagagagcagaggagatgattgcggcttggttagtttcattggccttggtactcttcttgattactataaattttgttttacttatctatcatcttatgcatttataattatattattcttggttttggaccaagggggatccatatcggcattctttgtggacgagatgccaatatgaacctctatgtttgttaacgtacaatttgaattgagtatttactttgaacttatgaaacttgttcgttcttgttaaaaaaaa

SEQ ID NO: 3900 - DNA, 2523 bp, Eucalyptus grandis
atggggttgggggaggggggcgaaaagtccgagctgccctcatccgtcccgctgcctcccgacacgtggccgcgtcgagtccctaaccctcgcgcgagtccgacgatctcacacgccatcctcgtcccctataaatacctcgcgatctcccccctctttcctccccaccaccattcccgaaatcctcccccatccgcgacggtgcggtcgatcgaaacacccccgacatcggcggagccgccaccgcgctcggaaaccctaaagatcgtccccccgcttccgcctcccaggtactcgcgaatgctctcgcgccgatcgggtttgcttgcttcttgtcattttttggggctgttgaagatggtgtcggacgcgagcaagaagaaggccgcccagaagaaggcggcggccgcggccaagaggggaggaaaggccgcggcggcggccacctcgtcgaaggcggcggcggcgtccgctgccgaggcgcagaacggggccggcaagctggccgacggcatcgggagtatggtcatttcggatcggacgtgcaccggggtgctctgctcgcatcctctctccagggacatccgtatagagtctctctcacttacattccatggacatgatcttattgttgattctgagctggagcttaactatggcaggcgatacggtttgcttggattaaatggatgtgggaaatccacactcctatctgcaattggttgcagagagcttccaataccagaacacatggatatatatcatttgagtagggaaattgaagcttctgacatgtcttcactcgaggctgtcattagctgtgatgaggagagattgcaattagagaaagaagctgaagccttggcagcacaggatgatggtggtggagaagctctggatcgtctttatgagcgcttggaagctatggatgcagcgactgcagagaaacgtgctgctgagatattgtatggtctcggctttaataagaagatgcaggcaaagaagtctcgagatttctctggtggctggagaatgaggattgcattagcacgagctctctttatgaatcctactatcttgttgcttgatgaacctactaaccaccttgatctggaggcttgtgtctggcttgaggagacattgaagaagtttgagaggatccttgttgtggtatctcattcacaggattttctgaatggtgtttgtacgaacatcattcacatgcaaaataagaaactgaagatctatactggcaattatgatcagtatgtccagacccgttctgaactggaagaaaatcagatgaaacaatacaaatgggaacaggagcagatttcttccatgaaggaatacattgcccgctttgggcatgggtctgcaaaattggcccgtcaagcccagagcaaagaaaagactctagccaagatggagcgtggtgggcttactgaacgggttgtgagggacaaggtcctagttttccgctttcctgatgttgggaagcttcccccaccagtgctccagtttgtagaagtaacctttggttacacacctgacaatcttatctacaagaatcttgattttggggttgacttggattctagagttgctctggtgggacctaatggagcaggaaagagcacgttgctgaagctaatgacaggggacttggtacctctagatggcatggtccggcgacataatcatttaaggattgcacagttccaccaacacctgaccgagaaacttgacttggatttgccagcactccagttcatgatcaaagagtaccccgggaatgaggaggagaagatgagggcagcaattggcaagtttggtctgactggcaaggcccaggtgatgcccatgaagaacttgtctgatggtcaaagaagccgagtgatctttgcatggttggcatggaggcagcctcacatgcttttgctggatgagccgactaaccatctggatattgaaacaattgactctctggctgaggcattgaatgagtgggatgggggcttggtgctggtgagtcacgatttcaggctcataaaccaggtggctcatgagatatgggtgtgtgaaaatcaggcagtgactcggtgggagggtgatattatggagttcaaggagcacctgaggagtaaggctggcttatcagactgatccccctctagtaatgttatattgcaaaacagggtttgtcacactatcgatacccactgctcaaggctaaagcatggatctgctatcccagttgccgtgcaagccattagggcaggaagagaggtagtgtatggcttggttattatttcaagcctacatgtgacctccacatgatatttttctgtgtttactggtcccttactgctagcaatttatcactgtagcatggcaagacctacttctagattttgctggatgaatacttatgtcggttctgttgagtttgagtacaacactagagtatgagattgtactactatactttctccattaaatattatttcggttttcttactt

SEQ ID NO: 3901 - DNA, 2409 bp, Amsonia hubrichtii
caattctcggacatcgtctcccattttctctgcagtcggaggtaaaagggcaaacgaaacacctgaaaacactcaaaccctagatcttgaagatggtgtctgacgcgagtaagaagagggaggcacagaagaaggcagcggctgcagctaagagagcagggaagtcaggtgcctcgtctaaggcagttaaggaggctgcggcggctgccactgccactgctgcaggggagaatggaagtgcggataatttggcaaatggagttggggcgcttcaaatatcggatcggacttgcaccggtgtgctttgctcgcatccattatcaagagatattcggatagagtctttatcactcactttccatggacatgacctaattgtggattcagaactagagctaaactatggcagacgttatggtttgcttggactgaatggctgtgggaagtctactctccttgctgccataggatgtcgagaattgcccattccggatcatatggacatttatcaccttactagagagattgaagcatctgatatgacttcacttgaggctgtcataaattgtgatgaggagaggttgaaattggagagagaagctgaagccttgggtgcacaggaggatggtggtggagagcaacttgaacgcatttatgaacgtctggaagcactggatgcagcgactgctgagaagcgtgctgccgagattttatatggtcttggttttgacaagatgatgcaagcaaagaagaccagggacttttctggtgggtggagaatgaggattgctttagcaagggctctgtttatgaatccaaccatattattgctggatgaaccgacaaaccacctagatttagaggcttgtgtctggttagaggaaactctgaagaagtttgaccgtatattggtcgtggtgtcacactcccaggattttttgaatggtgtgtgcaccaacatcatccacatgcagaataagaagttgaagatctatactggtaattatgaccaatatgtccagactcgtgctgaactagaagagaaccagatgaaacagtacaaatgggagcaggagcagattgcttcaatgaaggagtacattgctcgatttggacatgggtcagccaagctagctcgtcaggcacagagcaaagaaaaaactttggccaagatggagcgaggtggcctcacagagaaggtgatcagggacaaggttttggtgttccgctttcatgatgttgggaagctccccccgcctgtcctacagtttgtggaagttgcatttggttatacacctgattatctcatttacaagaaccttgactttggtgttgaccttgactcaagggtagcattggtgggccccaatggtgctggcaagagcacactgttgaagctgatgacaggggatttagttcccactgatggcatggtccgcaggcacaaccacttgaggattgcacagttccatcagcatttgactgagaaacttgacatggagatgtcagcactccagtttatgataaaagagtaccctggaaatgaggaggagaagatgagagcggcaattggaaagtttgggctctcgggcaaagctcaagttatgcccatgaaaaatttgtcagatggtcagaggagcagggtaatctttgcatggttagcttggaggcaaccccatatgctgctcttggatgaaccaactaaccacttggatatcgagacaattgattcgctggctgaagctttgaatgagtgggatggaggtttggtcctcgttagtcatgattttaggcttataaatcaggttgctcaagagatctgggtatgtgaaaatcaggctgtgaaacggtgggagggtgacatcatggactttaaggagcatttgaggcaaaagtctggtttatttgattgaaactgatgatctattccaatcatatgctatctacggtttgctacttcctggattagcttgtatgcatagagtggattatgacgaaagcaggcagagggaagaggtgattatttgttcatcgccctcttttgagtactctccaattgatcgttagagctactggtttccgttatttcatagtactacttgtatttgctatatgttccttgattgtggatgaaggagaaaagatggcagcacataggtggatgtcattgtggatcttgggccactttattttgctctatatatggatacgaattagatgacatgttactattgtactcatcagttgattttccagtgtattgctgggtctttttgtagtaaagtagtgctgttatatttgattaataagtagaaactggattcctaatttctatagccaactgatttcaaggatggttcataaatagcttgtacagcttcttctgtttcttgcagagaagcaatggtg

SEQ ID NO: 3902 - DNA, 2309 bp, Lotus japonicus
aacccctctttctgcttctcttctctcgcgaaatcttcacctcactagatctgttctctattctcgatccaagagattagaggttgaagatggtgtctgacgcgagcaagaagaaggcggcacagaagaaagcggccgcggcggctaagagaggaggcaaggcggctaccgctgcggcttcgtcgaaagcggcggcgtctgacaaggctgccgacaagctcgctaatggaattgcggatatgcagatttccgatcggacctgtaccggcgtcctctgttcgcatcctctctcgagggatattcggatagaatctctatcagttacttttcatggacatgatctgatagtcgattctgagttggagctgaattatggaagacgttatgggttgcttgggttaaatggttgtggaaaatctaccctgcttacagcaataggtcaccgagaacttcctataccagagcacatggatatttatcaccttaccagggagattgaagcctctgacatgtctgcattggaagctgtcgtgagctgtgatgaggaaaggttgagattggagaaagaagctgaaactttggcagcacaggatgatgggggtggtgaaactctcgaacgtatttatgaacgattagaagccttggatgcatcaactgcagaaaagcgtgctgctgaaattttacacggtcttgggttcgacaaaaagatgcaggcaaagaagactcgtgatttttctggtggctggagaatgaggattgctttagcacgagctctatttatcaacccgaccattcttctacttgatgaaccaaccaatcaccttgatttggaagcttgtgtgtggctggaggagagtttgaagaattttgaccgtattatggttgtgatttcacattcccaggattttcttaatggtgtctgcacgaatatcattcacatgcaaagcaaacaattgaagatgtatactggtaattatgatcaatatgttcagacacgatctgaactggaagagaaccagatgaagcagtacaagtgggagcaggaacagatttccaacatgaaagaatacattgcccgatttgggcatggatcagcaaaattagctcgccaagctcagagtaaggagaaaactcttgcaaaaatggagcggggtggacttacagagaaggtagcaagagactcagttttggtattccgctttgttgacgtgggaaaacttccaccacctgtgctccagtttgttgaagtgtcatttggttacactcctgataatctcatctacaagaacattgactttggagttgatttagactccaggattgctcttgttggacccaatggagctgggaagagtacattactgaaactaatgacaggtgaattgggtcctacagatggcatggttcgacgccacaatcaccttcgcattgcacaatatcaccagcacttggctgaaaagctggacatggaaatgtctgctcttctgtatatgatgagagagtaccctggagttgaggaagagaagatgagagcagctattgggaagtttggactgtcgggcaaagcgcagatcatgcctatgaagaacttatctgatgggcagaggagccgtgtgatatttgcatggttagcttatagacagcctcagatgctacttttggatgaaccaactaatcatttggatattgaaacaattgactcactggctgaagcattgaatgaatgggatggtggtctggtgcttgttagccatgattttaggctcataaaccaggtagcccatgagatatgggtgtgtgaaaatcaagctgtgaaaaaatgggagggtggtattatggacttcaagcgacatctcaaggcaaaggctggtttatctgactaaagtgaagaagatagttagatgggtgttgctgctgctgctgtttaacgattaagaacttatagcacaatgtagggtgggtgttgctgcgtataagtggatttctataatggtgataatagttgagttgattggcaaggaaccggtgtagaaatcggttcaaactttttttgtgccgagaagtcctttcacccccgtaagattggtattatttttgtttttcattatttgttgcgcttatcaaatttggttgcttggttgataaccagcatgatagataacatagtagatgtgatacctatctgaatctactagttgtacacggcttaatttatgaaccatatgtgttgtaccgagagcattatttttacggtaatataaactctcatttttctgctaataattcttcatcctgggtaagttctctta

SEQ ID NO: 3903 - DNA, 2242 bp, Solanum phureja
ctttttttttctgaaaattgatagatggtgtcggatgcgagtaagaagagagaggcgcagaagaaggcagcagcagctgcgaagagaggagggaagtctaaggcggcggtgatgaaggcggcagcggctgcgacagctactccggcggggaggaatgatgtcgatgaattaacgaatggggtaggagatattcagttgtctgatcggacttgtaccggtgttttatgttcacatccactttccagagatattcggatagaatcgttatcacttacttttcacggacatgatcttatagttgattctgaactggagcttaactatggaagacgttatggtttgcttgggcttaatggctgtgggaagtctactcttctttctgctataggatgtcgtgaacttcccatcccagatcatatggatatctttcatctaacgcgggagattgaagcgtctgacatgtcctcacttcaagctgttattagttgcgatgaagagaggttgagattggagaaagaagttgaagtcttggctgcacaggatgatggtggtggagagcaacttgaacgcatctatgagcgtttggaagctttggatgcatcaactgctgagaagcgtgcagctgaaatcctgtttggtcttggatttaacaagaaaatgcaagaacaaaaaacacgagatttttccggtggatggaggatgagaattgctcttgctcgtgccctgtttatgaatccgaccattttgctgcttgatgaacccaccaatcatctagacctagaggcttgcgtgtggttagaagaaaccttgaagaagtttgaccgtattctggttgttgtttcacactcgcaagactttctaaatggtgtgtgtactaacatcatccatatgcaaaataagaagttgaagctctacaccggtaattatgaccaatatgtccaaacccgtgaggagctggaagaaaatcagatgaaacagtacagatgggagcaggagcagattgcttcaatgaaggagtacattgctcgatttggacatggatctgccaaactagcccgtcaagcacaaagtaaagagaaaacactggctaagatggagcgtggagggcttacagagaaggtggcgaaggacaaggttctggtcttccgttttcctaatgttggcaaacttccccctcctgttctgcagtttgtggaagtgacatttggctacacacctgataatctcatttacaagaacctagattttggtgtagaccttgattcaagggtagcactggtgggacctaatggagctggaaagagcactctacttaagctgatgacaggggaattagttccccttgatggcatggttaggcggcataatcacctgcggattgcacagttccaccagcacttggctgagaagcttgacatggaattgtctgctctacaattcatgataaaagagtatcgtgggaatgaggaggagaagatgagggcatcaattgggagatttggccttactggtaaagctcaagtaatgcctatgaaaaacttgtcagacggtcaacgtagccgggtaatatttgcgtggttagcttttaggcaacctcacatgctgcttctcgatgagcccaccaaccatctcgatattgagacaattgactcacttgccgaggctttgaatgaatgggacggtggcatggttcttgttagtcatgatttcaggctcataaaccaggttgcccatgagatatgggtttgtgaaaatcagactgtgacacggtgggagggtgatattatggacttcaagctacatttgaaggcgagggccggattgggtgatgagtgaagcagatgttccaagttttagtactactaggaagtcataatatgactgcttctcctggctaaacgtttagtccgaagagaaattggtcaacatcagcagtagctacagttttagttacaccatgcctagttttatatgccatatgactggactgtgctgttttatttggtgcaatgttttcgcggtccaatttattctggcttttctccattatcatagttcatgaagcgagagaagtagcgggctagcagcagtcagcttgatgcattacataaataccaccacttgttatctatgttgtactattgctatgttgttcttaagaatttaggatttcactgcttttcattttaagtttactacatatgtttgccaagtatgtcattgaagtggtgttttcaacata

SEQ ID NO: 3904 - DNA, 2185 bp, Sorghum bicolor
gtagagttgaggttccccttcttccccctgtcgtctgcttcacattcccacaatcccggtgccgtggtggtggtggtgtgctgcgctgtcgtccctctccgaccttcccgattcttcttctcccttcttctgcgtcaggccgccgcggcatcaccctccccatcctcctcctcaccatggtgtcggacgccagcaagaagaaggccgcgcagaagaaggcggccgccgcagccaagaggggagccaaggtcccggccccttcctcatcctcctcctcctctgccgccgctaaggccgtcgatgccgtcgccgcgctcaagctctccgatcgcacctgcaccggcgtcctcgcctcccacccgctctcccgagatatccacatagagtctctttcattaacgtttcatggccatgaccttattgtagattctgagttggagctcaactatgggaggcgttatggtttgctcggcctaaatggctgtgggaaatctactctgctcaccgcgataggctgcagggaactccctatacctgaacacatggacatataccatctcacccatgagatcgaggcttcagacatgtctgcgctacaagctgttgttagttgtgacgaagaaagagtgaagttggaaaaggaagcggagattttggctgcacaggatgatggtggtggtgatgctttggatcgtgtatatgagcgtctagaagcgattgatgcatcaaccgctgaaaagcgcgctgctgagatattatatggtttaggttttaacaagcaaatgcaagctaagaaaactcgagatttttctggaggttggcgtatgagaattgctttggctagagcactgttcatgaatccaacaatccttttgcttgatgagcctacaaatcatcttgatcttgaggcatgtgtctggttggaagagatgctaaagaaatttgaccgtatacttgttgtcatatctcactcccaggactttctgaatggtgtgtgcactaacatcatccatatgcagaataagaagctcaagttatatactgggaactatgaccagtacgttcagacccgttctgagcttgaagagaatcagatgaagcagttcaagtgggagcaggagcagattgcatcaatgaaagagtacattgcacggtttggccatggatctgcaaagcttgcacgtcaggcccagagcaaggagaaaactcttgcaaagatggagcgtggtgggctcactgagaaggttgttagggataaaatactggtcttccgcttcacaaatgttggcaaacttccaccaccagtgcttcagtttgttgaggtcacgtttgggtacacaccggataatctcttgtacaagaagctcgactttggtgttgacctggactctaggattgcactggttggtcccaatggggcagggaagagcactctcctgaagctgatgacaggtgagctggctccattggacggtatggtgaggcggcacaatcacctgcgcatcgcacagttccatcagcacctggcagagaagctggacctggacatctcggccctgcaatacatgatgaaggaataccctgggaacgaagaagagaggatgagagccgcagtcggtaagtttgggctgtcagggaaggctcaggtgatgccaatgaggaacctgtcggacgggcagaggagccgtgtcatctttgcgtggctggcatacaggcagccgcagctactgctgctggatgagccaacaaaccatctcgatatcgagaccatcgactccctagcggaggcgctgaacgagtgggacggcggtctggtactggtgagccatgacttcaggctgatcaaccaggtcgctcatgagatctgggtttgtgagaatcaggcagtgactaggtgggaaggcgatatcatggatttcaaggaacatttgaggagcaaggctggtctatctgattaactagaagggaaggccttttttttccttctccttggagatttaccccttgtataatgtggtataggcacccaaagttttatctgtgtatcacattcagcaatcaccgagttgttatcgagtattagtagtaatatagatcatccaaacagtgtatcagtatcgagctgagtctcataataagaagcgaaagatttgtagtaataaagcaatattctcgtttcttttcc

SEQ ID NO: 3905 - DNA, 2430 bp, Catharanthus roseus
gttcgcggacactgtctatctctcctccacttttaagttttaattccagtcggaggaaaatacctgagaaaagcactcaaaccctagatcttgaagatggtgtctgacgcgagtaagaagagggaggcacagaagaaggcggctgctgcagccaagagagcagggaagtctggtgcatcatctaaggctgccaaggaggcagcggcggctgccactgccacgaccgcagctgctggggagaatggtacggcgaatgatttggccagcggagtgggggcgcttcagatatcggatcgaacttgtaccggtgtcctttgctcgcatccgttatctagagatatccgaatagagtcgttatctctcactttccacgggcatgacctgatagtggattcagaactggaactaaactatgggagacgttatggtctgcttggattgaacggctggtgggaatctactctcctcactgccataggatgtcgagaattaccaataccctgatcatatggatatataccacctaagcagagagattgaagcatctgatttgtcgtcacttgaggcagtcataaactgtgatgaggagaggttgcaattggagaaagaagcggaagccttggcagggcaggaggatggtggaggagagcaacttgaacgcatttatgaacgtttagaagccttggatgcagctacagctgagaagcgtgctgccgagatcttatatggtcttggttttgacaagaagatgcaagcaaagaaaactagggacttttctggtggttggagaatgaggattgccctagcacgtgctctgtttatgaatcccaccatactattgctggatgaaccgacaaaccatctagatttggaggcttgtgtctggttggaggaaactctgaagaaatttgatcgtatactggtcgtggtttcgcattcccaggatttcttgaatggtgtgtgcaccaatattatccatatgcaaaataagaagctgaagctttatactggtaattatgaccagtatgtccaaactcggtctgagctagaagagaaccagatgaaacaatacaaatgggagcaggagcagattgcttcaatgaaggaatacattgctcggtttggacacggatcggccaagcttgctcgccaggcacagagcaaagagaaaactttggccaagatggagcgaggtggccttacagagagggttgtgagagacaaggttctggtctttcgctttgttgatgttgggaagcttcctccgcctgtcctacagtttgtggaagtttcatttggttatacacctgagaatctcatctacaagaacatcgacttcggcgttgacctcgactcaagggtagcattagtgggccccaatggtgctggaaagagtacactgttgaagctgatgacaggggatttagttccccttgatggcatggtccgcaggcacaaccacctgaggattgcacaattccatcagcacctggctgagaaacttgacatggagatgtctgcactccagtttatgatcaaagagtaccctggaaatgaggaagaaaagatgagggcagcaattggaaagtttgggctctctggcaaggcccaagttatgcccatgaaaaatttatcagatggtcagagaagcagggtaatttttgcttggttagcttggaggcagccacatatgttgctgttggatgaaccaactaatcacttggatatcgagacaatcgactctctagccgaggctctgaacgagtgggatggtggtcttgtgcttgttagtcacgattttaggctcataaatcaggttgctcatgagatatgggtatgtgaaaatcaagctgtgaaacggtgggagggtgacatcatggacttcaaggaacatttaaggcaaaagtctgggctatttgattgagtgaaactggcgattttcatgaggaaatcactatataatagtttagctattccatggatgcagtttgatattgtagtagtagagtgagtgggataatgatgaacataggcgacagagaggaaagaggtgattgttttatcatcaccattttgagtactctaccctgagtgataattgaattctctgatgctattttgatctctatctgctttgtcttccttgatagtggatcaagcatagaagatggaagcagcagcagcagcagcacactagtaggatatcaatcaatactgaacatgcatggatcttgtttactctattattagcagtaccatattttgttgttagattgtgttttactgaaaaaaaagatattattagataaagatttctagtaatactcatttgttgattttccagtatattgctgctgctgctgctgctggggttttgatgagtaagagttggcagggcagagtgttttattatgttttatcaataaatga

SEQ ID NO: 3906 - DNA, 2313 bp, Lippia dulcis
tcgaaggccatcttgctgccgcattgaatattccgagagtaagggaacgaagacgcaaaccctagatcaggaaaatatactttgtgattttccgctgcaggcaatatcctcgataattcaagatggtgtccgatgcgagtaagaagaaggcacttcagaagaaggctgcggctgccgccaagagaggaggcaaggctgcggcggctgccgcctcatctaaggctgctgcccttgagaacggtaacaaagtcaataatttggcgagtggggtgggggatcttcagatatctgatcggacgtgtaccggagttttgtgttcgcatccgttgtccagagatattcggatagagtctctctcactcactttccatgggcatgaactaatagttgattctgaactggaactcaattacggaagacggtatggtttgcttgggttaaatggctgtgggaagtctactcttcttactgccataggatgccgagagcttccgatcccagatcacatggatatttttcaccttactagggagatagaagcttctgatatgtcttcacttgaggctgttattagttgtgatgaggagaggctgcaattggaaaaagaagctgaagcattggctggacaggatgatggtggtggtgaacaactcgagcgcatttatgaacgtttggatgctatggatgcatcaactgctgagaaacgagctgctgagatcctatttggtcttggctttaccaagaaaatgcaagaaaagaaaacacgcgacttttctggtggttggaggatgagaatcgccttagcaagagcccttttcatgaacccaaccatattgttgcttgatgaacctacaaatcatcttgacttggaggcttgtgtctggttggaggagacgttgaaaaagtttgagcgcattctcgttgttgtttcacattcccaggatttcctgaacggggtttgcaccaatataatccatatgcaaaataagaagttaaagatatacacaggcaatttcgatcaatatgtccaaacccgctccgaacttgaagagaaccagatgaaacagtacaggtgggagcaagaacagatagcttcaatgaaggaatacattgcacggttcggtcacggttcggctaaattagcccgtcaggcccaaagtaaagaaaaaactctagccaagatggagcgtggtggtctcacggagaaggttgtgagagataaggttcttgtcttccgatttgctgatgtgggaaagctccctcctcctgtccttcagtttgtggacgttacatttggctacactcctgataatctcatctacaaaaaccttgactttggtgttgaccttgattcaagagtggcccttgtgggacccaatggtgctggaaaaagtacccttctgaagctgatgacgggggatttggttcctcttgatggcatggtgcggcgccacaaccatttaaggattgctcagttccaccagcatctgactgagaagctcgaccttgatatgtctgctctggcatatatgatgaaagagtatccaggaaatgaggaagagaaaatgagagcggcagttggtcgatttgggctcacaggcaaagctcaaattatgcctatgaggaatttgtcagatggacaaagaagccgtgttatctttgcatggcttgcatttaggcagccccagatgctgcttttggatgagccgactaaccatttggatattgagacaattgactctcttgctgaggccttgaacgaatgggatggtggtttagttcttgttagccacgattttaggctgataaaccaggtggcacatgagatatgggtgtgtgaaaatcaggccgtgacgagatgggagggagatattatggacttcaagcaacatttgagggcgaagtctggtttgtttgaatgagtttagagagagtatggaggccgcagtcagttttggttggctattgctctttagcgctggacctgaagatgatgtaatgttctattcagtgggctctgaggaaatgagcgactcttgattggtcaattattgtgaaggtgctgcttcaagttcccttggtaggagagaatggaagaatgagtttatagatagctttctttatgaatggatgttgtgatattcttacctactactactaaccttggttgctgaagcagctagaggggttagagagagcaggtctgatgagtatctttattttgcgtattattatatatgaaaattaatttgatattgtacttgagaacatttggatggtctttctgccattgacttatctggtattcttaat

SEQ ID NO: 3907 - DNA, 2351 bp, Fragaria vesca
aaaaacctcgaacccaacccgacccaacctctctctctctctcgggtttaaccgactcgctcaccacctgagactaatcccagatctgactcccaccgccgagctctcttctccgatcgcctcctaggttgattatttgataagatggtctccgacgcaagcaagaagaaggcggctcagaagaaggcggcggcggcggccaagagaggtggaaaggcagcggcggcggcttcgtcaaaatctgcgtccgagtcgcagaatggagctgataagctcgccaatggagtcgaatcgatgaggatatcggatcggaattgcactggcgtgctttgctctcaccctctttccagggatatccggattgagtctctatcagttactttccatgggcatgatttgatagttgattctgaactggagcttaattatggcagacgttatggtttacttgggttgaatgggtgtggtaaatctaccttgctgactgcaatagggtgccgagagcttcctatcccagaacacatggatatctttcatctcagcagggaaattgaagcttcagacatgtcttcactagaggctgtcattagctgtgatgaggagaggattagattggagaaagaagttgaagaattggcagctcaagatgatggaggtggagagcagcttgaacgcatttatgagcgtcttgaagctctggatgcagcaactgcagagaagcgtgccgctgaaatactctatggtctcggttttgacaaacagatgcaagcaaagaaaactagagatttctctggtggttggaggatgaggattgcacttgcacgtgctctatttatcaacccaacaatcctgttgcttgatgagcctactaatcatcttgatctcgaagcttgtgtgtggttagaggagactctgaagaaatttgaacgcatcttggttgtggtttcacattctcaggatttcctgaatggtgtttgcacaaatatcattcacatgcagagcaagaaactgaagatctactctggaaactatgatcaatatgttcagacacgttcagaacttgaagaaaaccagatgaaacagtacaagtgggagcaagaacaaatttctaacatgaaagagtacattgctcgttttggtcacgggtcagcgaaactagctcgccaggcacaaagtaaagagaagacgctagctaaaatggagcgtggtgggcttactgaaaaggtggccagagacaagattttagtctttcgctttgttgatgtgggaaagctgccaccacctgtgcttcagtttgttgaagtctcatttggttacactcctgataatctgatctacaagaacatcgactttggtgttgatttggattcgcgtgtcgctctggttggccccaatggagctggaaagagtactctcctgaagctgatgacgggggaattgactcctcttgatggcatggtccggaggcacaatcaccttaggattgctcaattccatcagcacttgactgagaagcttgacatggagctgtctgccctccagtttatgatcaaagagtacccaggaaacgaggaagagaagatgagggcttcaattggtaaatttggactaacaggcaaagcacaagtgatgccaatgagtaatttgtcagatgggcagaggagccgtgttatctttgcttggttggcgtttaggcaacctcagatgcttctgttggatgagccaactaatcatttggatattgagacaattgactcactggccgaggcgttgaatgagtgggatgggggtctggttcttgttagccacgatttcagactcataaaccaagtagctcatgagatttgggtatgtgaaaatcaagctgtgacccggtgggagggtgatattatgcaatttaaaaatcacctcaagtcaaaggctggtttaggtgattaagtattgcggcagcctcagagaagtttcataagcttttgtagtttatttgttgaccttgcttactacacttgtatgagacacaatgtcttctcggagtgaactatgatgggaaccaagagcataatgggtgaagaaggcttggttattgtttcgagcagtggcagtttctgtgccctggcccagtttgtgcaggggttatttttgttgctttcattttgcatgctttttctttgctcttctattttacttggttattaaccaggtcgattaagttatattttaggtagatacaatgtctatgaggcttgttctattctctgaaatggtatgtttgtactttcgtagcatattctatgacattgagtttctattttatttcttagccaatgagatcaacaaaaatatcgtttaat

SEQ ID NO: 3908 - DNA, 2163 bp, Vinca minor
aaagcaaacgaagaacctgaaaactctcaaaccctagatctcaaagatggtttctgatgcgagtaagaagagagaggcacagaagaaggcggccgccgccgctaagagagctgggaagtctggaacatcatctaaggcagtcaaggaggcgtccgccgccgcagctgctggagagaatgggaacgcagataatttggccgatggagttggggcgcttcagatatcggatcggacttgtaccggtgtcctttgctcgcatccgatgtctcgagatatccgaatagagtctttatcactcactttccacggacatgacctgatagtggattcagagctggaactaaactatggcaggcgttatggtctgcttggattgaatggctgtggaaagtctactcttctcagttccataggatgtcgggaattaccaatcccagatcatatggatatttttcaccttaccagagagattgaagcatctgatatgtcttcacttgaggctgtcataaactgcgatgaggagaggttgaagttggagaaagaagctgaagcattggctggacaggacgatggtggcggggagcaacttgaacatatttatgaacgtttggaagcattggatgcagcaactgctgagaagcgtgctgccgaaattttatttggtcttggttttgacaaaaagatgcaagcaaagaaaaccagggacttctctggtggctggagaatgaggattgctctagcaagggctctgtttatgaatcctaccattctattgcttgatgagccaactaaccatctagatttggaggcttgtgtttggttggaggaaactttaaagaactttgaccgtatactggttgtggtctcgcactcccaagattttttgaatggtgtgtgcaccaatatcatccatatgcagaataagaagctgaagaattatactggtaattatgaccagtatgtccaaactcgttccgaactagaagagaaccagatgaaacaatacaaatgggagcaggagcagatagcctcaatgaaggagtacattgctcgatttggacatggatcagccaaactagctcgtcaggcacagagcaaagaaaaaactttggccaagatggaacgaggtggtcttactgaaaaggtggcgagagaccagattttggtgttccgctttcctaatgttgggaagcttcctccaccagtcctacagttcgtggaagtttcatttggttatacacctgagaatctcatatacaagaacattgactttggtgttgacctggactcgagggtagcactggttggccccaacggtgctggcaagagcacactgttgaagctgatgatgggggatttagttcccaatgatggcatggtccgcaggcacaaccacttgaggattgcacaattccatcagcacttggctgaaaaacttgacttggaaatgtcagcactcttgtttatgataagagagtaccctggaaatgaggaagagaagatgagagctgcaattgggaagtttgggctttcgggcaaagctcaagttatgcccatgaaaaatttatcagatggtcagaggagcagggtaatttttgcgtggttggctttcaggcagccacacatgctgttactggatgagccgactaaccacttggatatcgagacaattgactcgcttgctgaggctttgaatgagtgggatggtggtctggtgctcgttagtcacgattttaggctcataaaccaggttgctcatgagatctgggtatgtgaaaatcaggctgtgaaaccgtgggatggtgacatcatgggctttaagcagcatttaaggcaaaagtctggtctatatgattaaaacttaatatcagatcgcgatcattatacagttcgctacttcctggatgcagttggatgtgtagcagagcggattattgacaaaagcaggccatgagaggcaaggaggtgactttattcattcaccattttgggtacttctcctgagcttatgcaacttcaaatgttattttagggcatatgtatacgctctctcttttcttggctgtggatcaaggagaaaggcagcagcacactagtaggattttcatgaccatctatatatcgatacgctatgattagataatgtctttctgttgtactcat

SEQ ID NO: 3909 - DNA, 2481 bp, Solanum lycopersicum
aatttacgcaacttaaataagaagagaaattctaaaaagcatcaccgatcaaattctcctgaacttcaacagtaaaactgacacgtgtatcatcttcttcccacaatcttcttataaatattcatcaaacttctccttcaacactcaaaaccctcatacacatctgattattgcaacttttttccagatggtgtcggatgcgagtaagaagagagaggcgcagaagaaggcagcagcagctgcgaagagaggagggaagtctaaggcggcggtgatgaaggcggcagcggctgcaacatctactccgtcggagagtaacggtgtcgatgaattgacgaatggtgtaggagaaattcagttgtctgatcggacctgtaccggcgttttatgttcacatccactttccagggatattcggatagaatcgttatcacttacttttcatggacatgatcttatagttgattctgaactggagcttaactacggaagacgttatggtttgcttgggcttaatggctgtgggaagtctactcttctttctgctataggatgtcgtgaacttcccatcccagatcatatggatatctttcatctaacgcgggagattgaagcgtctgacatgtcctcacttcaagctgttattagttgcgatgaagagaggttgagattggagaaagaagttgaagtcttggctgcacaggatgatggtggtggagagcaacttgaacgcatctatgagcgtttggaagctttggacgcatcaactgctgagaagcgtgcagctgaaatactgttcggtcttggatttaacaagaaaatgcaagaacaaaaaacacgagatttttccggtggatggaggatgaggattgctcttgctcgtgccctgtttatgaatccgaccattttgctgcttgatgaacccaccaatcatctagacctagaggcttgcgtgtggttagaagaaaccttgaagaagtttgaccgtattctggttgttgtttcacactcgcaagacttcctaaatggtgtgtgtactaacatcatccatatgcaaaataagacgttgaagctctacactggtaattatgatcaatatgtccaaacccgtgaggagttggaagaaaatcagatgaaacagtacagatgggagcgggagcagattgcttcaatgaaggagtacattgctcgttttggacatggatctgccaaactagcccgtcaagcacaaagtaaagagaaaacactggctaagatggagcgtggagggcttacagagaaggtggcaaaggacaaggtcctggtcttccgttttcctaatgttggcaaacttccccctcctgttctgcagtttgtggaagtgacatttggctacacacccgagaatctcatctacaagaacctagattttggtgtagaccttgattcaagggtagcactggtgggacctaatggagctggaaagagcacgctacttaagctgatgacaggggagttggttccccttgatggcatggttaggcggcataatcacctgcggattgcacagttccaccagcacttggctgagaagcttgacatggaattatctgctcttcagttcatgataaaagagtatcctgggaatgaggaggagaagatgagggcatcaattgggaggtttggccttactggtaaagctcaagtaatgcctatgaaaaacttgtcagatggtcaacgtagccggattatatttgcgtggttagcttttagacaacctcacatgctgcttctcgatgagccaaccaaccatctcgatattgagacaattgactcacttgccgaggctttgaatgaatgggatggtggaatggttcttgttagtcatgatttcaggctcataaaccaggtcgcccatgagatatgggtatgtgaaaataaaactgtgacacggtggaagggtgacattatggacttcaagctacatttgaaggcgagggccggattgggtgatgagtgaagcagatgttccaagttttagtacactactagcaagtcataatatgactgcttctcctggctaaacattatcagcagcaggccagcagtagctacagttttagttacttacaatgcctagtttttctatatgcatagagaagattaagaagtaaccgtggtcaccatatgactggactggctgttttatgtggtgcgatgtttttgcggtcctatttattctggcctttgtccattatcatagttcatgaagctaaagacgtagcgcgctagcagcagtcagcttgatgcattgcataaatatcaccactctatactgttcttaagaatttagttcagtgctattatggatttaccttttcattttaagaggtgtactacatatgttggccaagtattgtcattgaagtgttgtttcaaaatatgtttacctgtaatgacacttgatcatagtattaatatatattattccctctgctgaat

SEQ ID NO: 3910 - DNA, 3283 bp, Solanum lycopersicum
ggctaactgattttgtgtgaggtttgcagaataagagcagcatcaagaatattgaaggcgagaagaagaacgaagaacagcaccaggagaagaaggaaggaggaaagaatgaacagaacaatcgaaatgtggttttgaaagtggagtttcattgccaaggttgcgtccgtaagattctcaaaaccgttcgaagctttgaaggcgtggagaaggtgacctgtgatagcgaagccaataaggtgacggcaatcggagaagtggatgcattgaagctaaaggagaagttggagcgaaagatgaacaggcctgtacaacttatctctcctttaccaaaggattgtaagaaagagaagaagcagaatgaaaatgactcaaagagtagcaaaggagacgacaagaaaaccaaagagaaagagcctccggtaaccactgtggaactgaaattgcatctacattgcgaaggatgcatccagaagattcaaaaaacaataactaaaaacaaaggttacaaggagatgaaaattgatcacgaaaaggagttgatgacagtgacaggttcaatggacatgaaggaactggtagaggcactgaagaagcagctgaagaaagatgtccaaattgtcccgtcaaagaaggaaggaggagagaagaaagaaggcggaggtggagggaagggaaacgaaaaagggaaggatgggcaaggcggcggcggcggcggcggcggcgagaagagggagcagtatgagtacccggagctggatgcaactgcaattcatgctactcagcttttcagtgatgaaaatgctaatgcttgcagtattataagagaaattctaaaaagcatcaccgatcaaattctcctgaacttcaacagtaaaactgacacgtgtatcatcttcttcccacaatcttcttataaatattcatcaaacttctccttcaacactcaaaaccctcatacacatctgattattgcaacttttttccagatggtgtcggatgcgagtaagaagagagaggcgcagaagaaggcagcagcagctgcgaagagaggagggaagtctaaggcggcggtgatgaaggcggcagcggctgcaacatctactccgtcggagagtaacggtgtcgatgaattgacgaatggtgtaggagaaattcagttgtctgatcggacctgtaccggcgttttatgttcacatccactttccagggatattcggatagaatcgttatcacttacttttcatggacatgatcttatagttgattctgaactggagcttaactacggaagacgttatggtttgcttgggcttaatggctgtgggaagtctactcttctttctgctataggatgtcgtgaacttcccatcccagatcatatggatatctttcatctaacgcgggagattgaagcgtctgacatgtcctcacttcaagctgttattagttgcgatgaagagaggttgagattggagaaagaagttgaagtcttggctgcacaggatgatggtggtggagagcaacttgaacgcatctatgagcgtttggaagctttggacgcatcaactgctgagaagcgtgcagctgaaatactgttcggtcttggatttaacaagaaaatgcaagaacaaaaaacacgagatttttccggtggatggaggatgaggattgctcttgctcgtgccctgtttatgaatccgaccattttgctgcttgatgaacccaccaatcatctagacctagaggcttgcgtgtggttagaagaaaccttgaagaagtttgaccgtattctggttgttgtttcacactcgcaagacttcctaaatggtgtgtgtactaacatcatccatatgcaaaataagacgttgaagctctacactggtaattatgatcaatatgtccaaacccgtgaggagttggaagaaaatcagatgaaacagtacagatgggagcgggagcagattgcttcaatgaaggagtacattgctcgttttggacatggatctgccaaactagcccgtcaagcacaaagtaaagagaaaacactggctaagatggagcgtggagggcttacagagaaggtggcaaaggacaaggtcctggtcttccgttttcctaatgttggcaaacttccccctcctgttctgcagtttgtggaagtgacatttggctacacacccgagaatctcatctacaagaacctagattttggtgtagaccttgattcaagggtagcactggtgggacctaatggagctggaaagagcacgctacttaagctgatgacaggggagttggttccccttgatggcatggttaggcggcataatcacctgcggattgcacagttccaccagcacttggctgagaagcttgacatggaattatctgctcttcagttcatgataaaagagtatcctgggaatgaggaggagaagatgagggcatcaattgggaggtttggccttactggtaaagctcaagtaatgcctatgaaaaacttgtcagatggtcaacgtagccggattatatttgcgtggttagcttttagacaacctcacatgctgcttctcgatgagccaaccaaccatctcgatattgagacaattgactcacttgccgaggctttgaatgaatgggatggtggaatggttcttgttagtcatgatttcaggctcataaaccaggtcgcccatgagatatgggtatgtgaaaataaaactgtgacacggtggaagggtgacattatggacttcaagctacatttgaaggcgagggccggattgggtgatgagtgaagcagatgttccaagttttagtacactactagcaagtcataatatgactgcttctcctggctaaacattatcagcagcaggccagcagtagctacagttttagttacttacaatgcctagtttttctatatgcatagagaagattaagaagtaaccgtggtcaccatatgactggactggctgttttatgtggtgcgatgtttttgcggtcctatttattctggcctttgtccattatcatagttcatgaagctaaagacgtagcgcgctagcagcagtcagcttgatgcattgcataaatatcaccactctatactgttcttaagaatttagttcagtgctattatggatttaccttttcattttaagaggtgtactacatatgttggccaagtattgtcattgaagtgttgtttcaaaatatgtttacctgtaatgacacttgatcatagtattaatatatattattccctctgctgaat

SEQ ID NO: 3911 - DNA, 2451 bp, Vinca minor
agtaaaagcaaaacgaaacacctgaatccactcaaaccctagatctcgaagatggtgtctgacgcgagtaagaagagggaggcacagaagaaagcggccgccgctgctaagagagcggggaagtctgggggatcatcgaaggcggcggctgccgccactactgcaggggagaatgggaacgcagataatttggctaatggagtcggggcgcttcacatatcggatcggacttgtaccggtatcctttgctcgcatccgatgtctagagatatacgtatagagtctttatcactcactttccacggacatgacctgatagtggattcggagctggaactaaactatggcaggcgttatggtctgcttggattgaatggttgtggaaagtctacgcttctcagttccataggatgtcgagaattaccaatcccagatcatatggatatttttcaccttaccagagagattgaagcatctgatatgtcttcacttgatgctgtcatgaactgcgatgaggagaggttgaagttggagaaagaagctgaagcattggctggacaggacgatggtggtggggagactcttgaacgtatttatgaacgtttggaagcattggatgtagcaactgctgagaagcgtgctgccgagatcttatttggtcttggttttgacaagaagatgcaagcaaagaaaaccagggacttctctggtggatggagaatgaggattgctctagctagggctctgtttatgaatcccaccatactattgctggatgagccaacaaaccatctagatttggaggcttgtgtttggttggaggaaactctaaagaacttttcccgtatactggttgtggtctcgcactcccaagattttttgaatggtgtgtgcaccaatatcatccatatgcagagtaagacgctgaagatttatactggtaattatgaccagtatgtccaaacacgttctgaactagaagagaaccagatgaaacaatacaaatgggagcaggagcagatttcctcaatgaaggagtacattgctcgatttggacatggatcagccaagttagctcgtcaggcacagagcaaagaaaaaactttggccaagatggagcgaggtggtcttacagagaaggtggcgagagaccaggttctggtgttccgctttcctgatgttgggaagcttcctccacctgtcctacagtttgtggatgtttcatttggttatacacccgagaatattatctacaagaatctggactttggtgttgatctggactcgagggtagcactggtgggccccaacggtgctggtaagagtacactgttgaagctgatgacgggggatttagttcccaatgatggcatggtccgcaggcacaaccacttgaggattgcacagttccatcagcacttgactgaaaaacttgacatggaaatgtcagccctcctgtttatgataagggagtaccctggaaatgaggaagaaaagatgaggggggcaattggaaaatttgggctgaccggcaaagctcaagttatgcccatgaaaaatttgtcagatggtcagaggagcagagtaatttttgcatggttggcttttaggcagccccatatgcttttactggatgagccgactaatcacttggatatcgagacaattgactcgctagccgaggctttgaacgagtgggatggtggtttggtgctcgttagtcacgatttcaggctcataaaccaggttgctcatgagatctgggtatgtgaaaatcaggctgtgaaacggtgggagggtgacatcatgggctttaaggagcacttaaagcagaagtccggtctatgattgaaactgatcaccagaccgcgatcattacatagttcgctactttctggatgcagtttgatgtgtagcagagcggattatgacgaaagcaggtcaagagaggcaaagaggtgactacttatgcataaccattttgggtactctcctgagcttatgcaactcatgttattttacggtatatgtatccgctgcatcttttcttggctgtggatcaaggagaaaggctagtaggatcttcatgaccattttattttgtcctatatatcaatacgatatgattagattaatgtttctctgttttactcatttgttgaattttgagtttatttccgagtaagatgacatactgctattattatgtttgatttattgaatatggtaactggactctcaactgagattccagaacctgaacttttgaattgagtttactagtctggtgtaagaagagtggatagctgcctgcttttactactaggctaaattctagaacctttttcttttcatttgtggttgggtattgaacttggtcctcggctagaatgctgaacaatagctgcccagttgagatagtttgtttcgcaacactttttagaagaaata

SEQ ID NO: 3912 - DNA, 2230 bp, Fragaria vesca
  misc_feature (1849)..(1849): n is a, c, g, or t
  misc_feature (1895)..(1895): n is a, c, g, or t
  misc_feature (1956)..(1956): n is a, c, g, or t
  misc_feature (2017)..(2017): n is a, c, g, or t
  misc_feature (2078)..(2078): n is a, c, g, or t
  misc_feature (2139)..(2139): n is a, c, g, or t
  misc_feature (2200)..(2200): n is a, c, g, or t
  misc_feature (2230)..(2230): n is a, c, g, or t
acccgacccaacctctctctctctctcgggtttaaccgactcgctcaccacctgagactaatcccagatctgactcccaccgccgagctctcttctccgatcgcctcctaggttgattatttgataagatggtctccgacgcaagcaagaagaaggcggctcagaagaaggcggcggcggcggccaagagaggtggaaaggcagcggcggcggcttcgtcaaaatctgcgtccgagtcgcagaatggagctgataagctcgccaatggagtcgaatcgatgaggatatcggatcggaattgcactggcgtgctttgctctcaccctctttccagggatatccggattgagtctctatcagttactttccatgggcatgatttgatagttgattctgaactggagcttaattatggcagacgttatggtttacttgggttgaatgggtgtggtaaatctaccttgctgactgcaatagggtgccgagagcttcctatcccagaacacatggatatctttcatctcagcagggaaattgaagcttcagacatgtcttcactagaggctgtcattagctgtgatgaggagaggattagattggagaaagaagttgaagaattggcagctcaagatgatggaggtggagagcagcttgaacgcatttatgagcgtcttgaagctctggatgcagcaactgcagagaagcgtgccgctgaaatactctatggtctcggttttgacaaacagatgcaagcaaagaaaactagagatttctctggtggttggaggatgaggattgcacttgcacgtgctctatttatcaacccaacaatcctgttgcttgatgagcctactaatcatcttgatctcgaagcttgtgtgtggttagaggagactctgaagaaatttgaacgcatcttggttgtggtttcacattctcaggatttcctgaatggtgtttgcacaaatatcattcacatgcagagcaagaaactgaagatctactctggaaactatgatcaatatgttcagacacgttcagaacttgaagaaaaccagatgaaacagtacaagtgggagcaagaacaaatttctaacatgaaagagtacattgctcgttttggtcacgggtcagcgaaactagctcgccaggcacaaagtaaagagaagacgctagctaaaatggagcgtggtgggcttactgaaaaggtggccagagacaagattttagtctttcgctttgttgatgtgggaaagctgccaccacctgtgcttcagtttgttgaagtctcatttggttacactcctgataatctgatctacaagaacatcgactttggtgttgatttggattcgcgtgtcgctctggttggccccaatggagctggaaagagtactctcctgaagctgatgacgggggaattgactcctcttgatggcatggtccggaggcacaatcaccttaggattgctcaattccatcagcacttgactgagaagcttgacatggagctgtctgccctccagtttatgatcaaagagtacccaggaaacgaggaagagaagatgagggcttcaattggtaaatttggactaacaggcaaagcacaagtgatgccaatgagtaatttgtcagatgggcagaggagccgtgttatctttgcttggttggcgtttagcaacctcagatgcttctgttggatgagccaactaatcatttggatattgagacaattgactcactggccgaggcgttgaatgagtgggatgggggtctggttcttgttagccacgatttcagactcataaaccaagtagctcatgagatttgggtatgtgaaaatcaagcngtgacccggtgggagggtgatattatgcaatttaaaaatcacctcnaagtcaaaggctggtttaggtgattaagtattgcggcagcctcggagaagtttcataagcnttttgtagtagtttatttgttgaccttgcttactacacgtgtatgagacaatgtagtgagnggtacctccttttctgagctatgtcttctcggagtgaactatgatgggaaccaagtgagcnataatgggtgaagaaggcttggttattgtttcgagccgtggcagtttcaggggttattttntgttgctttcattttgcatgcattttctttgctcttctatcttacttggttattaaccagngtcgattaagttatactcatattttaggtn

SEQ ID NO: 3913 - DNA, 2233 bp, Amborella trichopoda
  misc_feature (1360)..(1360): n is a, c, g, or t
  misc_feature (1936)..(1936): n is a, c, g, or t
ggggacactttctctctcatccgacgagaaccgcttctctttctctctctaactcctgctatagcacctgcttccagagatatttatcactttaaagggtttcatcagcttgatctttgaaaaggaggataaaggagagagaagatggtgtccgatgctagcaagaagaaggcagctgccaagaaggctgctgctgccgcgaagcgaggaggtaagtctggggctggggcatcaaaggctgccgaggctcagaatggagttgataagttggccaatggagttggtgggattcatttatctgatcgcacttgcactggagttctttgttcacaccccctatcccgagatatccatatagaatccttatctgttaccttccacggccacgatctcatagttgattccgaattggagctcaattatggaaggcgctatggtttgcttgggctgaatggctgtggaaagtccactcttttggcagctataggatgcagagaactcccaattccagaacacatggatatctttcaccttacaagggagatcgaggcttctgatttgtcggcattagaagcggttgtcagctgtgatgaagaaagactgagattggagaaagaagtcgagacactagctgcacaggatgatggtggtggagaggctcttgatcgtatttatgagcgtctagaggcaatggatgcatcgacggctgagaagcgtgcagcagagatcttgtatggtctgggcttctctaaacagatgcaggccaagaagactagagatttctctggtgggtggcgtatgagaatcgcgttggcaagagctttgttcatgaatcccaccattctattactagacgaacccacaaatcatcttgatctagaagcatgtgtttggttggaggagacactaaagaactttgatcgcatcctggtggtggtctcccactcacaggacttcctcaatggggtgtgcaccaacatcatccacatgcagaacaagaagctgaagctctacactggtaactacgatcaatacgttcaaacgcgccaagagctcgaggagaaccagatgaagcaatacaggtgggagcaggagcagattgcctccatgaaagagtacattgctcgttttggtcatggttctgcaaagctcgcacgccaagctcaaagcaaggagaaaacccttgcgaaaatggagcgtggtggtctcactgagaaggtggtgagggataaagtcttggtctttcgcttcactgatgtgggtaagctcccccctcctgttttacagttcgttgaaattgccttttggtacaccccggaaaacatcatatacaagaagctggatttcggggttgacctanactcgaggatcgctttggtgggtcctaatggggcagggaagagcacactattgaagctaatggctggggatctagagcccaaggatgggatggtgaggaggcataaccatttgagaattgctcaataccatcagcacttggctgagaagctcgaccttgaaatgtccgctttgcagtacatgatgaaggaatacacgggcaatgaggaggagaagatgagggcagccattggaaaattcgggcttactggaaaagctcaggtgatgcctatgaataacttatcagatgggcaaaggagccgagtcattttcgcatggttagcttggaggcagccacacctattgttgctcgatgaaccaactaaccatttggatattgaaaccattgattcgcttgctgaagccctcaatgagtgggatggggggatggtgctcgttagtcacgatttccgtctcatcaaccaggtggccaaggagatttgggtgtgtgagaaccaagtggttacaaggtgggagggtgatatcatggacttcaagaaccatctcaaggcgaaagcggagttatgagctagttttngagtgagcccctggccctatgatttctattacttatatttcaatgattaccagatgctagctagctagctattacgttgttgctttagtgtctacctatcttttagagaacataatgtttgtattttagggatgcatgtaacggggggtagggttttaccttgaaccgctgcactttttggtttgggtagagtttttcacggcaaaattcatgttttagatcatacacacgtattcttttgacatgtattaaagtaaaatacctaaatttggatatgatacatggagttttctattc

SEQ ID NO: 3914 - DNA, 2158 bp, Brachypodium distachyon
cctaccctaccctacccgccatggtgtccgacgccagcaagaagaaggccgcgcagaagaaggctgcggccgccgccaagagggggtccaaggccagcgccgcctcctcttcgtccgcagcctccgccgtcgacaaggcggccaacggcgtgtccgcgctcaacctctccgatcggacctgtaccggcgtcctcgcctcccatccgctatcccgggatatacacatagagtccctctcattgacatttcatggccacgatctgattgtggattcagatttggagcttaactatgggaggcgatatggtttgcttggcttaaatggttgtggaaaatccacccttctcacggcaataggctgcagggaacttcccatccctgaacacatggacatataccatctcagccgtgagattgaggcttcagacatgtctgcgcttcaagctgttatctgttgtgatgaagaaaggatcaagttggaaaaggaagctgaaattttgtctgcacaggatgatggtggtggtgaggctttggatcttgtatatgagcggttagaagcaatggatgcctcaactgctgaaaagcgtgctgctgagatattgtttggtctaggttttgacaagcaaatgcaagcaaagcaaactagagatttttctggtggttggcgtatgaggattgcgttggcaagggcattgttcatgaatcctaccatccttttacttgatgagccaacaaaccatcttgatctggaggcatgtgtctggctggaagagaaattaaagaattttgagcgcatacttgttgtcatatcacactcccaagatttcctaaatggtgtgtgcacaaacatcatccacatgcagaacaagatcctcaagttatatactggtaactatgaccagtatgttcaaaccagatctgagcttgaagagaatcagatgaagcaatacaaatgggagcaggaacagattgctaatatgaaggaatacattgccagatttggtcacggttctgcaaagctcgctcgtcaggctcagagcaaagagaaaacccttgcaaagatggagcgtggtggcctcgctgagaaggttgttaatgacaagattctggttttccgctttacagatgttggcaaactcccaccgccagtgctacagtttgctgatgtcacatttgggtacactccagataatctcatctacaagaacctcgactttggtgttgaccttgactctagagttgcactggttggtcccaatggggcagggaagagcacacttctgaagcttatgacaggtgacctatccccattggatggcatggtcaggcgccacaatcacctccgtattgcacagttccatcaacatctcactgagaagctggacctggacatgccggccctgcagtacatgatgagggaataccctgggaatgaggaggagaagatgagagctgccattggcaagtttggcctctcaggcaaggcacaggtgatgccaatgaaaaatctgtctgatgggcagaaggcccgtgttatctttgcgtggctggcttttaggcagccgcagatgctgttgcttgacgagccgacaaatcatcttgacattgagaccatcgactccctagctgaggcactcaaggaatgggacggaggattagtgctggtgagccacgacttcaggctgatcaaccaggttgctcaggagatctgggtgtgcgagaaccaggcggtaacaaggtgggaaggtgatatcatggatttcaagcaacacttgaagaaaagagctggtctttaaagtgccttcttttcttcctaggctctttggagatctatagacaagccaaagttttgcctctgtatcggaaaattttaaattatttagagtggctacaagtacggttatcattgtatccaagttaaaagaaacctagtacggcattttataaccagaggattcatattatttccacatgttgatgattcatattatttccctatctcgatgatttttggcgtcggttacttgatttatgatgtgtgtaagttgatcttagatgttggatttgacggcagtttttctttctgttcaagatgacgaaagtgttctatgaatgtactacgtatttgtgattataacaggcccttgatccaagctgt

SEQ ID NO: 3915 - DNA, 2272 bp, Capsicum annuum
ctcgttcctctcttctccacacagctgcactacacaaatttactcaaatttctccataatccgtagatctatcattttcaaagatggtgtcggatgcagcgaagaagagagatgcacagaagaaggcggcagcagctgcaaggaggggaggaaagggtgctgcaacctcaaaggcagctgcagcaaaaggggcggcggcggaaagtaacggggttgacagtttggctaatggaataggggatctaaagatatctgatcggacttgtactggtgttttgtgttcgcatccgctttcgagggatattcggatagaatctttatcagtcactttccacggacatgatcttatagttgattctgaactggagctcaactatggcagacgttatggtttgttgggattgaatggctgtgggaagtccactcttcttactgctataggcttgcgggaacttcccatcccagagcacatggatatttttcatctttcaagggagatcgaggcctctgacatgacctcccttgaggctgtcatcaattgtgatgaagagaggttgcaattggagaaagaagctgaagctttggctggacgggacgatggtggtggagagcaacttgaacgtatctatgagcgtttagaagctatggatgcagccactgctgagaaacgtgctgctgaaatcttgtttgggcttggatttgataagaaaatgcaagcaaagaaaacacgtgatttttctggtggctggagaatgaggattgctcttgcgcgagccctatttatgaatccaacaattttgttgcttgatgagccgacaaaccatcttgatctagaggcctgtgtgtggttggaagagtcgttgaagaatttcgagcgcattctggttgtcatttcacactcgcaggactttctcaatggtgtgtgtaccaatatcatccacatgcaaaacaagaagttgaaaatctatacagggaactacgaccaatatgtgcaaacccgttcagagctggaagagaaccagatgaaacagtacaagtgggagcaggatcagattgctgcaatgaaagaatatattgctcgctttgggcacggttcagctaaactagcccgtcaagcacagagtaaggaaaagacattggctaagatggagcgtggtgggcttactgagaaggtggggagggacagcgtcctggttttccggtttactgatgtcggcaaacttcctcctccagttctacagttttcagaagtttcttttggctacacacctgataacctcatctacaagaatcttgattttggtgtagatctcgactccagaatagcacttgtgggcccgaatggagctggaaagagcacactgcttaagctgatgataggggatttgtttcccactgacggcatggttaagcgtcataatcacctaaaaattgcacagtaccaccagcacttggccgagaagctagacatggacatgtcggctcttcagtacatgatgagagagtacccagggaatgaggaggagaagatgagggcagcaattgggaggtttggcctcacaggtaaagctcaagtaatggctatgaagaacttgtcagatggtcaacgtagtcgggtgatttttgcatggctggcttatagggtacctcacatgctgctgttggatgagccaaccaatcatcttgatattgaaacaatcgactcacttgctgaggcgttgaacgcatgggatggtgggatggttctagtcagtcacgactttaggctcataaaccaggtggcccatgagatctgggtatgtgaaaatcaggctgtgacacggtgggagggcgacatcatggacttcaagaaacacttgaagaaaagggccggattgggtgaatgaagtaagatactatgtgttacattagaatgtgatggtatcgctgtttgccctttggttgtttagtgcctaaggcaatggtgaaatcagcacggcccatcactgaaggtgaaggggagaaagaccagtaagacctaagtaacattagctaagaccacgcctagagccgggtgctagagagaggaagtgatcaaaccatggtcacataccgtttgaactctggttgttgttcgggcttcgtccactatttttgttatcctctttacatattctcttaggtttcggagagcttacattacagcttattccttatgatcacaaattctatattatattgctatgtactccagattttttcaaagctattatggatttttgaaattattttc

SEQ ID NO: 3916 - DNA, 2187 bp, Triticum aestivum
tctctccacaccacaagccgccgccgaccgctcgctgggaggggaatagaaatcgtgtatcgtagggttgcgcaaatcgccgcctccagcaaccaatccccaaccctcgagctatctaactatcccgatcccgatctcctaccatggtgtccgatgccagcaagaagaaagccgcgcagaagaaggccgccgccgccgccaagaggggagccaagtccagcgccgctgcctcgtcctcgtcggcgtcgtcggcggccgataaggccgccaatggcatagcggcccttaacttatccgatcggacatgtaccggggtcctggcttcgcatccgctctcccgtgatatccacattgagtccctttcattaacatttcatggacatgaccttattgtggattcagaattggagcttaactacgggaggcggtatggtttgctcggcttaaatggttgtgggaaatctacccttctcaccgcaataggctgcagggaactccccattcctgaacacatggacatacatcatcttacgcgtgagattgaggcttctgacatgtctgcgctgcaagctgttatctgttgtgatgaagaaagagtgaagttggaaaaggaagctgaaattctggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcattggcaagggcgctgttcatgaacccgaccatccttttgcttgatgagccaaccaaccatcttgatctcgaggcttgtgtctggctggaagagaaattaaagaattttgagcgtatacttgttgttatctcgcattcccaagattttctaaatggagtgtgcactaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcccgatttggtcatggatctgcgaagcttgctcgtcaggctcagagcaaagagaagactcttgcaaagatggagcgtggtggtcttgctgagaaggttgtcaatgacaggattcttgttttccgctttacagatgttggcaaactcccaccaccagtgctgcagtttgctgatgtgacatttggttacactccggataatctcatctacaagaaccttgacttcggtgttgaccttgactcgagagttgcactggtcggtcccaatggggcaggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcgattggcaagtttggcctgtcaggaaaggcacaggtgatgccaatgaaaaacctgtctgatgggcagaaggcccgtgtcatttttgcttggctagcatttaggcagccacagatgctgttgcttgatgagccgacaaatcatcttgacattgagaccattgactcacttgctgaggcactgaaggaatgggacggggggttggtcctggtgagccatgacttcaggctgatcaatcaggttgctcaagagatctgggtctgtgagaaccaggcggtgactaggtgggaaggcgatatcatggatttcaagcaacacttgaagaaaagggctggtctctagatttcctgtcttttccttctcggctctttggagatctagacaacccaaagtttttgcctgtatcagaaaagtttccatcatttagcgtgacaagtatgagtattattgtatcacttaaaacatatcttctccacactattttataaccagacgatccgtgtttaatttcatatcttttaacattgttgatccatgatggtttggtttgctctgcggttctagatttgaagattatcattttattaaggtgatgaaatgtagacat

SEQ ID NO: 3917 - DNA, 2398 bp, Hordeum vulgare
gccacaacccgccgccaccgcccgctgggaggggattagaaatcgtgtatcgtaggtttgcgcaaatcgccgcctacagcaaccaatcccctcccctcccctcccctcgagctatctacctttcccgatcccgataccctaccatggtgtccgatgctagcaagaagaaagccgcgcagaagaaggccgccgccgccgccaagaggggagccaagtccaacgccgctgcctcatcctcgtcggcgtcgtctgcggcggacaaggcggctaatggcatagcggcgcttaacttgtccgatcggacatgtaccggggtcctggcttcgcatccgctctcccgtgatatccacatagagtccctttcattaacatttcatggacatgaccttattgtggactcagaattggagcttaactatgggaggcggtatggtttgctcggcttaaatggttgtggaaaatctacccttctcacagcaataggctgcagggaactccccattcctgaacacatggacatacatcatctcacccgtgagattgaggcttctgacatgtctgcgctgcaagctgttatctgttgtgatgaagaaagagtcaagctggaaaaggaagctgaaattttggctgcacaggatgatggtggcggtgaagctttggatcttgtatatgagcggttagaagcgatggatgcatcaactgctgaaaagcgtgctgctgagatattgtttggtctaggttttgacaagcaaatgcaagcaaagccaactcgtgatttttctgggggttggcgtatgcggattgcgttggcaagggcactgttcatgaatccgaccatccttttgcttgatgagccaaccaaccatcttgatcttgaggcttgtgtctggcttgaagagaaattaaagaattttgagcgtatacttgttgttatctcacattcccaagatttcctaaatggagtgtgcaccaacatcatccacatgcagaacaagaccctcaagctatatactggaaattatgaccagtatgttcaaactcgctctgagcttgaagagaatcaaatgaagcagtacaaatgggaacaggaacagatagctaatatgaaggagtacattgctcgatttggtcatggatctgcgaagcttgctcgtcaggctcagagcaaagagaagactcttgcaaagatggagcgtggtggtctcgctgagaaggttgtcaatgacaagattcttgttttccgctttacagatgtaggcaaactcccaccaccagtgctgcagtttgctgatgtcacatttgggtacactccggataatctcatctacaagaacctcgactttggtgttgaccttgactcaagagttgcactggtcggtccgaatggggcaggtaagagcacacttctgaagctcatgacaggtgacctatctccactggatggcatggtcagacgccacaaccacctacgcattgcacaattccatcaacatctcactgagaagctggacctggacatgccggccctgcagtacatgatgagggagtaccctgggaatgaagaggagaagatgagagctgcaatcggcaagtttggcctgtcaggaaaggcacaggtgatgcctatgaaaaacctgtctgatgggcagaaggcccgtgtcatttttgcttggctagcatttaggcagccacagatgctgttgcttgatgagccgacaaatcatcttgacattgagaccatcgactcacttgctgaggcactgaaggaatgggacggggggttggtcctggtgagccatgacttcaggctgatcaatcaggttgcccaagagatctgggtctgtgagaaccaggcggtgactaggtgggaaggtgatatcatggatttcaagcaacatttgaagaaaagagctggtctctaatttcatgtcttttccttctcggctctttggagatctatagacaacccaaagttttgcctctgtatcagaaagtttccatcatttagagtgactagtattgagtattgagtacgattgtatcgacttaaaacgtatcttcttctctacgctattttataaccagatgatccttatttaattttcgtatctttgacattgttgatccatgatggtttgttttgctctgggattctcaaagatttgaagattttcattttattatggtgatatcatgaatttcaagcaacatttgaagaaaagagctggtctctagatttcatgtcttttccttctcggctccttggagatcatagacaacccaaagtttcacctctgtatcagtaagtttccatcatttagtgtgtgactagtattgagtacgattgtataacctgatgatccttatttaattttcatatctttgagattgttgatcc

SEQ ID NO: 3918 - DNA, 2395 bp, Hordeum vulgare
acaacccgccgccaccgcccgctgggaggggattagaaatcgtgtatcgtaggtttgcgcaaatcgccgcctacagcaaccaatcccctcccctcccctcccctcgagctatctacctttcccgatcccgataccctaccatggtgtccgatgctagcaagaagaaagccgcgcagaagaaggccgccgccgccgccaagaggggagccaagtccaacgccgctgcctcatcctcgtcggcgtcgtctgcggcggacaaggcggctaatggcatagcggcgcttaacttgtccgatcggacatgtaccggggtcctggcttcgcatccgctctcccgtgatatccacatagagtccctttcattaacatttcatggacatgaccttattgtggactcagaattggagcttaactatgggaggcggtatggtttgctcggcttaaatggttgtggaaaatctacccttctcacagcaataggctgcagggaactccccattcctgaacacatggacatacatcatctcacccgtgagattgaggcttctgacatgtctgcgctgcaagctgttatctgttgtgatgaagaaagagtcaagctggaaaaggaagctgaaattttggctgcacaggatgatggtggcggtgaagctttggatcttgtatatgagcggttagaagcgatggatgcatcaactgctgaaaagcgtgctgctgagatattgtttggtctaggttttgacaagcaaatgcaagcaaagccaactcgtgatttttctgggggttggcgtatgcggattgcgttggcaagggcactgttcatgaatccgaccatccttttgcttgatgagccaaccaaccatcttgatcttgaggcttgtgtctggcttgaagagaaattaaagaattttgagcgtatacttgttgttatctcacattcccaagatttcctaaatggagtgtgcaccaacatcatccacatgcagaacaagaccctcaagctatatactggaaattatgaccagtatgttcaaactcgctctgagcttgaagagaatcaaatgaagcagtacaaatgggaacaggaacagatagctaatatgaaggagtacattgctcgatttggtcatggatctgcgaagcttgctcgtcaggctcagagcaaagagaagactcttgcaaagatggagcgtggtggtctcgctgagaaggttgtcaatgacaagattcttgttttccgctttacagatgtaggcaaactcccaccaccagtgctgcagtttgctgatgtcacatttgggtacactccggataatctcatctacaagaacctcgactttggtgttgaccttgactcaagagttgcactggtcggtccgaatggggcaggtaagagcacacttctgaagctcatgacaggtgacctatctccactggatggcatggtcagacgccacaaccacctacgcattgcacaattccatcaacatctcactgagaagctggacctggacatgccggccctgcagtacatgatgagggagtaccctgggaatgaagaggagaagatgagagctgcaatcggcaagtttggcctgtcaggaaaggcacaggtgatgcctatgaaaaacctgtctgatgggcagaaggcccgtgtcatttttgcttggctagcatttaggcagccacagatgctgttgcttgatgagccgacaaatcatcttgacattgagaccatcgactcacttgctgaggcactgaaggaatgggacggggggttggtcctggtgagccatgacttcaggctgatcaatcaggttgcccaagagatctgggtctgtgagaaccaggcggtgactaggtgggaaggtgatatcatggatttcaagcaacatttgaagaaaagagctggtctctaatttcatgtcttttccttctcggctctttggagatctatagacaacccaaagttttgcctctgtatcagaaagtttccatcatttagagtgactagtattgagtattgagtacgattgtatcgacttaaaacgtatcttcttctctacgctattttataaccagatgatccttatttaattttcgtatctttgacattgttgatccatgatggtttgttttgctctgggattctcaaagatttgaagattttcattttattatggtgatatcatgaatttcaagcaacatttgaagaaaagagctggtctctagatttcatgtcttttccttctcggctccttggagatcatagacaacccaaagtttcacctctgtatcagtaagtttccatcatttagtgtgtgactagtattgagtacgattgtataaccagatgatccttatttaattttcatatctttgagattgttgatcc

SEQ ID NO: 3919 - DNA, 2141 bp, Leymus cinereus x Leymus triticoides
  misc_feature (244)..(244): n is a, c, g, or t
  misc_feature (263)..(263): n is a, c, g, or t
  misc_feature (2064)..(2064): n is a, c, g, or t
  misc_feature (2086)..(2086): n is a, c, g, or t
ccacaacccgccgccaccgcctgctgggaggggattagaaatcgtgtatcgtagggttgcgcaaatcgccgcctccagcaaccaatcccctcccctcgagctatctatcccgatcccctaccatggtgtccgatgccagcaagaagaaagccgcgcagaagaaggccgccgccgccgccaagaggggagccaagtccagcgccgctgcctcatcctcgtcggcatcgtcagcggccgacaaggnggccaatggcatagcggcncttaacttatccgatcggacatgtaccggggtcctggcttcgcatccgctctcccgtgatatccacatagagtccctttcattaacatttcatggacatgaccttattgtggattcagaattggagcttaactatgggaggcggtatggtttgctcggcttaaatggttgtggaaaatctacccttctcacagcaataggctgcagggaactccccattcctgaacacatggacatacatcatctcacccgtgagattgaggcttctgacatgtctgcgctgcaagctgttatctgttgtgatgaagaaagagttaagttggaaaaggaagctgaaattttggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaactcgagatttttctgggggttggcgtatgaggattgcgttggcaagggcgctgttcatgaatccgaccatccttttgcttgatgagccaaccaaccatcttgatcttgaggcttgtgtctggctggaagagaaattaaagaattttgagcgtatacttgttgttatctcacattcccaagatttcctaaatggagtgtgcaccaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcacgatttggtcatggatctgcgaagcttgctcgtcaggctcagagcaaagagaagactcttgcaaagatggagcgtggtggtctcgctgagaaggttgtcaatgacaagattcttgttttccgctttacagatgttggcaaactcccaccaccagtgctgcaatttgccgatgtcacatttgggtacactccggataatctcatctacaagaaccttgactttggtgttgaccttgactcaagagttgccctggtaggtcccaatggggcaggtaagagcacacttctgaagctcatgacaggtgacctatctccattggatggcatggtcagacgccacaaccacctacgcattgcacaatttcatcaacatctcactgagaagctggacctggacatgccggccctgcagtacatgatgagggagtaccctgggaatgaagaggagaagatgagagctgcaattggcaagtttggcctgtcaggaaaggcacaggtgatgccaatgaaaaacctgtctgatgggcagaaggcccgtgtcatttttgcttggctagcatttaggcagccacagatgctgttgcttgacgagccgacaaatcatcttgacattgagaccatcgactcacttgctgaggcactgaaggaatgggacgggggtttggtcctggtgagccatgacttcaggctgatcaatcaggttgctcaagagatctgggtctgcgagaaccaggcggtgactaggtgggaaggtgatatcatggatttcaagcaacacttgaagaaaagggctggtctctagatttcctgtcttttccttctctcggctctttggagatctatagacaacccaaacttttgcctctgtatcagaaaagtttccatcatttagagtgactacaaagtatgagtactattgtatcgagttaaaacatatcttctctatgctattttataaccagacnatccttatttaattttcatatntttgccattgttgatccaggagggtttgttttgctttggggttttcaaatttttt

SEQ ID NO: 3920 - DNA, 2234 bp, Avena sativa
tccacaccacaacccccccgccgccgccaagagggaggggattagaaatcctgtatcctgtatcgtagggttgcgcagatcgccgccaccagctaccaatcccctcccctcgagttacctatccccgatctcccatcatggtgtccgacgccagcaagaagaaggccgcgcagaagaaggccgccgccgccgccaagaggggtgccaagtccagcgttgccgcctcgtcctcgtcggcgtccgccgcagccgataaggcggccgacagcatatcggcgctcaacctatccgaccggacctgtactggggttctggcctcccatccgctctcccgtgatatccacatagagtccctttcattaacattccatggccatgaccttatcgtggattcagagttggagcttaactatgggaggcgttatggcttgctcggcttaaatggctgtggaaaatctacccttctcacagcaataggccacagagaacttcctatccctgaacacatggacatacaccatctcacccgtgagattgaggcttcagacatgtcttcgctgcaagctgttatctgttgtgatgaagaaagaatcaagttggaaaaggaagctgaaattttgtctgcacaggatgatggtggcggtgaagctttggatcttgtatatgaacggttagaagcaatggatgcatcaactgctgaaaagcgtgctgctgagatattgtttggtctaggttttgacaagcagatgcaagcaaagccaactcgagatttttctggtggttggcgtatgaggattgcgttggcaagggcgctgttcatgaacccgaccatccttttgcttgatgagccaactaaccatctcgatcttgaggcttgtgtttggctggaagagaaattaaagaattttgagcgtattcttgttgtcatctcacactcacaagatttcctgaatggagtgtgcactaacatcatccacatgcagaacaagatcctcaagttatatactggtaattatgaccagtatgtgcaaacccgctctgaacttgaagagaatcaaatgaagcagtacaaatgggagcaggaacagattgctggtatgaaggagtacattgcgcgatttggtcacggatctgcaaagcttgctcgtcaggctcagagcaaagagaaaactcttgcaaagatggagcgaggtggtcttgctgagaaggttgtcaatgacaagattctggtgttccgctttacagatgttggcaaactcccaccaccagtgctacaatttgctgatgtcacgtttggatacactccggataatctcatttacaagaaccttgactttggtgttgaccttgactcaagagttgcactggttggtcccaatggtgcagggaaaagcacactcctgaagctcatgactggtgacctaactccattggatggcatggtcaggcgccacaatcacctacgcattgctcaatttcatcaacatctcactgagaagctggatctggatatgccagctctgcagtacatgatgagggagtaccctgggaatgaggaggagaagatgagagcttcaattggcaagtttggcctctcagggaaggcacaggtaatgccaatgaaaaatctgtcagatggacagaaggcccgtgttatctttgcttggctggcattcaggcagccgcagatgcttttgcttgatgagcccacaaatcatcttgacattgagacaattgactcccttgcggaggcactgaaggaatgggatgggggattagtcctcgtgagccatgacttcaggctgatcaaccaggttgctcaagagatctgggtgtgtgagaaccaggcggtaactaggtgggaaggtgatattatggatttcaagcgacacttgaagaagagggctggtctctagggtgccttgctttttggtcctcggctctttggagatctatagataacccaaagttttgcctctgtatcggaaaagttttaattatttagagtaacaagtcattgtatcgagtcgaaccatattcttgtacgtcattttatatccagatgatccatattatttttcttgatgtgttggtcttaattatttggcattattgtgtgttggtgttgtgttgtacttctgttcttattaagttcttcaaaagatggtgtgttgtgttgcttctgttcttaatattgtcgaagtaatgtatccttgcctgtaactggcttaagt

SEQ ID NO: 3921 - DNA, 2097 bp, Pseudoroegneria spicata
cccgccgccaccgcctgctgggaggggattagaaatcgtgtatcgtagggttgcgcaaatcgccgcctccagcaaccaatcccctcccctcgacctatctacctatcccgatcccgatccccctaccatggtgtccgatgccagcaagaagaaagccgcgcagaagaaggccgccgccgccgccaagaggggagccaagtccagcgccgctgcctcttcctcgtcggcgtcgtcagcggccgacaaggcggccaatggcatagcggcgcttaacttatccgatcggacatgtaccggggtcctggcttcgcatccgctctcacgtgatatccacatagagtccctttcattaacatttcatggacatgaccttattgtggattcagaattggagcttaactatgggaggcggtatggtttgctcggcttaaatggttgtggaaaatctacccttctcacagcaataggctgcagggaactccccattcctgaacacatggacatacatcatctcactcgtgagattgaggcttctgacatgtctgcgctgcaagctgttatctgttgtgatgaagaaagagtcaagttggaaaaggaagctgaaattttggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcgttggcaagggcgctgttcatgaatcccaccatccttttgcttgatgagccaaccaaccatcttgatcttgaggcttgtgtctggctggaagagaaattaaagaattttgagcgtatacttgttgttatctcacattcccaagatttcctaaatggagtgtgcaccaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcacgatttggtcatggatctgcgaagcttgctcgtcaggctcagagcaaagagaagactcttgcgaagatggagcgtggtggtctcgctgagaaagttgtcaatgacaggattcttgttttccgctttacagatgttggcaaactcccgccaccagtgctgcagtttgctgatgtcacatttgggtacactccggataatctcatctacaagaaccttgactttggtgttgaccttgactcaagagttgcactggtcggtcccaatggggcaggtaagagcacacttctgaagctcatgacaggtgacctatctccgttggatggcatggttagacgccacaaccacctacgcattgcacaattccatcaacatctcactgagaagctggacctggacatgccggccctgcagtacatgatgagggagtaccctgggaatgaagaggagaagatgagagctgcaattggcaagtttggtctgtcaggaaaggcacaggtgatgccaatgaaaaacctgtctgatgggcagaaggcccgtgtcatttttgcttggctagcatttaggcagccacagatgctgttgcttgacgagccgacaaatcatcttgacattgagacaatcgactcacttgctgaggcactcaaggaatgggacgggggattggtcctggtgagccatgacttcaggctgatcaatcaggttgctcaagagatctgggtctgcgagaaccaggcggtgactaggtgggaaggtgatatcatggatttcaagcaacacttgaagaaaagggctggtctctagatttcctgtcttttccttctctcggctctttggagatctatagacaacccaaagttttgcctctgtatcagaaaagtttccatcatttagagtgactacaagtattgagtactattgtatcgacttaaaacatatcttctctacgctattttataatcagacaatcagacgatccttatttaattttcgca

SEQ ID NO: 3922 - DNA, 2257 bp, Triticum aestivum
gcccagcgatgactcgagaaccgtctctccacaccacaagccgccgccaccgcccgctgggaggggaatagaaatcgtgtatcgtagggttgcgcaaatcgccgcctccagcaaccaatccccaaccctcgagctatctaactatcccgatcccgatcccgatctcctaccatggtgtccgatgccagcaagaagaaagccgcgcagaagaaggccgccgccgccgccaagaggggagccaagtccagcgccgctgcctcgtcctcgtcggcgtcgtcagcggccgataaggccgccaatggcgtagcggcccttaacttatccgatcggacatgtaccggggtcctggcttcgcatccgctctcccgtgatatccacattgagtccctttcattaacatttcatggacatgaccttattgtggattcagaattggagcttaactacgggaggcggtatggtttgctcggcttaaatggttgtgggaaatctacccttctcaccgcaataggctgcagggaactccccattcctgaacacatggacatacatcatcttactcgtgagattgaggcttctgacatgtctgcgctgcaagctgttatctgttgtgatgaagaaagagtgaagttggaaaaggaagctgaaattttggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcattggcaagggcgctgttcatgaacccgaccatccttttgcttgatgagccaaccaaccatcttgatctcgaggcttgtgtctggctggaagagaaattaaagaattttgagcgtatacttgttgttatctcgcattcccaagattttctaaatggagtgtgcactaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcacgatttggtcatggatctgcgaagcttgctcgtcaggctcagagcaaagagaagactcttgcaaagatggagcgtggtggtctcgctgagaaggttgtcaatgacaggattcttgttttccgctttacagatgttggcaaactcccaccaccagtgctgcagtttgctgatgtcacatttggttacagtccggataatctcatctacaagaaccttgactttggtgttgaccttgactcgagagttgcactggtcggtcccaatggggcaggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcaattggcaagtttggcctgtcaggaaaggcacaggtgatgccaatgaaaaacctgtctgatgggcagaaggcccgtgtcatttttgcttggctagcatttaggcagccacagatgctgttgcttgatgagccgacaaatcatcttgacattgagaccattgactcacttgctgaggcattgaaggaatgggacggggggttggtcctggtgagccatgacttcaggctgatcaatcaggttgctcaagagatctgggtctgtgagaaccaggcggtgactaggtgggaaggcgatatcatggatttcaagcaacacttgaagaaaagggctggtctctagatttcctgtcttttccttctctcggctctttggagatctagacaacccaaagttttgcctctgtatcagaaaagcttccatcatttagcgcgacaagtacaagtactattgtatcacttaaaacatatcttctctacgctattttataaccagacgatccgtatttaatttcatatctttaacattgttgatccatgatggtttgttttgctctgtggttctagatttgaagattatcattttataaggtgatgagatgtagacatatttcattccattgttatcttcaaatttgtatttagtaaac

SEQ ID NO: 3923 - DNA, 2219 bp, Triticum aestivum
gaacagcgatgactcgagaaccgtctctccacaccacaagccgccgccaccgcccgctgggaggggaatagaaatcgtgtatcgtagggttgcgcaaatcgccgcctccagcaaccaatccccaaccctcgagctatctaactatcccgatcccgatcccgatctcctaccatggtgtccgatgccagcaagaagaaagccgcgcagaagaaggccgccgccgccgccaagaggggagccaagtccagcgccgctgcctcgtcctcgtcggcgtcgtcagcggccgataaggccgccaatggcatagcggcccttaacttatccgatcggacatgtaccggggtcctggcttcgcatccgctctcccgtgatatccacattgagtccctttcattaacatttcatggacatgaccttattgtggattcagaattggagcttaactacgggaggcggtatggtttgctcggcttaaatggttgtgggaaatctacccttctcaccgcaataggctgcagggaactccccattcctgaacacatggacatacatcatcttactcgtgagattgaggcttctgacatgtctgcgctgcaagctgttatctgttgtgatgaagaaagagtgaagttggaaaaggaagctgaaattttggctgcacaggatgatggtggcggtgaagctttggatcttgtatatgagcggttagaagcaatggatgcatcaactgctgaaaagcgtgctgctgagatattgtttggtctaggttttgacaagcaaatgcaagcaaagccaacacgagatttttctgggggttggcgtatgaggattgcattggcaagggcgctgttcatgaacccgaccatccttttgcttgatgagccaaccaaccatcttgatctcgaggcttgtgtctggctggaagagaaattaaagaattttgagcgtatacttgttgttatctcgcattcccaagattttctaaatggagtgtgcactaacatcatccacatgcagaacaagaccctcaagttatatactggaaattatgaccagtatgttcaaactcgctctgagcttgaagagaatcaaatgaagcagtacaaatgggaacaggaacagatagctaatatgaaggagtacattgcacgatttggtcatggatctgcgaagcttgctcgtcaggctcagagcaaagagaagactcttgcaaagatggagcgtggtggtcttgctgagaaggttgtcaatgacaggattcttgttttccgctttacagatgttggcaaactcccaccaccagtgctgcagtttgctgatgtcacatttggttacactccggataatctcatctacaagaaccttgacttcggtgttgaccttgactcgagagttgcactggtcggtcccaatggggcaggtaagagcacacttctgaagctcatgacaggtgacctatctccgttggatggcatggtcagacgccacaaccacctacgcattgcacaattccatcaacatctcactgagaagctggacctggacatgccggccctgcagtacatgatgagggagtaccctgggaatgaagaggagaagatgagagctgcaattggcaagtttggcctgtcaggaaaggcacaggtgatgccaatgaaaaacctgtctgatgggcagaaggcccgtgtcatttttgcttggctagcatttaggcagccacagatgctgttgcttgatgagccgacaaatcatcttgacattgagaccattgactcacttgctgaggcactgaaggaatgggacggggggttggtcctggtgagccatgacttcaggctgatcaatcaggttgctcaagagatctgggtctgtgagaaccaggcggtgactaggtgggaaggcgatatcatggatttcaagcaacacttgaagaaaagggctggtctctagatttcctgtcttttccttctctcggctctttggagatctagacaaccccaaagttttgccctgtatcagaaaagtttccatcatttagcgtgacaagtatgagtactattgtatcacttaaaacatatcttctctacactattttataaccagacgatccgtatttaatttcatatctttaacattgttgatccatgatggtttgttttgctctgtggttctagatttgaagattatcattttataaggtgatgagatgtagacatatt

SEQ ID NO: 3924 - DNA, 2413 bp, Chelidonium majus
caatttcgagggttgttgttgtagttctcctttttctcttctctctctcactgaaagtgaaggaggctgctgctatcgacattataaaaccgacagattagaaaaaaagagaactcaacagcttaaacaaaaaaaaaaaaaccctagtttttgctctaccggtgaaaccctaattcgcagtcgcactctttctagcaccaccactaatcaaatcttaaaaggcggaaatatggtttctgacgcgagtaagaagaaggcagcacagaagaaggcagcggcggcggctaagagaggaggaaaggcagcgggagcagcttcttcaaagacgggctcttcaactaatggtgttgataagttgacgaatggagttgattctctgcatatatctgatcggacatgtactggtgttttatgttcgcatccgctctctagagatatccatatagagtctttatctgtaaccttccatggtcatgatctcatagtggattctgaactggagcttaattatggcaggcgttatggtttgcttggattgaatggctgtgggaagtctactcttctgactgcgattgggtgtcgggagctccccattccagaacatatggatatctatcatctcagcagcgagattgaagcctctgacatgtcttcacttgaggctgttataaactgtgatgaagagaagctgctattagaaaaagaagtagaacgtttggctgcagaggatggtgggggtggtgaagctctggatcgcatttatgagcgattggaatccttggatgcgtcaactgctgagatgcgtgctgctcagattttgtttggtcttggttttgacaagagtatgcaagccaagaaaactcgggatttctctggtggttggcgaatgaggatagcattagcaagagccttgttcatgaaaccaaccattcttttgcttgatgaacctacaaatcatctcgatctggaagcttgtgtctggctggaggagacattgaagaattttgatcgcatcctggttgtggtgtctcactctcaggatttcttgaatggtgtttgcacaaacattattcacatgcagagcaagaagctaaagctatacactggtaattatgaccagtatgtgcagactcggtccgaacttgaagagaatcagatgaaacagtacaaatgggaacaggagcagatctcaaacatgaaagagtacattgcacggtttggccatgggtctgcaaagcttgctcgccaagcacaaagtaaggagaagacattggcgaagatggaacgaggagggttgacagaaaaggtttcgagggacaaggttctgatctttcgcttcactgatgttgggaagcttccccctccagtactccagtttgtggaagtctcatttggttacacgcctgagaacctcatctacaagaacattgactttgggggggacttggactcaagagtagcacttgtgggacccaatggagctgggaagagcacactgctgaagttgatgacaggggagttgatgcctcaggatggcatggtccgacgccacaaccacctgaggattgctcagtaccaccagcatttgactgagaagctcgacatggagatgtctgcacttcagtacatgatgaaggagtatcagggaaccggggaagagaagatgagggcagcaattgggcagtttggtttgacgggcaaagcacaagtgatgcccatgaagaatttatcagatggtcagaagagtcgtgtgatatttgcgtggctggcatggaggcaaccgcaaatgctattgcttgatgagcctaccaaccatctggacattgagacgattgattctctagcagaggccctgaatgagtgggatggtggcttggttcttgttagccatgactttaggctcatcaaccaagttgcccatgagatatgggtgtgtgagaaccagaaggtgactcgatgggagggagacattatgggctttaagcaacacctcaagagcaaggctggtttataatttactttttaaattatatattctgcttacagttttatgttcttacacaataggaggaatggaggatctgcgttcacctattaatggtaaaatgtttttttatgttggatgatgacgagatcaagatttatgcagtaaatcgaggttattgttcgatggtattagctgctgctgacaggttcgattttttctgctggtttagaagagttgagtctttttcgacattcttgttactactattattttttcctaaactttttcatgatgcaaggagatactgtgatcctgctttttgatggtagatagggatattattttgaaacctattatattaatgttgtgtttcattggaggatttaattttcaagttgtactttttgagaataagtggagatatga

SEQ ID NO: 3925 - DNA, 2312 bp, Solanum phureja
ccctctttcaaaaaaccctcgttcctctcttctataacctttaacaatttctccaaatccgtagatcttacgaattcaaagatggtgtcggatgcggcgaagaagagagatgcgcagaagaaggcggcagcagctgctaggagaggaggtaaaggtgcggcagcgtctaaatcggctgcgacggcgtctaaatctgcgggggaaagtaacggggttgataatttgacgaatggagtaggggatctacagatatctgatcggacttgtacgggtgttttatgttcacatccgctatcgagggatattcggatagaatcattatcagtcactttccacggacatgatctaatcgttgattctgaactggagctcaactatggcagacgttatggtttgttgggattgaatggctgcgggaagtctactcttcttaccgctatagggttgagggaacttcccatcccagaccacatggatatttttcatctttctcgggagattgatgcctctgacatgacctctctcgaggccgtcattaattgtgatgaagagaggttgcaattggagaaagaagctgaagctttggctgcacaggatgatggtggtggagagcaacttgaacggatctatgagcgtttagaagctatggatgctgccactgctgagaaacgtgctgctgaaatcttgtttgggcttggatttgataagaaaatgcaagcaaagaaaacacgcgatttttctggtggctggagaatgaggattgctcttgcccgtgccctctttatgaatccaacaattttgttgcttgatgagccaacaaaccatcttgacctagaagcctgtgtgtggttagaagaatccttgaagaactttgagcgcattctggttgtcatttcacactcacaggattttctcaatggtgtgtgtaccaatatcatccacatgcaaaacaagaagttgaaactctatacaggtaactacgaccaatatgtgcaaacccgttcagagctggaagagaaccagatgaaacagtacaagtgggagcaggagcagatttctgcaatgaaggaatacattgctcgctttgggcacggttcagctaaactagcccgtcaagcacagagtaaagagaagacattggctaagatggagcgtggtgggcttactgagaaggtggggagggacagcgtcctggttttccggtttactgatgtcggcaaacttcctcctccagttctacagttttctgaagttgcttttggctacacacctgaaaacctcatctacaagaaccttgattttggtgtagatctcgactccagggtagcacttgtagggcctaatggagctggaaagagcacactgcttaagctgatgataggggagttatttcccactgatggcatggttaagcggcataatcacctaaaaattgcacagtaccaccagcacttgactgagaagctagacatggaggtgtcagctcttttgtacatgatgagagagtaccctgggaatgaggaggagaagatgagggcagcaattgggaggtttggactcacaggtaaagctcaagtaatggctatgaagaacttgtcagatggtcaacgtagtcgggtgatctttgcatggttggcttttagacaaccccacatgctgctgttggatgagccaactaaccatcttgatattgagaccattgactcacttgcagaggccttgaacgcatgggatggtgggatggttctagtgagtcacgactttaggctcataaatcaggtggcccatgagatatgggtatgtgaaaatcaggctgtgacacgatgggagggtggcatcatggagttcaagaaacacttgaagaaaagggctggattgggtgattaaaagtaagatctctgtgttatattagaaagtgtgatggtatcactatttcctcttggtggttcagtgccaaggcgtaatggtgaaacatcagcaggctcccatcacggtagctgaggggagaaagtaaaggcttcttgatcaccagtaagacctaagtaacgttagctaagaccacacctggtgctagagagagagtaagtgatcgaaccatggtcaccgactgtttgaactctggttattgttcgggcttagtccactatttttgtcgtccattttactctaattacatattaccctaggttttggagagcatacattacagcttattccttatgtcatttctattctatatcattgctatgtacttcggattttggaattctgaaagctattatggattttttaatcatctttgtctctctagt

SEQ ID NO: 3926 - DNA, 2312 bp, Solanum lycopersicum
ccctctttcaaaaaaccctcgttcctctcttctataacaaatttctccaaatccgtagatcttacgatttcaaagatggtgtcggatgcggcgaagaagagagatgcgcagaagaaggcggcggcagctgctaggagaggaggtaaaggtgcggcagcgcctaaatcggctgcaaccgcgtctaaatcggcggtggaaagtaacggggttgataatttgacgaatggagtaggggatctacagatatctgatcggacttgtacgggtgttttgtgttcacatccgctatcgagggatattcggatagagtcattatcagtcactttccacggacatgatctcatcgttgattctgaactggagctcaactatggcagacgttatggtttgttgggattgaatggctgcgggaagtctactcttcttactgctatagggttgagggaacttcccatcccagaccacatggatatttttcatctttctcgggagattgaagcctctgacatgacctctctcgaggctgtcattaattgtgatgaagagaggttgcaattggagaaagaagctgaagctttggctggacaggacgatggtggtggagagcaacttgaacggatctatgagcgtttagaagctatggatgctgccactgctgagaaacgtgctgctgaaatcttgtttgggcttggatttgataagaaaatgcaagcaaagaaaacacgtgatttttccggtggctggaggatgaggattgctcttgcccgtgccctctttatgaatccaacaattttgttgcttgatgagccaacaaaccatcttgacctagaggcctgtgtgtggttagaagaatccttgaagaactttgagcgcattctggttgtcatttcacactcacaggattttctcaatggtgtgtgtaccaatatcatccacatgcaaaacaagaagttaaaactctatacaggtaactacgaccaatatgtgcaaacccgttcagagctggaagaaaaccagatgaaacagtacaagtgggagcaggagcagatttctgcaatgaaggaatacattgctcgctttgggcacggttcagctaaactagcccgtcaagcacagagtaaagagaagacattggctaagatggagcgtggtgggcttactgagaaggtggggagggacagtgtcctggttttccggtttactgatgtcggcaaacttcctcctccagttctacagttttcagaagttgcttttggctacacacctgataacctcatctacaagaaccttgattttggtgtagatctcgactccaggatagcacttgtggggcctaatggagctggaaagagcacactgcttaagctgatgataggggatttatttcccactgatggcatggttaagcggcataatcacctaaaaattgcgcagtaccaccagcacttggctgagaagctagacatggaggtgtcagctcttttgtttatgatgagagagtaccctgggaacgaggaggagaagatgagggcagcaattgggaggtttggactcacaggtaaagctcaagtaatggcaatgaagaacttgtcagatggtcaacgtagtcgagtgatttttgcatggttggcttttaggcaaccccacatgctgctgttggatgagccaaccaaccatcttgatattgaaaccattgactcacttgcagaggccttgaacgcatgggatggtgggatggttctagtgagtcacgactttaggctcataaaccaggtggcccatgagatatgggtatgtgaaaatcaggctgtgacacgatgggagggtggcatcatggatttcaagaaacacttgaagaaaagggctggattgggtgattaaaattaagatcaatgtgttctatattagaaagtgtgatggtatcactatttcctcttggtggttcagcgccaaggcgtaatggtgaaaaacatcagcaggggccccatcacggtagctgaggagagaaagtgaaggcttcttgatcaccagtaagacctaagtaacgttagctaagaccacgcctggtgctagagagagtaagtgatcgaactatggtcactgactgtttgaactctggctattgttcgggcttagtccactatttttgtcgtccattttactctaattacatattaccgtaggttttggagaacatacattacagcttattccttgtgtcatttctattctatatcattgctataatgtacttcgtatttttgaattctgattatggattttttaaatatatctgtttctattttattttc

SEQ ID NO: 3927 - DNA, 2438 bp, Solanum lycopersicum
ccctctttcaaaaaaccctcgttcctctcttctataacaaatttctccaaatccgtagatcttacgatttcaaagatggtgtcggatgcggcgaagaagagagatgcgcagaagaaggcggcggcagctgctaggagaggaggtaaaggtgcggcagcgcctaaatcggctgcaaccgcgtctaaatcggcggtggaaagtaacggggttgataatttgacgaatggagtaggggatctacagatatctgatcggacttgtacgggtgttttgtgttcacatccgctatcgagggatattcggatagagtcattatcagtcactttccacggacatgatctcatcgttgattctgaactggagctcaactatggcagacgttatggtttgttgggattgaatggctgcgggaagtctactcttcttactgctatagggttgagggaacttcccatcccagaccacatggatatttttcatctttctcgggagattgaagcctctgacatgacctctctcgaggctgtcattaattgtgatgaagagaggttgcaattggagaaagaagctgaagctttggctggacaggacgatggtggtggagagcaacttgaacggatctatgagcgtttagaagctatggatgctgccactgctgagaaacgtgctgctgaaatcttgtttgggcttggatttgataagaaaatgcaagcaaagaaaacacgtgatttttccggtggctggaggatgaggattgctcttgcccgtgccctctttatgaatccaacaattttgttgcttgatgagccaacaaaccatcttgacctagaggcctgtgtgtggttagaagaatccttgaagaactttgagcgcattctggttgtcatttcacactcacaggattttctcaatggtgtgtgtaccaatatcatccacatgcaaaacaagaagttaaaactctatacaggtaactacgaccaatatgtgcaaacccgttcagagctggaagaaaaccagatgaaacagtacaagtgggagcaggagcagatttctgcaatgaaggaatacattgctcgctttgggcacggttcagctaaactagcccgtcaagcacagagtaaagagaagacattggctaagatggagcgtggtgggcttactgagaaggtggggagggacagtgtcctggttttccggtttactgatgtcggcaaacttcctcctccagttctacagttttcagaagttgcttttggctacacacctgataacctcatctacaagaaccttgattttggtgtagatctcgactccaggatagcacttgtggggcctaatggagctggaaagagcacactgcttaagctgatgataggggatttatttcccactgatggcatggttaagcggcataatcacctaaaaattgcgcagtaccaccagcacttggctgagaagctagacatggaggtgtcagctcttttgtttatgatgagagagtaccctgggaacgaggaggagaagatgagggcagcaattgggaggtttggactcacaggtaaagctcaagtaatggcaatgaagaacttgtcagatggtcaacgtagtcgagtgatttttgcatggttggcttttaggcaaccccacatgctgctgttggatgagccaaccaaccatcttgatattgaaaccattgactcacttgcagaggccttgaacgcatgggatggtgggatggttctagtgagtcacgactttaggctcataaaccaggtggcccatgagatatgggtatgtgaaaatcaggctgtgacacgatgggagggtggcatcatggatttcaagaaacacttgaagaaaagggctggattgggtgattaaaattaagatcaatgtgttctatattagaaagtgtgatggtatcactatttcctcttggtggttcagcgccaaggcgtaatggtgaaaaacatcagcaggggccccatcacggtagctgaggagagaaagtgaaggcttcttgatcaccagtaagacctaagtaacgttagctaagaccacgcctggtgctagagagagtaagtgatcgaactatggtcactgactgtttgaactctggctattgttcgggcttagtccactatttttgtcgtccattttactctaattacatattaccgtaggttttggagaacatacattacagcttattccttgtgtcatttctattctatatcattgctataatgtacttcgtatttttgaattctgattatggattttttaaatatatctgtttctattttatcttcaaggcaagtagaatcagcaggttgttgagccattatcttgttcacaacacttggaacgttattattttgtagacttgaaattggaggtagataatatgcttatatacgagaatcaatttaaacctc

SEQ ID NO: 3928 - DNA, 2385 bp, Trigonella foenum-graecum
cggccgggggacactccatcatcttcctctttcaaaccacaaccctaatctcacatatccttcgttcgggtccatcttttcatcggaaccgacgttggccagatctatcttctctctcatccgttagggttttgtttgaaattcgaagatggtttccgacgctagcaagaagaaagctgctcagaagaaagccgccgccgccgctaaacgtggtggtaaggctgccgtcgctgctgcttcttccaaagctgctgataaggttgctgataaaatcagtgatatgaagatttcggatcggacttgtactggtgttctttgctctcatcctctttctagagatattcggatagagtctctgtcggttacttttcacggacatgatctcattgttgatactgaattggagttaaattatggaaggcgttatggtttacttggattaaatggctgtggaaagtccactctacttactgcaatcggaaagcgggaacttccaattcctgagcacatggatattcatcaccttagcagggaaattgatgcctctgacatgtctgcattggaagctgtcatagcctgtgatgaagaaaggttgaaactggagagagaagctgaaacattggcagctcaggatgatggaggtggtgaagcccttgaacgtatttatgaacgattggatgccctagatgcatcaactgctgaaaagcgtgctgctgaaatcttgcatggtcttggttttgacaagcagatgcaggcaaagaagacacgtgatttttctgggggttggagaatgagaattgcattagcacgagctttatttatgaaccctactgttcttctacttgatgagccaactaatcatcttgatttggaagcttgtgtgtggctggaggagagtttgaagaagtttgagcgtattttggttgtgatatcacattctcaagatttccttaatggtgtctgcacaaatattatccacatgcaaagtaagaaactgaagatctacactggtaactatgatcaatatgttcagactcgtggtgacttggaagagaaccagatgaagcagtacaagtgggaacaggagcagattgccaacatgaaggagtatattgctcgatttggtcatggttcagcaaaactagctcgccaggctcagagtaaggagaaaactctggcaaaaatggaacgaggtggactcactgagaaggttgtcagagatcaagttttagtattccgctttactgatgtggggaaacttccccctcctgttctccagttttctgaagtaagttttggttacactcctgataatctcatctacaaaaacattgactttggggttgacttagactctaggattgctctggttggaccaaatggtgctggaaagagtacactgctgaagctaatgacaggtgatttgtttcctagtgatggcatggtcaagcgtcataatcatcttcgaattgcacaatatcatcagcacttggctgaaaagttagacttggacgtgcctgcccttcagtttatgatgaatgaataccctggaaatgaggaagagaagatgagggcagctattgggaggtttggactgacaggtaaagcccaggtgatgccaatgaataacttgtctgatgggcaaaagagtcgagtgatatttgcgtggttagcttggaggcagcctcaattgctacttttggatgagccaactaatcatttggatatcgagacaattgactctctggctgaggcattgaatgagtgggatggcggcttggtgcttgttagccatgactttaggctcattaatcaggtggcgcatgagatatgggtgtgtgccgatcagaaagtgactagatgggagggtgacattatggatttcaagaagcatctaaaggcaaaggcagggatattggactgaagctgttagtgagaatagggatagaactaggccaaaccaccatcctttggagacttatggccttgcttacaaagtttatcaaataaatctggtttgctgggatattggctgttcccatatattactagcttaatgatttactacaaccaatatcttggtgggtgcctccattttttgcaatgttggtggtgattgttgagttcaatggcagaattggaagtgcaatcatttttgtttggattgagacatatctttcaccttggtggacttaaaatatattttttttccttattatttgttgtgcttatcatttaattgcttggttcttgaccagcaagatggataatgggacatcatctcgagctagatgtgatctctaactgaaccttaaatgatgcttattctataaatttgttgtaccgaaaattctatatttatgatattagtaactagtattatta

SEQ ID NO: 3929 - DNA, 2353 bp, Podocarpus macrophillus
aagaaatctgagcatttcttctctgaattgaaggcagctttgtgcaggaggtcgatatctacctttctctctggtttattgagcctcagatcccctccgaggttgtaaaatggtgtctgacgcgagcaagaagaaggccgccgctaaaaaggcagccgccgcagcaaagagagggtctaagtcagcagccgccgcttctgtagctccatcagcgtcgcagaatggtaaggccgttgccgaagtcgagaaagcgactagcgacatgggcgagatgaggatttctgatcggacttgtactggggtcctttgctcccatccccagtctcgagacattcatatagaatccttgtcagtgacattccatgggcatgatctggttgttgattcagagcttgagttgaactatggaagacgctatggattgcttggccttaatggatgtggtaaatctactctacttacagccatagggtgtcgggaacttccaattccagagcatatggacatatatcatttgaccagggagattgatgcaactgatatgacttcgcttgatgctgttatgaattgtgatgaagagaggcttaggcttgagaaagaagttgaagctctggcaggccaagatgatggaggtggagagcaactagatcggatatatgaacgattagatgcattggatgctgcaacagcagaaaagcgagctgctgaaattttatttggattaggatttaacaaagtaatgcaggcaaagaagacacgtgatttttctggtggatggcgtatgcggatagcattggcccgggcattgttcatgaaccctacgattttgttactagatgaacctacaaatcatcttgatctggaagcttgtgtatggctggaggaaactttaaagaactttgatcgaattctggttgtagtatcccattcccaagactttcttaacggagtttgcacaaacataatccacatgcaaaataaaaaattgaaattgtataccggcaactatgatcagtatgttcaaacacgatccgagctagaggaaaaccaaatgaagcagtacaggtgggaacaagaacagataagttcaatgaaggaatatatagctaggtttggtcatggttctgcaaagcttgccagacaagcacagagtaaagaaaagaccctggcaaagatggaaagaggaggtcttacagaaaaagttgtcagagataaagttttagtgtttcgtttcaccgatgttgggaagcttcctccgccagtccttcagtttgtggaggttacttttggatacactcctggaaaccttatatacaagaatattgattttggagtggatctggattcacgaatagctctggttggtccaaatggagcaggaaagagtacattgctgaagctgatgactggtgatctaactccctcagacggcatggtaaagcgacataatcatctccgtattgctcagtatcatcaacatctaacggagaaattggatctggaaatggctgcactgcaatatatgatgcatgaatatcaaggtattgaggaagaaaagatgcgtgcagcaataggcaaatttgggctgacagggaaagcccaaattatgcctatgaagaacttgtctgatggacagagaagtcgagtgatttttgcatggcttgcttggaggctacctcatctacttctgctagatgaaccaactaatcatcttgacattgaaaccattgattcacttgctgaagctctgaatgagtgggatggaggacttgttctagttagccatgattttcggctcataaaccaggtggccaaggaaatatgggtttgcgaaaataagaccgtcacaagatgggaaggtgatattatggatttcaagcagcatttgaaggccaaggctggcctgtgagtgcgtttagacacatctgcatgagctacttaaaatttgttctgaagagacattatcatcatggttatttttattttttagggacttaggaacacctcattgctgatgaaagtaattctgttgtattcattaggtagatatttttggctgaaattagcattctgttgttattatgtcactgcttcttaattgtttacggcctcatagaactagaacgaactcactaagcttctatccagctgcgcaaaatttcagtagcacatgtagtgctcatttgctttttctttgagccagctgttctaaatttctatagcacagcgagtgctcatgatattgaaccattgcagtagtggttatatttatgttgtaagcattttaatgtttgaggctgaaaagaaatcacttccaattagtcattagaaattcttcaactgattaattttt

SEQ ID NO: 3930 - DNA, 1903 bp, Festuca arundinacea
  misc_feature (70)..(70): n is a, c, g, or t
  misc_feature (883)..(883): n is a, c, g, or t
ggtgtccgacgccagcaagaagaaggccgcgcagaagaaggccgccgccgccgccaagaggggtgccaantccagcgttgccgcatcgtcctcgtcggcgacggccgcagccgataaggcggccgacaacttattggcgctcagcctatcggatcggacctgtactggggtcctggcctcccatccgctctcccgtgatatccacatagagtccctttcattaacgtttcatggccatgaccttatcgtggattcagagctggagcttaactatgggaggcgttatggtttgctcggcttaaatggttgtggaaaatctacccttctcacagcaataggccacagggaacttcctatccctgaacacatggacatacaccatctcacctgtgagattgaggcttcagacatgtctgcgctgcaagctgttatctgttgtgatgaagaaagaatcaagttggaaaaggaagctgaaattttgtctgcacaggatgatggcggtggtgaagctttggatcttgtatatgagcggttagaagcaatggatgcatcaactgctgaaaagcgtgcagctgagatattgtttggtctaggttttgacaagaagatgcaagcaaagccaactagagatttttctggtggttggcgtatgaggattgcgttggcaagggcgctgttcatgaacccgaccatccttttgcttgatgagccaactaaccatcttgatcttgaggcttgtgtctggctggaagagaaattaaagaattttgagcgtatacttgttgtcatctcacactcccaagattttctgaatggagtgtgcactaacatcatccacatgcagaacaaaatcctcaagttatatactggtaattatgaccantatgtgcaaacccgctctgaacttgaagagaatcaaatgaagcagtataaatgggagcaggaacagatcgctggtatgaaggagtacatcgcacgttttggtcatggatctgcaaagcttgctcgtcaggctcagagcaaagagaaaactcttgcaaagatggagcgtgctggtcttgctgagaaggttgtcaatgacaagattctggtgttccgctttacagatgttggcaaactcccaccaccagtgctacagtttgctgacgtgacgtttggatacactccagataatctcatttacaagaaccttgactttggtgttgaccttgactcaagagttgcactggttggtcccaatggtgcggggaaaagcacacttctgaagctcatgaccggtgacctaactccattggacggcatggtcaggcgccacaatcatctacgcattgcacagttccatcaacatctcactgagaagctggacctggacatgccagccctgcagtacatgatgagggaataccctgggaatgaggaggagaagatgagagctgcaattggcaagttcggcctgtcagggaaggcacaggtaatgccaatgaataatctgtcagatgggcagaaggcccgtgttatctttgcttggctggcattcaggcagccacagatgctgttgcttgacgagccaacaaatcatcttgacattgagaccatagactcccttgctgaagcactgaaggaatgggacgggggattggtccttgtgagccatgacttcaggctgattaaccaggttgctcaagagatctgggtgtgtgagaaacaggcggtgaccaggtgggaaggtgatatcatggatttcaagcaacacctgaagaagagggctggtctctagagtgcctttgctttttggtcctcggctctttggagatctatagacaacccaaagttttgcctctgtatcagaaaagttttaattttctagagcaactacatgtatgagtacctcggccgcgcccac

SEQ ID NO: 3931 - DNA, 2114 bp, Helianthus annuus
gatgcgagcaagaagaaggctctgcagaaaaaggcggctgcagccgccaaacgaggcggtaaggcggcggccgctgccacgtcggctaaagcggcggcggttggtacgatgaatggtagttctagttcggataatttgtcgaatgggatggggaatcttacgatatcggatcgtacgtgtactggtgttctttgttctcatcctttgtctagagatattcggatagaatccctgtcacttactttccacgggcatgatcttcttgttgatacagagctcgagcttaattacgggagacgttacggtttgcttgggttaaacggctgtgggaaatcaactcttcttacttcaatcggaatgcgagaactcccgatccccgaacacatggacatattccatctcacccgagagatcgaagcttctgacatgtcatcactcgaggccgtgatgaattgtgacgaagaaaggctgaaattggaagccgaagccgaacgcttagttggacaggatgatggtggcggtgaagcacttgaacgcgtctacgaacgtttggatgctatggatgcatccacagcagaaaaacgtgcagccgagattttgaacggtttaggtttcaacaaaatgatgcaagcaaagaaaactcgcgatttttctggtggttggaggatgagaattgctttggcccgtgcgttgtttatgaacccaaccattttgctgctagatgaacccacaaatcatcttgatcttgaagcgtgtgtgtggctggaagaaactttaaagaagtttgaacggattcttgttgtcgtctcgcactctcaagatttcttaaacggtgtatgcacaaacataatacacatgcaaagtaagaaactgaagatgtataccggtaacttcgaccaatatgttcaaacccgttcggaactcgaagagaatcagatgaaacagtacaaatgggagcaggaccagatcgctaacatgaaggaatacatagcacggttcggacacgggtccgctaagctcgctagacaggctcagagcaaggagaaaaccctagcgaaaatggaacgtggtgggttaaccgaaaaggttgcgcgcgacaaggttctcgttttccggtttgttgacgtgggcaagcttccgccgcctgtgcttcagttcgtagaggttacgttcggttacacacccgataaccttatatacaagaatcttgactttggtgttgatctcgattcgcgtgtggcgttggtcgggcctaacggagcgggtaagagtacgcttttgaagctgatgacgggagagttggttcctcttgacggaatggtgaggcggcacaaccacttgcggatcgcgcaataccaccaacacttggcggaaaagctcgatctcgaaatgtcggctttggcgtacatgatgaaagagtacccgggaaacgaagaggaaaagatgcgggcggcgatcgggagattcggattaaccgggaaagcccaagtgatgccgatgaagaacttatccgacggtcaaaagagccgagtgatcttcgcatggttggcttatcgccaaccgcagatgctgcttttggatgagccgactaaccacttggatatcgagacgattgactcattagccgaggcgttaaacgaatgggacggtggaatggtgctcgttagccacgacttccggctcattaaccaggtggcgaacgagatatgggtatgtgaaaatcaaaccataacgcggtgggaaggtgacatcatggggttcaaagaacatttaaggaataaggctggtctttagatcagtaagccggttgcggtcatagatccacatggtaccaagctcaagggcccgtactccgtaggtcggttcttacggcaacttgggttgggaccggcgtgtcgagtggctaacggtttgtagaggacgtggttcatgctggtgtggaactatgattataaaaattcacaggttgaaccttaggaagttttatcatcctcttatattaatctttacttgtttttcttgcataatattctgaatttggatttaccaacaaaaacatatgcattacctatgatttgctaaaatttatctaaagtgtaatgacctatgaccta

SEQ ID NO: 3932 - DNA, 2399 bp, Aquilegia formosa
gttggctactactcctcaaactctctacatcggtttttgttctctctgacaaaagctgacccttttctctcttctctctttcttctcacaaccaccaaaccaaagagagagaaacaaagagaaacacaacaacaacagcctccaaaccctaaattagtgtctaatcttaacttttcagatccgcacttatttcatctaaagtgaaaatatggtttctgatgcaagtaagaagaagttagctcaaaagaaagctgccgctgctgctaagagaggaggaaaagcttcatctgcagcaacatcatcaaagtctggaacttctaatggaattggtgttgataagataactaatggagttgattcactgcatatatcggatcgaacgtgcaccggtgtgctcgcttctcatcctatgtccagagatatccatatagagtctttatctcttaccttccatggccatgatctaatagtggattctgaattggagcttaattatggaagacgctatggtttgcttggcttgaatggttgtgggaaatctacgcttcttacttcaatcggttgcagagagctccctattccagagcacatggatatctatcatcttagcagggagatagaagcctctgatatgtctgcactggaagctgttataaattgcgatgaagagaggcttcaattggagaaagaagtagaaattttggcagcagaggatggtggtggtggagaggccctggaacgcatatacgagcgcttagatgcattggatgcttcaactgctgagaagcgtgctgctgagattttgtttggacttggttttgacaagaagatgcaatctaaaaaaactcgagatttttctggtggttggcgaatgaggattgctttggcacgtgccttgtttatgaaccccaccatacttcttctggatgaacctacaaaccatctcgatttggaagcttgtgtctggttggaggaaatgctaaagaagtttgatagaatcctggttgtggtatcacattcccaagatttcctgaatggtgtttgcacaaatatcatacacatgcagagcaagaagctgaagttctacagtggtaactatgatcaatacgtgcagacccgatcagagcttgaagaaaaccagatgaagcagtacaagtgggagcaagaacaaatttctaacatgaaggagtacattgctaggtttggccatggttctgcaaagctagcccgacaggcacagagcaaggagaagacactggcaaagatggagcggggtgggctcactgaaaaggtcgctagggaccaggttttagttttccgattcactgatgttggcaaacttcctccaccagtactccagtttgtggaggtcaaatttggctatactcctgaaaatcttatttacaaaaaccttgattttggggtggatttggattcaagagtagcacttgtgggtcctaatggagctggtaagagcacactgctgaagctaatgacaggggatctgactcctcttgatggcatggttaagcggcacaatcatctgaagattggacaatatcatcagcatttgactgagaagcttgacttggagatgcctgcccttcagttcatgatgagggagtatcctggcaatgaggaagaaaagatgagggcagcgattgggaagtttggactgactggcaaggcccaagtcatgccaatgaaaaacttatctgatggccagaaaagcagggtgatttttgcatggttggcatggaggcaaccacaaatgctgctattggatgaacccacaaatcatctggacattgaaaccatagactcactggcagaggcacttaaagagtgggatggtggattggttcttgtcagccatgacttcaggctcataaaccaggtagcaaaagagatttgggtgtgtgagaaacaggcagtaacccgatgggagggcgacattatggatttcaaggcacatctcagacgcaaggctggtttgttggattgaggtagcaaagagaacaaaactattggggagctatttcatggccgcaatagatatctagctcatctttgtgttatgatgcaatcgagggtccaaattactgtttttggtgaaagtggcctatgttgatgacgatgacgaaattgaggctgggtattgttgtaatcccacacgtttggtatttttgtgcgagcccacaggtctgatatggtcttctatatgaggtagctatataaattttattacaagtcaaaggtggtatatggtgaggatttcttatttgtagtcgctagtgttatcctaaatttagttgtttttgcgcttcattggatttgagttataaattaagttgcactctggcgaataatcaaaatgacattaaaattttgttttaaag

SEQ ID NO: 3933 - DNA, 2439 bp, Aquilegia formosa
gttggctactactcctcaaactctctacatcggtttttgttctctctgacaaaagctgacccttttctctcttctctctttcttctcacaaccaccaaaccaaagagagagaaacaaagagaaacacaacaacaacagcctccaaaccctaaattagtgtctaatcttaacttttcagatccgcacttatttcatctaaagtgaaaatatggtttctgatgcaagtaagaagaagttagctcaaaagaaagctgccgctgctgctaagagaggaggaaaagcttcatctgcagcaacatcatcaaagtctggaacttctaatggaactggtgttgataagataactaatggagttgattcactgcatatatcggatcgaacgtgcaccggtgtgctcgcttctcatcctatgtccagagatatccatatagagtctttatctcttaccttccatggccatgatctaatagtggattctgaattggagcttaattatggaagacgctatggtttgcttggcttgaatggttgtgggaaatctacgcttcttacttcaatcggttgcagagagctccctattccagagcacatggatatctatcatcttagcagggagatagaagcctctgatatgtctgcactggaagctgttataaattgcgatgaagagaggcttcaattggagaaagaagtagaaattttggcagcagaggatggtggtggtggagaggccctggaacgcatatacgagcgcttagatgcattggatgcttcaactgctgagaagcgtgctgctgagattttgtttggacttggttttgacaagaagatgcaatctaaaaaaactcgagatttttctggtggttggcgaatgaggattgctttggcacgtgccttgtttatgaaccccaccatacttcttctggatgaacctacaaaccatctcgatttggaagcttgtgtctggttggaggaaatgctaaagaagtttgatagaatcctggttgtggtatcacattcccaagatttcctgaatggtgtttgcacaaatatcatacacatgcagagcaagaagctgaagttctacagtggtaactatgatcaatacgtgcagacccgatcagagcttgaagaaaaccagatgaagcagtacaagtgggagcaagaacaaatttctaacatgaaggagtacattgctaggtttggccatggttctgcaaagctagcccgacaggcacagagcaaggagaagacactggcaaagatggagcggggtgggctcactgaaaaggtcgctagggaccaggttttagttttccgattcactgatgttggcaaacttcctccaccagtactccagtttgtggaggtcaaatttggctatactcctgaaaatcttatttacaaaaaccttgattttggggtggatttggattcaagagtagcacttgtgggtcctaatggagctggtaagagcacactgctgaagctaatgacaggggatctgactcctcttgatggcatggttaagcggcacaatcatctgaagattggacaatatcatcagcatttgactgagaagcttgacttggagatgcctgcccttcagttcatgatgagggagtatcctggcaatgaggaagaaaagatgagggcagcgattgggaagtttggactgactggcaaggcccaagtcatgccaatgaaaaacttatctgatggccagaaaagcagggtgatttttgcatggttggcatggaggcaaccacaaatgctgctattggatgaacccacaaatcatctggacattgaaaccatagactcactggcagaggcacttaaagagtgggatggtggattggttcttgtcagccatgacttcaggctcatcaaccaggtagcaaaagagatttgggtgtgtgagaaacaggcagtaacccgatgggagggcgacattatggatttcaaggcacatctcagacgcaaggctggtttgttggattgaggtagcaaagagaacaaaactattggggagctatttcatggccgcaatagatatctagctcatctttgtgttatgatgcaatcgagggtccaaattactgtttttggtgaaagtggcctatgttgatgacgatgacgaaattgaggctgggtattgttgtaatcccacacgtttggtatttttgtgcgagcccacaggtctgatatggtcttctatatgaggtagctatataaattttattacaagtcaaaggtggtatatggtgaggatttcttatttgtagtcgctagtattatcctaaatttagttgtttttgcgcttcattggatttgagttataaattaagttgcactctggcgaataatcaaaatgacattaaaattttgttttaaagttctctagtctattatattccagctacatgatttttagtg

SEQ ID NO: 3934 - DNA, 2522 bp, Tropaeolum majus
cggccggggctctttacatccccttaaccctactatcgggattgttgctcctccttcccaactagtaataccacctaaattacacacaccatacgaaaacctagatctaaaatcttatcgtaaactcgattctcatccgtcatcagatctttagattcttagttctcaaaggttgaaagaaaatggtgtcagacgcgagcaagaagaaggcggcacagaagaaagctgcggcagcggctaagagaggaggaaaggctccggctacatctaaggcggcggctccatctgatggatcgaacggtgccgcttctttgtcaaacgggattgatgcgatgcatatatccgatcgtaactgtaccggtgtcctttgctcgcatcctctctccagagatattcgtatagagtccttatcagtcacttttcatggacacgatctcgtagtggacactgagttggaacttaattatgggaggcgttatggactacttggtctaaatggttgtggaaaatctactcttcttacttcaatagggttgcgtgaactcccaattccagatcacatggatatttaccacctcagcagagagattgaagctactgatatgtcatcgctagaggcagtcatgagttgtgatgaagagagattgaaattggagaaagaagctgaagtgttggcagcacaggatgatggaggtggagaacaactggaacgtttatatgagcgtttggacgccatggatgcttcaactgcagagaaacgtgctgctgaaattttgtttggtcttggttttgacaagaagatgcaggcaaagaaaacacgtgacttttctggaggttggagaatgagaattgccttggcaagggctctttttattaaccccactattctgttgcttgatgagccaacaaatcatttagatttggaagcttgtgtctggctggaggaaaccctcaagaactttgagcgcatccttgtggttgtatcacattctcaggatttcctgaatggagtatgtacaaatattatccacatgcagagcaaaaaattaaagatgtatactggaaactatgatcagtatgtccagactcgttctgaacttgaagagaaccaaatgaaacaatacaagtgggaacaagaacaaatttcaaacatgaaagaatacatcgcacgatttggtcacgggtcagctaaacttgcccgacaggcccagagcaaggagaaaacattggcgaagatggaaagaggagggcttactgaaaaggtatctagagatcatattttagtattcaggtttgttgatgttggtaagcttccaccaccagtgttgcagtttgtggaagtttcatttggttacactcctgacagtctgatttacaagaacattgactttggggtagacttagactcaagggttgctcttgtgggacctaatggagcagggaagagtactctgcttaagctgatgactggggaattaacccctagtgaagggatggtcaggcgtcataaccaccttagaattgcacaataccatcagcacttgacagagaaacttgatatggatttgtcggctctggcatacatgatgaaggagtaccctgggaatgaagatgagagcagcagtaggtaagtttggtctgtctggaaaggcacaggttatgccaatgaagaacttgtcagatgggcagaaaagtcgtgtgatttttgcatggctagcatttaggcaaccacaaatgcttcttctagatgagcccactaatcatttggatattgagaccattgactcgctagctgaagcactgaaggagtgggatggaggcatggttctagttagtcacgatttcaggttgattaaccaagttgcccatgagatttgggtttgtgagaaccaaaagatcaccaagtggggaggtgacattatggacttcaaacaacatcttaagagcaaggctgggttatgaagtgtttgaagttcagcgtacaacttatactgttctggggcttcaaggttgtgttttattaacgcaatagaagaatacggtaaccacctctgggtgagttattttccagggtggaatagagcagcagagggtaggaggatggctgttattggttgaagccgttagtttcactactctctgcatagttgtaaggtaatattttgttttaatggcctatttgcctatctggacctcatagtagttttctccatggaccgaggcttttttatattttaggtgtttctttaatactatgctcctgtgagaaccttatatagtgtctttggagatgcattattgttatttgattctattctgtactcggagatgacttatggtattttaaattttggttgttagcttttcctttattggtatatttgtgggacgtcaactatttcgcttttctttctgctgtctagtggctatttatctctagcaaagctgcttgtactgcctttttgctacagtgcggatgtgtgctctacaagttggaaggaatagcaaagctgcttgcactg

SEQ ID NO: 3935 - DNA, 2374 bp, Mimulus guttatus
ctttcccaacagacgcactgccgcagaactattgtccgagcaaaacggtagcgcaaacgaaaccctagatcttaacaccctcgagatttttcaagatggtttcggatgcgagtaagaagaaggcggctcagaagaaggcggcggctgctgcgaagagaggaggaaaggctgtggcggtcgccgcctcgtctaaggctgctgagaacggcagcaaagtagatagcttggccagtggagtcggagatcttcatatatctgatcggacgtgtaccggagtcctctgctcgcatccccagtctagagatattcggatagaatctctttcactcactttccatggtcacgatctgatagttgactcagaactggagctcaattatggcagacgctatggtttgcttgggttaaatggctgtgggaagtccactcttcttacttcattaggttgccgggagcttccaattcctggacacatggatatctatcacctttctagggagatcgaagcttctgacatgtcttcacttgaggctgttatgagttgtgatgaggagaggctgaaattagagagggaagctgaagtattggctgcacaggatgatggtggtggtgaaccacttgagcgcatttatgaacgtttggaattaatggattcatcaacagctgaaaaacgagctgctgagatattatttggtctcggttttgacaagaaaatgcaacaaaagaaaacacgagatttttctggtggctggaggatgaggattgctttagcaagagctcttttcatgaacccaaccatactgctgcttgatgaacctacaaatcatcttgacttggaggcttgtgtgtggttagaagagatgttgaaaaacttcgaccgtattctcgtagtggtgtcgcattcccaggattttctgaatggagtctgcacaaacatcattcacatgcagagcaagaagctaaagatctactctggcaactacgaccaatatgtccaaacccgctcggaactcgaagagaaccagatgaaacagtacaagtgggagcaggagcaaatatcctcgatgaaggaatacattgctcgctttggtcacggttctgccaagcttgcccgtcaggcccagagcaaagaaaaaactctagcaaagatggagcgtggtgggttaacagagaaggtggcaagagatagcgtccttgttttccgattcacagatgttggaaaattaccccctcctgtccttcagttttccgaagtgacattcggctacactcctgataatctcatctacaagaaccttgactttggtgttgaccttgattcgagaattgcccttgtgggacccaatggagctggaaagagtacacttctgaagctgatgactggtgatttggttcctcttgatggaatggtccgccgtcacaaccacctgagaatcgcacagtaccaccagcacttgactgagaagcttgatgttgaattgtctgcgctcgagtttatgctgaaggagtaccagggtaccgaggaggagaagatgaggagtgcagtgggaaggttcggtattagtggcaaagcccaaacgatgcctatgaagaacctgtctgatgggcagaggagccgtgtgatttttgcttggctggcatacaggcagccacagatgctgctgttggatgagccaaccaatcatttggatatcgagaccattgactctcttgccgaggctttgaaggagtgggacggtggtttggttctggtgagtcacgattttaggctgattaaccaggtggcgcacgagatttgggtgtgcgagaatcaggcggtgactaggtgggagggtggcatcatggacttcaagcgccacttgaaggctaaggctggtttgtaagaagtccatatatttagagagagaggatttcctggccgtagctatgaggatatgcatgtaatatgctattctcgtgtgttgtggtgaaagtcgatgagggtaatttggtcattactgtgagcatgtttggttctaagtccctctatgcaggaagaagctgaattgaagcttgacttagcttttatttatatggatatttgctgggtgttaccttacttcgcctggtcacagccaacggcggaaagggtattgcctgtattctcttttttctttttttctttttttctttttttgcgtaattatatgaattttgatgatgccgtactcgaatatttggcaatgttttatcttttattttttgccctagtattttcataattaatacggagtagaccattagatgagtgcagacaatatgtaatacctactactactattattcttgtgtaataactcatttctattcggctttatggtctcgttttacgttc

SEQ ID NO: 3936 - DNA, 2161 bp, Helianthus annuus
cctcctatttctgaggcctcttcttcctcctgctcacatccaccacacatcggccgttaattcactccgcaacccccagatctctcactttccgatctcaagatggtgtcagatgcgagcaagaagaaggcgctacagaagaaggcggccgccgccgccaagagaggaggtaaagcagccgccgccgccacttccgctaaggcggcggctgttggtacgatgaacggcagttccagctcggataatttgtccaatgggatggggaatcttacgatctctgaccgtacttgtactggtgttctttgttctcaccccttgtctagggatattaggatcgagtctttgtccttaactttccatgggcacgatcttcttctcgataccgagctggagcttaactacgggagacgttatggtttgcttgggttgaacggctgtgggaaatcaactcttcttacttcactcggattgcgcgaacttccgatccccgaacaaatggacatattccatctcacaagagagatcgaagcttctgacatgtcgtcgcttgaggcagtgatgaattgtgacgaagagaggctgaaattggaagaagaagccgaacgcttagctggacaggatgctggtggcggtgaagcacttgatcgtatctacgaacgtttggatgctatggatgcatccactgcggagaaacgtgctgctgagattttaaacggtttgggtttcaacaaacaaatgcaagcaaagaagacacgggatttttctggtggttggagaatgagaattgcgttggcgcgtgctttgtttatgaacccaactgttttgctgctcgatgaacccacaaatcatcttgatctcgaggcctgtgtctggctggaagaaacgttaaagaagtttgagcggatactcgttgttgtgtcgcactctcaagatttcttgaacggtgtatgcactaacatcatacatatgcaaagtaggaaactgaagatgtataccggtaatttcgaccaatacgttcagacccgttcggaactcgaagagaatcagatgaagcaatacaaatgggagcaggaccagatcgctaacatgaaggagtacatagcccggttcggacacgggtctgctaagttggctcgacaggctcagagcaaggagaagacgttagccaagatggaacgtggcggtctaaccgaaaaggtgtcgcgcgataaggttttggtgtttcggttcgttgatgtcggcaagcttccaccacctgtacttcagtttgtcgaggttacctttggttacacacccgataccctcatctacaagtccatcgacttcggtgttgacctcgattcccgtgtggcgttggtgggaccgaacggagcgggtaagagtacgcttctaaagctgatgacaggggagttggttcctcttgacggcatggtgaagcgtcacaaccatttgaagatcgcacaataccaccagcatttagctgaaaagctcgatctcgaaatgtcggctttgctgtatatgatacgcgagtacccgggtaacgaagaggaaaagatgcggtcagctatcggaaggttcgggctaaccggaaaagcccaagtgatgccgatgaagaacttatcagacggtcaaaagagccgtgtgattttcgcgtggttagctttccgacaaccacaaatgctgcttttggacgagccgactaaccatctggacattgaaacgattgactcgttagcggaggctttgaacgagtgggatggtggtatggtgctggtgagtcacgactttaggttgattaaccaggtggcgaaggagatatgggtgtgtgagaatcaaacgataacgcgatgggaaggtgacatcatgggattcaaagagcacttgaggagtaagtctggtctatacgattagatcatagtgtccgcataaaaggtgtgttcttatggaccggcatgctgtcgtgggactatgagataataggatgtggaattttaggggatgttgaacttttttcatcctttttcggacacctgtttttaatttttagttgcactatattttgaattttgttttgccaacaaagaacatatcatatgccttcggctttcgtacttatattgctacaattttattgaagagtgtaatacgtacttctatgttt

SEQ ID NO: 3937 - DNA, 2134 bp, Arnica chamissonis
tcaaaccctagatctttccctttccgatctcaatatggtgtcagatgcgagcaaaaagaaggcgctccaaaagaaggcagccgccgctgcaaagagaggaggtaaggcagcggccgccgctacttcagctaaggcggcggcaatcggtacgatgaacggcagctccagttcggataacttgtcgaatgggatggggactcttacgatctcagaccgtacttgtactggtgttctctgttctcacccgttgtctagggatattcggatagaatctttgtcacttactttccatgggcatgatcttcttgttgatacggagctggagcttaattacgggagacgttatggtttgcttgggttaaatggctgtgggaaatcgactcttcttacttcaattggaatgcgagaactcccaattcctgaacaaatggatatattccatctcacccgagagattgaagcttctgacatgtcatcacttgaggctgtgatgaattgtgatgaagaaaggctgaaattggaagcagaagctgaacgcttagctgcacaggatgatggtggtggtgagccacttgaaagaatctacgaacgtttggatgctatggatgcatccactgcagaaaagcgtgcagctgagattctaaacggtttaggttttgacaaaaagatgcaagacaagaaaactcgggatttttctggtggttggagaatgagaattgctttggctcgtgctttgtttatgaacccaaccgttttgctgctagatgaacctacaaatcatcttgatcttgaagcttgtgtgtggttggaagagactttgaagaactttgagaggattcttgttgtagtctcacactctcaagatttcttgaatggtgtatgcaccaacataatacacatgcaaagtaagaaattgaagatgtataccggaaactttgaccgatatgttcagacccgttctgaactcgaagagaatcagatgaaacagtacaaatgggagcaggaccagattgctaacatgaaggaatacatagcccggtttggtcacgggtcggctaagcttgcacggcaagctcagagcaaggagaaaaccctagctaaaatggaacgcgatgggttaactgaaaaggttactagggacagtgtcctggttttccggtttgttgatgtgggcaagcttccgccacctgtacttcagtttgtagaggtttcttttggttacacacctgataaccttatctacaaaaaccttgactttggtgttgacctagactcccgtgtcgctttggtgggacctaacggagctggtaagagtacacttttgaagctgatgacaggggagttggttcctcttgatggcatggtgaggcggcacaaccacttgaggatcgctcaataccaccaacatttggctgaaaaactcgatctggaaatgtcggctttgttgtatatgatgagagagtacccaggaaacgaagaggaaaagatgcgggcttccatcgggagatttgggctgaccgggaaagcccaagtgatgcccatgaagaacttgtcagacggtcaaaagagccgtgtgatatttgcatggttagcttttagacaaccacagatgctgcttttggacgagccgaccaatcacttggatattgagaccattgactcgttagccgaggcattgaaagaatgggatggtggattggtgctggttagccatgactttaggctcattaaccaggtggctcaagagatatgggtgtgtgaaaatcaaaccataacccggtggggaggtgacattttggcttttaaagagcatttaagggctaaggctggtctttagtaaaccagttgcaatcatagactccacacactaccaagctgaagggtcagtaggtcggtccttatggcaacttgggttgggaccagcatgtggagtggctaatggcttgcagaggcatggttcatgctgaggtgggactatgattataagctgaaaaaacgatttttgttgaggaacttgatgacattttaatctagttttgtttttcttgcactatattttgaatatgatactaccaacaagaacctatttgctacaattttatttcaagtgtaatgacttactcctatgttgtat

SEQ ID NO: 3938 - DNA, 2373 bp, Cephalotaxus harringtonia
gctagttctcttaaatacgatcggaagaaagaaaagaaaagaactgccacccattgtttgaattcgatcggctatatcaggtttctctcttccaataatccgccctctcagatcccctcgtaaggctctacaatggtttctgatgcgagcaagcagagggcggccgccaagaaggcagccgctgcggcaaagaggggtgccaagtcagcggtagccgcagcgcccaagtcagatgcagcaccatccaagttatcagatgtgtcgcagaatggcaaagccagcgccagcgtggacaaagcagccgatgaactggctgccctgagtatatccgatcggacatgtactggcgttctttgttctcaccctctctctcgagatattcatatagaatccttgtcagtcactttccatggccatgagttgattgttgattcagagcttgagctgaattatggaagacgctatggattgcttggacttaatggatgtgggaaatctacacttcttacagctctagggtgtcgagagattcctataccagagcatatggatatatatcatttgaccagggaaattgaggcaactgatatgacttcacttgaagctgtcatgaactgtgatgaagagaggcttaagcttgagaaagaagccgaagctttggccgctaaagatgatggaggtggagaggcactggatagaatatacgaacgtttggagctcttggatgctgctacagcagaaaagcgagctgctgaaattttatttggcttaggttttactaagaaaatgcaagcaaaaaagacacgagacttctctggaggctggaggatgagaattgcactggcacgtgcattattcatgaatcctacaattttgttattagatgaacctacaaatcatctagatcttgaagcttgtgtatggcttgaggaaactctgaagaaatttgatcgtatattggttgtaatatcacattcccaagactttctcaatggagtttgtacaaacattattcatatgcaaaataaaaagctgaaattatatacaggaaactatgatcagtatgtacaaacacggtctgagctagaggaaaaccagatgaagcaatacaggtgggaacaagagcagatttcttcaatgaaggaatatatagctaggtttggacacggttctgcaaagcttgcaaggcaagcacagagtaaagaaaagaccctggcaaagatggaaagagggggcctaacagaaaaagtggttagagataaagtattggttttccgattcactgatgttgggaagctccctcctccagtgcttcagtttgtggaagtagattttggatacactcccgagaaccttatatataaaaatgttgattttggagtggatctggattccaggatagctttggttggtccaaatggagctggtaagagtacattgctgaagctgatgactggtgaattgaccccattggatggcatggtaaagcgccataatcatctccgtattgctcagtatcaccagcatcttaccgagaaactagatctggaaatgtctgcactgcagtacatgatgcatgaatataatggtattgaggaagagaagatgcgtgcggcaattggaaaatttggactgacagggaaagcccagattatggcaatgaaaaacttgtctgatggacagaaaagtcgtgtgatttttgcatggcttgcttggaggctacctcacttgcttttgctagatgaaccaactaatcatcttgacattgaaaccattgattcacttgctgaagcactgaatgagtgggatgggggacttgttctggttagccacgactttcggctcataaaccaggttgccaaggaaatatgggtatgtgaaaataagtctatcacaagatgggaaggtgatattatggatttcaagcaacatttaaagagcaaggctggcctgtgagggcatttgccatctgcgcctttgtgctactggaagtttgtttttgagagacatacacaacacatacatgttcattttattatttttttgatttaagaaagccttgttataggcttaagtctgttgtaggctataagcaattctgttgtattggtctagatagatgttttagggtaaagttaacaaaatcttttactgaaatcaatgctactacatgtttatggtctcgaaactgttgtattggtctagataaatgttagtgtctagatagattttatacggtaaattagcaatcctgcgttgttatcactgccacaacatgtttatggtctcaaagaactaagagtccagatttaattctgcttgaggccagatatatattgttatatagcttgtgcatcacaggcatttggaatg

SEQ ID NO: 3939 - DNA, 1981 bp, Cajanus cajan
agaaggcagccgacaagctcgccgacggaattggggacattcagatttctgatcggacctgcactggtgtcctctgctcgcatcctctttccagggatattaggatagaatctctgtcagttactttccatggacatgatctaatagttgatactgaattggagctaaattatggaagacgttatggcttgcttggattaaatggttgtggaaaatctaccctgcttacggcaataggttgccgagagttacctattccagaccacatggatatttatcaccttaccagagaaattgaagcctctgacatgtctgcactggaggctgtcataagctgtgatgaggaaaggttgagattggagaaagaagctgaagctttggcagctcaggatgatgggggtggtgaaactcttgaacgaatttatgaacgattggaagccatggatgcatcaactgcagaaaagcgtgctgctgaaattttatttggtcttggtttcaacaagcagatgcaggcaaagaagacacgtgatttttctggtggctggagaatgaggattgctttagcacgtgctctatttatgaacccaaccatccttttacttgatgaaccaaccaatcaccttgatttggaagcttgtgtgtggctggaagagaatttgaagaagtttgaccgaattctggttgtgatttcacactcccaggatttccttaatggtgtctgcacaaatatcatgcacatgcaaaacaagaagctgaagctctatactggtaattatgatcaatatgttcagacacgtgctgaactagaagagaaccagatgaagcagtacaaatgggagcaggagcaaatttcctcgatgaaggaatacattgcccgatttggtcatggatctgcaaaactagctcgccaagcccagagtaaagagaaaactcttgcaaaaatggaacgtggtggactcacagagaaggtggtaagagacaaagttttggtattccgcttcgttgatgtgggaaaacttcccccgcctgtcctccagtttgttgaggtgacatttggttacactcctgataatctgatctacaagaaccttgactttggggttgatttagactctaggatcgctctggttggacccaatggagctgggaagagtacattactgaagctaatgactggtgatctggttcctatagatggcatggttcgacggcacaatcatcttcgaattgcacaatttcaccagcacttggctgaaaagctagacttggaattgtctgctcttcagtttatgataaaagaataccctggaaatgaggaggaaaggatgagagcagctattgggaaatttggactgtcaggtaaagcgcaggtgatgccaatgaagaatttatcagatgggcagaggagccgcgtgatatttgcatggttagcttatagacagcctcatttgctgcttctggacgagccaactaatcatttggatattgaaacaattgactcgttggctgaagcattgaatgaatgggatggtgggatggtgcttgtcagtcatgattttaggctcattaatcaggtggcccatgagatatgggtgtgcgctgatcaagctgtgaccagatgggaaggtgacattatggatttcaaggagcacctaaggtcaaaggcgggtttatctgactgaaccgaagaaaatagtatcactatttgaagattacacacttgtattacaatgcaggtgggggtgttgatttaaatggatggcagaggatcggtgtagaaatcatgctctatatttttaagccgagatgcccttctcccctgttagattgtggtaatctttcttttgtttttctatcatttattgtgcttattatcaatatggttgttgaccagcatgtagataacaggggaagctagtatctcaatcaaacttttacgcggctaatattatgaaatatgaatgatatgttgtactgagac

SEQ ID NO: 3940 - DNA, 2283 bp, Triphysaria pusilla
attctcgtactttcttcattccgaacgatctgccgctcaagccttgtcctgagtgaaaagaaggggaacgcgaaaccctagatcgtttatttataacttttgccttgtgctgaagataacaattataatcgcgagatttgaagatggtgtctgatgcgagtaagaagaaggcggctcagaagaaggctgcggctgccgccaagagaggaggcaaggctgctgcatctgcctcgtctaaggctgccacatcggcgaacggaagcaaagctgatagtttggctaatggagtcgcagatcttcatatttcggatcggaattgtaccggagttctctgctcgcatcctttatccagagatatccggatagaatcactttcgctcactttccatgggcatgatttaatagtcgactctgaactggaactcaattatggccggcgttatggtttgcttgggttaaatggctgtgggaagtctactcttctttcttcgataggttgccgagagcttcctatcccagatcatatggatatttttcatctgacgagggagattgaagcttctgacatgtcttcacttgaggctgtaataagttgtgatgaggaaaggctgaaactggagaaagaagttgaagaattgtctggacaagatgatggtggtggagaagcacttgaacgtatttatgaacgtttggatgcattggatgtggcaactgctgaaaaacgtgctgctgagatcctatttggtcttggctttgacaagaaaatgcaagcaaagaaaacccgcgacttttctggtggctggaggatgagaattgcattagccagagctcttttcatgaacccaactatattgttgcttgatgaaccaacaaatcatcttgacttggaggcttgtgtttggttagaggagacattgaaaaaattcgaaaggattcttgttgtggtttcacattcccaggattttctgaacggggtttgcaccaacataatccacatgcagagcaagaagttgaagatctatactggtaacttcgacacatacatccaaacccgttctgatcttgaagagaaccaaatgaagcaattcaaatgggagcaggagcagattgctaatatgaaggaatacatagcccgtttcggacacggatcagctaagcttgctcgtcaggcccagagcaaggaaaaaacactagcaaagatggagcgtggtgggctaactgaaaaggttgtccgtgaccaggttcttgttttccgatttgtcgatgtcggcaagctcccacctcctgtccttcagttttctgaagtcacatttggctacacccctgacaatctcatctacaagaacatcgattttggcgttgacctcgattcaagagtagccctggtgggacccaatggagctggtaaaagtactctgctgaagctaatgaccggggaattacaccctcttgatgggatggtgcgtcgtcacaaccacttgagaattgcacagtttcaccagcatttgacagagaagctcgacttggagctgtcggccctggagtttatgctgagggaataccctggtaacgaggaggataagatgcgggctgctgtgggcagattcggccttaccggaaaagcccaagtgatggctatgcagaacttgtctgacggacagaaagcccgtgtaatttttgcgtggctggcttggaggcaacctaacatgctgctcttggacgagccgactaatcatttggatattgagacgattgattcccttgctgaggcgttgaaagagtgggatggtgggttggtgcttgtgagccacgactttaggctgattaatcaggtggcccatgagatatgggtttgtgagaaacaggctgtgacgaggtgggagggtgatattatggacttcaagaagcacctgaaggccaagtctggattggcctaaatttttggatttaaatgcaatatcttagtggtttggccactctccgcttgcttttgatgggcggggccgaagcagctcaatgtgaaatttgaggggcgttgcgactatatttgtggtcgttatggtgtttgtttcttggctgtcacggtaggtaggattatagtggaagcttttatttgtttgttgcgatacttacctaatatactgttggtctagatcaatggctgttgcggagagggtagtcctctatgaatattatttttttaagattacttgatgctgtacttttatttccatgatttgagactgtttacgtgctatttttataattgaatctgaaatgaat

SEQ ID NO: 3941 - DNA, 2257 bp, Zostera marina
ctccaacctaaaaggggaaaaatagagacgaacaaaaccctaatttgttctctccattaactatcaccgtatatatccttcccctatatcggattttcgcttcgttcttatcatccgattcaatcgatagacaagaatatggtttcggacgcaagcaagaagaaggccgcgcagaagaaggcagccgccgctgccaagagaggtggaaaggccgccgcgacatcgtcaaagtcgaagactaatggtgtggccgaagtttccagcaagattggatctttgcagatatctgatcggaactgcacgggcgttctgtgttctcatccgctgtctagagatatacatattgaatctctctctgtcacttttcatgggcatgatcttatagtagattccgatctggagcttaattatgggagacgttatggtttacttgggttgaatggttgtgggaaatctacactaatgacagctttagggaaaagagaacttccaattcctgaacacatggatatttttcatcttacacgagagattgaagcctcagacatgactgcattagaggctgttgttaattgtgatgaggaaaagttgaaattggagaaggaggctgagatgctggcagcagaggatggtggaggtggtgatgcattggacatgatttatgagcgtcttgaagcattggatgcatccacagcagagaaacgagctgctgaaattttgaatggacttggtttcaacaagcaaatgcaggggaaaatgactcgtgatttttctggtggatggagaatgagaattgctttagctcgtgctcttttcatgaatcctactattcttttgcttgatgaacccactaatcatcttgatctggaagcatgtgtttggcttgaagagcttctgaaaaacttcgaacgaatccttgttgtggtgtcgcattctcaggatttcttgaatggtgtttgcacgaacattatccatatgcagagtaagaagattaaaatctacagtggtaattatgatcagtatgtgcagacaagatcagagcttgaggagaaccagatgaaacaatacaaatgggagcaagagcagatctcctcaatgaaggaatatattgcccgttttggtcacggttctgctaagttagctcgccaagcccaaagcaaggaaaaaacattggccaagatggaaagaggtggtcttacagaaaaagtaacaagagacagtgttttagtgtttaacttcacagatgttgggaaacttccaccacctgtattgcaatttgtggatgttgccttcggatatacacctgaaaatcttatttacaaatgcctcaattttggggttgatctagattctaggatagcattggtgggacccaatggagctggtaagagtactcttcttaagttgatgactggggatctcacaccttctgatggcatggttaggcgtcataatcatctgagaattgcacaattccatcagcatttggctgagaagcttgatgtggaattatcagctctggcgtatatgatgcaagaataccctggaaactcggaagagaagatgagggccatagtgggtcgttttgggttaagtggtaaaacacagataatgccaatgaagaacctttctgacggacagcgtagtcgtgtgatttttgcctggcttgcctggaggcttccacatatgcttctacttgatgagccaacaaatcatcttgacattgaaacaattgattccctggcagatgcattgaaacagtgggatggtggtttggttttggttagtcacgatttcaggcttataaatcaggtagcagaggaaatctgggtgtgtgaggaccaagctgtaacccgttggaacggtgatatcatgggtttcaagttgcatctgaggaagaaagccggtttatttgactgacgagttttgacaacgtgtttttatcgtttggcaatattcaatttatttcctttcacaaatatgccacaactagtctatttttcatctgtcctagcagccttcctatttacaaacagtgtccagtttctattactgctgacattgaaatatcaagtcctttttagtattgttattgtgtgatatgaaaccatagtttatttaaatctggatgattattattttaaaatgtttttcaattggaatgagtttttaattcatcatataattcttagcatatttagtgttttgaattttcatggttgtttctttctttcatgaaaattgtgtgggattattg

SEQ ID NO: 3942 - DNA, 2280 bp, Sequoia sempervirens
aatcaaagaaagcctgctattaaatctgtaaatccgatccctatttgccaggtttttctcttccaattcaccgccctctcagatcccctcacgaggctctacaatggtttctgatgcgagcaagcagagggcggccgccaagaaggcagccgctgcggcaaagaggggtgccaagtcagcggcagtcacggcgcctaagtcagaggcagcatcatctacgtcagtagagccatcgcagaatggcaaagccagtgccagcgtggacaaagcagctgatgaaatagctgccatggctatatctgatcggacatgtaccggtgtcctttgttctcatcctctctctcgagatatacatatagagtccttgtcagttacattccatggtcacgaattgattgttgattcagagctcgagctgaattatggaagacgctatggattgcttggacttaatggatgtggaaaatctacacttcttacggctctaggaatgcgagagctccccataccagagcatatggatatatatcatttgaccagagaaattgaggccactgatatgacttcacttgaagctgtaatgaactgtgatgaagagaggcttaagcttgagaaggaagctgaagctttggctggccaagatgatggaggtggagaggctttagatcggatatatgaacgtttggaactcatggatgctgctacagcagaaaagcgagctgctgaaattttatttggcctgggttttactaagaaaatgcaagcgcaaaagacacgggacttttctggtggctggcggatgcgaattgcattggcacgtgcactattcatgaatcctacaattttgttactagatgagcctacaaatcatctagatcttgaagcttgtgtttggcttgaggaaactctgaagaagtttgatcgtattttggttgtagtatcacactcccaagactttctcaatggagtttgtacaaacattattcatatgcaaaataagaagttgaaattgtatacaggaaactatgatcagtatgtacaaacacgggccgagctagaggaaaaccagatgaagcaatataggtgggaacaagaacagatttcttcaatgaaggaatatatagctaggtttggacatggttctgccaagcttgccaggcaagcacagagtaaagaaaagacactagcaaagatggaaagaggtgggctaacagaaaaagtagtcagagatcaagtattagtgttccggttcactgatgttggtaagcttccccctccagtgcttcagtttgtggaggtggattttggatacactcctgaaaacctcatatacaaaagtgctgattttggagttgatctagattcacgggtagcactggttggtccgaatggagctggaaagagtacattgctgaaactaatgactggtgatttgactccattggatggcatggtaaagcgccataatcatctccgtattgctcagtatcaccagcatcttactgaaaagctagatctggaaatgtctgcattgcagtacatgatgcatgaatataatggtattgaggaagagaagatgcgtgctgccattggaaaatttggactcacaggcaaagcccagattatgcccatgaaaaacttatctgatggacagaaaagccgtgtgatttttgcatggcttgcttggaggctacctcatcttcttttgctcgatgaaccaactaaccatcttgacattgaaactattgattcacttgctgaagcattgaatgagtgggatgggggacttgttctagttagccatgactttcggctcataaaccaggttgccaaagaaatatgggtgtgtgaaaataagtctatcactagatggcaaggtgatattatggacttcaagcagcatttaaagagcaaggccggcctgtgagtgcatttgccatctgtgcttttgtgctactggaagtttgttcttgaaagacaatatatacacagttcattttactatttgtaggattcgtaactcctttgttgtaggctaagcaattctattgtattggtctagatagatgttctagggtaaaattagtaaaacctttgttgaaaatttgaaaccattgttactgatagtttatggtctcaaggaactaagagtttgttgccattttttgttgaagccagctatttattgatatatagcttgtgcatcacatgcatttgggaagggaaaaaactgaaatagaaaccatttctgaagagtggatgaaactttcaactatgatt

SEQ ID NO: 3943 - DNA, 2302 bp, Zea mays
ggacatgaagagttaagttgatgttcgccttcccctgtcagcttcccgttaccacaatcctagtcttgtggtggtgtgctgtgctgtcgtctctctccgatcttcccgattcttcttaccccttcttcgtcaagccgcagccgtcgcctcccttgctcaccaccatggtgtcggacgccgccgccgccaagaggggagccaaggtcccgaccccttcatcttcgtcctctgccgacgctaaatccatcggtgccgtggccgcgctcaagctctccgatcgcacctgcaccggcgtcctcgcctcccacccgctctccagagatatccacatagagtctctttcattaacgtttcatggccatgacctcattgtagattctgagttggagctcaactatgggaggcgttatggtttgcttggccttaatggctgtggaaaatctactcttctcactgcgataggctgcagagaactccctatacctgaacacatggacatataccatctcacccatgagatcgaggcttcagacatgtctgcactacaagctgttgtctgttgtgatgaagaaagaatgaagttggaaaaggaagcagagattttggctgcacaggatgacggtggtggtgatgctttggatcgtgtatatgagcgtctagaagctattgatgcatcaactgctgaaaagcgtgctgctgagatattatatggtttaggttttaacaagcaaatgcaagctaagaaaactcgagatttttctggtggttggcgtatgaggattgctttggctagagcactcttcatgaatccaacaatccttttgcttgatgagcctacgaatcatcttgatcttgaggcatgtgtctggttggaagagacgctaaagaaatttgaccgcatactggttgtcatatcgcactcccaggactttctgaatggtgtgtgcactaacatcatccatatgcagaacaagaagctaaagttatatactgggaattatgaccaatacattcagacacgctccgagcttgaagaaaatcagatgaagcagttcaggtgggagcaggagcagattgcatcaatgaaggagtacattgcacggtttggccatgggtctgcaaagcttgcacgtcaggctcagagcaaggagaaaactctggcaaagatggagcgtggtgggctcaccgagaaggttgttagggacaaaatactggtcttccgcttcacaaatgttggcaaacttccaccaccagtgcttcagtttgttgaggtcacgtttgggtacacaccagataatctcttgtacaagaagcttgactttggtgttgacctggactctaggattgcattggttggtcccaatggcgcagggaagagcactcttctgaagctgatgacaggtgagctggttccattggacggtatggtgagacggcacaatcacctgcgcatcgcacagttccaccagcatctggcagagaagctggacctggacatgtcggccctgcaatacatgatgaaggaataccctgggaacgaagaagagcggatgagagccgcagttggtaagtttgggctgtcagggaaggctcaggtgatgccgatgaggaatctgtctgacgggcagaggagccgtgtcatctttgcgtggctggcatacaggcagccgcagctattgctgctggacgagccgacgaaccatcttgatatcgagaccatcgactccctagcggaggcgctgaacgagtgggacggcggtctggtcctggtgagccatgacttcaggctgatcaaccaggttgctcatgagatctgggtttgtgagaatcaggcagtgacaaggtgggaaggcgatatcatggatttcaaggagcacttgagaagcaaggcttgtctatcggattaagggaaggccttggctttccttaccttctctttggagatgtattatcccttgtataattatgtattattataggccctccaagttttactagtagctagctgatcatctgagcaagtacctctgtatctgtatcctgctgagtctcataataagaagcgaaagttttgtagtactaacgtaattgtcacggcaggaagtgccatggagagcaaggatgcgggagaagagaggctgggagactgaagaagcaggaagtgcgtggtgtgcgtgctgttgggctcaatgtgtgtgggcgtgagtttggtgggttcggcccatgtaagtgacctataattctgtagcgaactgagaataaggcagacaagaaatagaaccagagaaaagttcccaaccgt

SEQ ID NO: 3944 - DNA, 2238 bp, Solanum tuberosum
tcctctcttctataacctttaacaatttctccaaatccgtagatcttacgaattcaaagatggtgtcggatgcggcgaagaagagagatgcgcagaagaaggcggcagcagctgctagaagaggaggtaaaggtgcggcagcgtctaaatcggctgcgacggcgtctaaatcggcgggggaaagtaacggggttgataatttgacgaacggagtaggggatctacagatatctgatcggacttgtacgggtattttgtgttcacatccgcaatcaagggatattaggatagaatcattatcagtcactttccacggacatgatctaatcgttgattctgaactggagctcaactatggccgacgttatggtttgttgggattgaatggctgcgggaagtctactcttcttaccgctatagggttgagggaaattcccatcccagaccacatggatatttttcatctttctcgggagattgaagcctctgacatgacctctctcgaggccgtcattaattgtgatgaagagaggttgcaattggagaaagaagctgaagctttggctgcacaggatgatggtggtggagagcaacttgaacggatctatgagcgtttagaagctatggatgctgccactgctgagaaacgtgctgctgaaatcttgtttgggcttggatttgataagaaaatgcaagcaaagaaaacacgcgatttttcaggtggctggagaatgaggattgctcttgcccgtgccctctttatgaatccaacaattttgttgcttgatgagccaacaaaccatcttgacctagaagcctgtgtgtggttggaagaatccttgaagaactttgagcgcattctggttgtcatttcacactcacaggattttctcaatggtgtgtgtaccaatatcatccacatgcaaaacaagaagttgaaactctatacaggtaactacgaccaatatgtgcaaacccgttcagagctggaagagaaccagatgaaacagtacaagtgggagcaggagcagatttctgcaatgaaggaatacattgctcgctttgggcacggttcagctaaactagcccgtcaagcacagagtaaagagaagacattggctaagatggagcgtggtgggcttactgagaaggtggggagggacagcgtcctggttttccggtttactgatgtcggcaaacttcctcctccagttctacagttttctgaagttgcttttggctacacacctgataacctcatctacaagaaccttgattttggtgtagatctcgactccagggtagcacttgtagggcctaatggagctggaaagaacactgcttaagctgatgataggggagttatttcccactgatggcatggttaagcggcataatcacctaaaaattgcacagtaccaccagcacttgactctcttttgtacatgatgagagagtaccctgggaatgaggaggagaagatgagggcagcaattgggaggtttggactcacaggtaaagctcaagtaatggctatgaagaacttgtcagatggtcaacgtagtcgggtgatctttgcatggttggcttttagacaaccccacatgctgctgttggatgagccaaccaaccatcttgatattgagaccattgactcacttgcagaggccttgaacgcatgggatggtgggatggttctagtgagtcacgactttaggctcataaatcaggtggcccatgagatatgggtatgtgaaaatcaggctgtgacacgatgggagggtggcatcatggagttcaagaaacacttgaagaaaagggctggattgggtgattaaaagtaagatctctgtgttatattagaaagtgtgatggtatcactatttcctcttggtggttcagtgccaaggcgtaatggtgaaacatcagcaggctcccatcacggtagctgaggggagaaagtaaaggcttcttgatcaccagtaagacctaagtaacgttagctaagaccacacctggtgctagagagagagtaagtgatcgaaccatggtcaccgactgtttgaactctggttattgtttgggcttagtccactatttttgtcgtccattttactctaattacatattaccctaggttttggagagcatacattacagcttattccttatgtcatttctattctatatcattgctatgatgtacttcggattttggaattctgaaagctattatgg

SEQ ID NO: 3945 - DNA, 2257 bp, Taxus baccata
gggattttgaaacttctctcaaaacgatcggaagggaaaaggaaagtttgccactccttctctgaattcgatccaactttatcaggttctctcttctaataatccgccctctcagatcccctcttaaggctctacaatggtttctgatgcgagcaagcagagggcggccgccaagaaggcagctgctgcggcaaagaggggtgccaagtcagcggtagtcgtagcgcccaaatcagaggcagcgccatcgaagtcatcagatgcatcgcagaatggaaaaaccagcgccagcgtagacaaagcagccgatgaaatggctgccatggctatatccgatcggacgtgtactggtgtactttgttctcatcccctctctcgggatattcacatagaatctttgtcagttacattccatggtcatgagttaatttttgattcagagcttgagctgaattatggaagacgctacggattgcttggacttaatggatgtgggaaatctacacttcttacagctctagggtttcgagagcttcccataccagagcacatggatatatatcatttgaccagggaaattgaggccactgatatgacttcacttgaagctgttatgaactgtgatgaagagaggcttaagcttgagaaagaagctgaagctttggctggccaagatgacggaggtggagaggcactagacagaatatacgaacgtttggaactcttggatgctgctacagcagaaaagcgagctgctgaaattttatttgggctaggttttactaagaaaatgcaagcaaaaatgacacgagatttttctggtggctggaggatgcgaattgcactggcacgtgcattattcatgaatcctacaattttgttattagatgaacctacaaatcatctagatcttgaagcttgtgtatggcttgaggagactctgaagaaatttgatcgtatcttggttgtaatatcacattcccaagactttctcaatggagtttgtacaaacattattcatatgcaaaataagaagttgaaattgtatacaggaaactatgatcaatatgtacaaacacgatctgagctagaggaaaaccagatgaaacaatacaggtgggagcaagagcagatttcttcgatgaaggaatatatagctcggtttggacatggttctgcaaaacttgccaggcaagcacagagtaaagaaaaaccttggcaaagatggaaagaggtgggctaacagaaaaagtagttagagataaagtattagttttccgattcactgatgttgggaagcttcctcctccagtgcttcagtttgtagaggtggattttggatacactccagagaaccttatttataaaagagttgattttggagtggatctagattcaagggtagctttggttggtccaaatggagctggtaagagtacattgttgaagctgatgactggtgaattgaccccattggatggcatggtaaagcgccacaatcatctccgtattgctcagtatcaccagcatcttacagaaaagttagaattggaaatgtctgcactgcagtacatgatgcatgaatataatggtattgaggaagagaagatgcgtgcagcaattggaaaatttggactgacagggaaagcccagattatgcccatgaaaaacttgtctgatggacagaaaagtcgtgtgatttttgcatggcttgcttggaggctacctcatcttcttttgctagatgaaccgactaatcatcttgacattgaaaccattgattcacttgctgaagcactgaatgagtgggatgggggacttgttttggttagccatgacttccgtctcataaaccaggttgccaaggaaatatgggtgtgtgaaaataaatctatcacgagatgggaaggtgatattatggatttcaagcagcatttaaagagcaaggctggcctgtgagtgcgtttgccatctgcgcatctgtgctactggaagtttgttttcgagacatacacaagatatacatggctcattttattatttttttaatttaagaatgtcttgtggtaggttaagtaaattctgtggtagggtcaagcaattctgttgtattagtctagatagatgttttagggtaaaatatagatgttgtagggtaaaatatagatgttttatcgtctaaatagatagatgttgtagggtaaatttagcaatccttgctggaatcactgctactacatgtttatggtctcaaaga

SEQ ID NO: 3946 - DNA, 2218 bp, Triticum aestivum
  misc_feature (185)..(185): n is a, c, g, or t
  misc_feature (193)..(193): n is a, c, g, or t
  misc_feature (195)..(195): n is a, c, g, or t
  misc_feature (214)..(214): n is a, c, g, or t
  misc_feature (223)..(223): n is a, c, g, or t
  misc_feature (265)..(265): n is a, c, g, or t
  misc_feature (433)..(433): n is a, c, g, or t
  misc_feature (436)..(436): n is a, c, g, or t
  misc_feature (445)..(445): n is a, c, g, or t
  misc_feature (490)..(490): n is a, c, g, or t
  misc_feature (538)..(538): n is a, c, g, or t
  misc_feature (697)..(697): n is a, c, g, or t
  misc_feature (760)..(760): n is a, c, g, or t
  misc_feature (790)..(790): n is a, c, g, or t
  misc_feature (855)..(856): n is a, c, g, or t
  misc_feature (874)..(874): n is a, c, g, or t
  misc_feature (1175)..(1175): n is a, c, g, or t
  misc_feature (1181)..(1181): n is a, c, g, or t
gccggcgccgtctgccatcacccaccacaccacaccacaccacaccacacatagctcggagaggagaggagatggtgtcggacgccagcaagaagaaggcggcgcagaagaaggccgccgcagccgcaaagaggggcgccaaggtgcccgcctcctcctcctccgcatcatcttccgcctcacgncaacgaanangggggccctcgccgccgtncagctgtcngaccgcacctgcaccgccgtcctcacctcccacccgctctcncgcgacatacacatagagtctctcactttaacattccacggccacgatctacttgtagacactgagctggagctcaactacggcaggcgctatggtttgcttggtctgaatggctgcggcaagtcctgccttctcaaagcaatagggtgcagggagcttcctatcccngancacatgganatataccacctcagccatgagatcgaggcttcagacatgtctgcncttggagctgtcattagctgtgatgaagaaagggtcaagctcgaaaangaagctgaagttttggctgctcaagatgatggcggcggtgcagctttggagcgcgtatatgagcggctagaagcaattgatgcatccaccgctgaaaagcgtgctgctgagattttgtttggcttaggctttaacaagcagatgcaggccaagaaaacnagggacttctctggcggttggcgcatgagaattgctttggcaagagctctcttcatgaatccnaccatccttttgctcgatgagcctaccaancatcttgcatcttgaggcatgcgtgtggctggaagaaacactgaagaagtttgaccgtatacttnntgtgatatcacactcccnagacttcctgaatggagtatgtaccaacatcatccacatgcagaacaggaagctgaagctgtacactgggaatttcgaccagtatgtccagacccgatctgagctggaggagaaccagatgaagcagtacaggtgggagcaggaccagattgcgtcgatgaaggagtacatcgcgcgctttgggcacgggtccgccaagctggcacggcaggcccagagcaaggagaagacgctggccaagatggagcgcggcgggctgacggagaaggtggcgagggacaggatcctgacgttccggttngccaangtgggcaagctcccgccgccggtgctgcagtttgtggaggtgacgttcgggtacacgccggacaacctgatctacaagaagctggactttggcgtggacctggactcgcgggtggcgctggtggggcccaacggggcgggtaagagcacgctgctgaagctgatgacgggggagctggtgccgctggacgggatggtgcggcggcacaaccacctgcggatcgcgcagttccaccagcacctggcggagaagctggacctggacctgtctgcgctgcagtacatgctgaacgagtacccgggtaacgaggaggagcggatgcgggcggcgatcggcaggttcgggctgtcggggaaggcgcaggtgatgccgatgcgcaacctgtcggacgggcagcggagccgggtgatcttcgcgtggctggcgtggcgcgagccgcagatgctgctgctggacgagccgacgaaccacctggacatcgagacgatcgactcgctggcggaggcgttgaacgagtgggacgggggcctggtgctggtgagccatgacttcaggctgatcaaccaggtggcgcaggagatctgggtgtgcgagaagcaggcggtgacgcggtgggagggggacatcatggagttcaaggagcacctgaagagcaagtcgggcggcatgtcggacgactgagcctatctatctatctatctatctatatctatctatctatgtgtcaatgtgtagaagatgtttgcattctgctgctgctgctgggtgagatgttctctagggtctactgtagttagtatttgatgaagagttgttatgatgaagatgaagttatccatgcatgcatgcatgcatatgacgggtgatgcctaaactcctcatgtttgtgcggcggcaaaggcaccaaacagatgcgtgtaagcaaggctactacagtactatttactatcaaagttgttgcttgtcacctgaaactgaaactctgtttttattaagtttattcttggctggctggctggcttgtataatgaatgaat

SEQ ID NO: 3947 - DNA, 2150 bp, Hordeum vulgare
cgtcggtcggaatcagaccacgccggccgccgtaatctccgtctctctgccatcaccaagaagaagacgagagcagagcagccatggtgtccgacgccagcaagaagaaggcggcgcagaaaaaggccgccgccgccgcaaagaggggggccaaggtgcccacctcctcatcttcctcatcctcggcatccaccaagaaggtcgccgacgccctcgccgccgtccacctctccgaccgcacctgcaccgccgtcctcacctcccacccgctctcccgcgacatccacatagagtctctcactttaacattccacggccacgatctacttgtggacacagagctggagcttaactacggcaggcgctatggtttgcttggtctgaatggctgcggaaagtcctgccttcttaaagcaataggatgcagggagcttcctatccctgagcacatggatatataccacctcagccatgagattgaggcttcagacatgtctgcactgggagcggtcattagttgtgatgaagaaagggtcaagctggaaaaggaagctgaagttttggccgctcaagatgatggcggcggtgcagctttggagcgcgtatatgagcggttagaagcaattgatgcatccaccgctgaaaagcgtgctgccgagattttgtttggcctgggctttaacaagcagatgcaggccaagaaaactagggacttttctggcggttggcgcatgagaattgctttggcaagagctctcttcatgaatccaaccattcttttgctcgatgaacctaccaatcatcttgatcttgaggcatgcgtgtggctggaagaaacactgaagaaatttgaccgtatacttgttgtgatatcacactctcaagactttctgaatggggtatgtacgaacatcatccacatgcagaacaggaagctgaagctctacaccgggaatttcgaccagtatgtgcagacccgatctgagctggaggagaaccagatgaagcagtacaggtgggagcaggaccagatcgcgtcgatgaaggagtacatcgcgcgattcgggcatgggtccgccaagctggcacggcaggcccagagcaaggagaagacgctggccaagatggagcgcggcgggctgacggagaaggtggcgagggacaggatcctgacgttccggttcgcgaacgtgggcaagctcccgccgccggtgctgcagtttgtggaggtgacgttcgggtacacgcccgacaacctgatctacaagaagctggactttggggtggacctggactcgcgggtggcgctggtgggtcccaacggggcggggaagagcacgctgctgaagctgatgacgggggagctggtgccgctggacgggatggtgcggcggcacaaccaccttcggatcgcgcagttccaccagcacctggcggagaagctggacctggacctctccgcgctgcagtacatgctgaacgagtacccgggcaacgaggaggagcggatgcgggcggccatcgggcggtttggcttgtcgggcaaggcgcaggtgatgccgatgcggaacctgtcggacgggcagcgtagcagggtgatctttgcgtggctggcgtggcgcgagccgcagatgctgctgctggacgagccgacgaaccacctggacatcgagacgatcgactcgctggcggaggcgctgaacgagtgggacggcgggctggtgctggtgagccatgacttccggctgatcaaccaggtggcgcaggagatctgggtgtgcgagaatcaggcggtgacccggtgggagggcggcatcatggagttcaaggagcacctgaaaagcaagtcgggtggcatgtcggaggactgatggtcacctcctggctggactggagagaatatataatctatctatctatctatctatgtgttatttatctactatatacgtgtagaagatgtttttcctcatcgatcctgtgctgctggttgagattttttagggtccaagagttgttagcatgaagatgaagggatccatgccgatagttgccttcatcttaatatgttgttaagcgtgtttgactgtccacattgctcttgttgcacgtttggtttatataaaccaatttgttgttactattttata

SEQ ID NO: 3948 - DNA, 2077 bp, Hordeum vulgare
ccatggtgtccgacgccagcaagaagaaggcggcgcagaaaaaggccgccgccgccgcaaagaggggggccaaggtgcccacctcctcctcttcctcatcctcggcatccaccaagaaggtcgccgacgccctcgccgccgtccacctctccgaccgcacctgcaccgccgtcctcacctcccacccgctctcccgcgacatccacatagagtctctcactttaacattccacggccacgatctacttgtggacacagagctggagcttaactacggcaggcgctatggtttgcttggtctgaatggctgcggaaagtcctgccttcttaaagcaataggatgcagggagcttcctatccctgagcacatggatatataccacctcagccatgagattgaggcttcagacatgtctgcactgggagcggtcattagttgtgatgaagaaagggtcaagctggaaaaggaagctgaagttttggccgctcaagatgatggcggcggtgcagctttggagcgcgtatatgagcggttagaagcaattgatgcatccaccgctgaaaagcgtgctgccgagattttgtttggcctgggctttaacaagcagatgcaggccaagaaaactagggacttttctggcggttggcgcatgagaattgctttggcaagagctctcttcatgaatccaaccattcttttgctcgatgaacctaccaatcatcttgatcttgaggcatgcgtgtggctggaagaaacactgaagaaatttgaccgtatacttgttgtgatatcacactctcaagactttctgaatggggtatgtacgaacatcatccacatgcagaacaggaagctgaagctctacaccgggaatttcgaccagtatgtgcagacccgatctgagctggaggagaaccagatgaagcagtacaggtgggagcaggaccagatcgcgtcgatgaaggagtacatcgcgcgattcgggcatgggtccgccaagctggcacggcaggcccagagcaaggagaagacgctggccaagatggagcgcggcgggctgacggagaaggtggcgagggacaggatcctgacgttccggttcgcgaacgtgggcaagctcccgccgccggtgctgcagtttgtggaggtgacgttcgggtacacgcccgacaacctgatctacaagaagctggactttggggtggacctggactcgcgggtggcgctggtgggtcccaacggggcggggaagagcacgctgctgaagctgatgacgggggagctggtgccgctggacgggatggtgcggcggcacaaccaccttcggatcgcgcagttccaccagcacctggcggagaagctggacctggacctctccgcgctgcagtacatgctgaacgagtacccgggcaacgaggaggagcggatgcgggcggccatcgggcggtttggcttgtcgggcaaggcgcaggtgatgccgatgcggaacctgtcggacgggcagcgtagcagggtgatctttgcgtggctggcgtggcgcgagccgcagatgctgctgctggacgagccgacgaaccacctggacatcgagacgatcgactcgctggcggaggcgctgaacgagtgggacggcgggctggtgctggtgagccatgacttccggctgatcaaccaggtggcgcaggagatctgggtgtgcgagaatcaggcggttacccggtgggagggcggcatcatggagttcaaggagcacctgaaaagcaagtcgggcggcatgtcggaggactgatggtcacctcctggctggactggagagaatatataatctatctatctatctatctagtgttatttatctactagtatatacgtgtagaagatgtttttcctcatcgatcctgtgctgctggttgagattttttagggtccaagagttgttagcatgaagatgaagggatccatgccgatagttgccttcatcttaatatgttgttaagcgtgtttgactgtccacattgctcttgttgcacgtttggtttatataaaccaatttgttgttagtattttatatacgaa

SEQ ID NO: 3949 - DNA, 2102 bp, Pteridium aquilinum
acgtcttcgcgaggcaaggcctaccatttctcataccttcttcctctctgcggtgccgtctcttctttgctcttctattctcgaggaggaaggtttttgttcttaaaacaatggtgtcagatgcaagtaagaagaaggcagcacagaagaaggcagctgctgcagctaagcgcggttcaaaagctacctctaccattgcaacctcgtctaaaaccaatggtgcgtcaaacaatgccctaaatgaagtagcagacgagatgggatccctgcagataaccgataggacatgcacaggagtcctcgcttcacatccacaatcaagagatattcatattgaaagtttatcggtcacatttcatggccatgacttgattgtagattcaagccttgaacttaattatggaaggcgttatggattgttggggctgaatggatgtgggaagtccactctcctcgcatccataggctgccgagagctgcctattccagagcatatggatatttatcatttatctcgcgagattgaggcaactgacttgacgtctttgcaagctgttgtaaatgtagacgaggaaagaatacaactagaaaaagaggccgagcttctgtctgctcaggatgacggtggtggtgaggttctggaaagactttatgagcgactggaggctatggatgcatcaacagcagaaaagagggcagctgaaatattatatggtctgggttttaccaaaagcatgcaacaaaagaagactcgagatttttctggtggttggagaatgagaattgcattagcaagagcactgtttatgaatcctactattttgcttcttgacgagcctaccaaccatttagatcttgaagcgtgtgtctggctagaggaaacattaaaaaagttcgatcgaatcctcgttgttgtatcgcattctcaagattttctcaatggggtctgcacaaatattatccatatgcaaaacaaaagccttaagttctacacaggaaattatgatcaatatgtgcaaactcgagaagagctggaggaaaatcaaatgaagcaatataaatgggaacaagaacaaatatcaaatatgaaagagtacattgccaggtttgggcatgggtctgctaaattggcgaggcaagcgcagagcaaagagaagactctggcaaaaaatggaaagaggaggtcttacagagaaggttgttagggacaaggtgcttgtttttcgtttcactgatgttggcaagctgccccctccagttctgcaatttgttgaggtggactttgggtatacaccagattatcttatatataagaaggttgattttgggttgacttggattctaggatagccttggttggacccaatggagcaggtaagagtactctgttaaagctgatgactggtgagttgtctcctattgatggcatggtgagacgacacaaccatcttcgaattgcccaattccaccagcatttggctgataagttaaatcttgatgtgcctgccctacaatatatgatgtctgaatatccaggtctagaagaggagaagatgcgtgcagcgattggaaggtttgggctcactggcaaggctcaaattatgcccatgaaaaatttatctgatggccagaggagtagagttatatttgcttggttggcttggcggttgcctcatctgcttctgcttgatgagcctaccaatcatcttgacattgagacaatagatgcactagctgatgcactgaatgagtgggatggagggcttgtgcttgtgagtcatgatttcaggctgatcaatcaggtggccaaggagatttgggtctgtgaaaaccagacaatttcaaggtgggagggtgacatcatggacttcaaacagcacttgaaagcaaaagcaggcctttgaaaacggtcttgcttttcatgaagctggactctattgatctatagccataccttctaataaggaagtgaagatttttacttttgagttgaattattatttaaatttgacagtgatcttcttttttgtagctggtaaatgaagcggctcagctatttctaaaatgaaattatgatactcgctaaatattttcaaaaagaa

SEQ ID NO: 3950 - DNA, 2235 bp, Gnetum gnemon
cgcaaatcccagcagcagaaacagagcttaaacacttgttctgcttctgcaatttgggttcgtattttcggtgtttgttatcattccgcggcgctaccgcttctgccgcagcagcttcgccgatctcgagatctcattttgctgatcaagatggtgtcggacgcgagcaagaagagggctcaggccaagaagcaaacggcagcgatgaaaaggggatcgaaagctggagcagcggcagcaacggctgcgtcgtcgaccaagaaagtgaccgatgagatggcggagatgcgtatctctgatcgcacctgcaccggggttctttcctctcatccgctttcgcgagatattcacatagaatctctctcagttacatttcatgggcatgagttgatagttgattcagaacttgagttgaactatggaaggcgttatggactgcttggtcttaatgggtgtggaaaatctacactccttacagctttaggacttcgtgaactcccaataccagatcacatggacatattccatcttacaagggagattgaagcaactgatatgtctgcacttgcggccgtgatcaactgtgatgaggaaaggttaagattggagagggaagcagaagcgcttgccagtcgggaagatggtggtggtgagcaacttgaaagaatatacgaaaggttggatgcaatggatgctgctactgcagagaaaagagctgctgaaattttatttggtctaggttttaacaaggcaatgcaagccaaaaagacacgtgatttttctggtggttggcgtatgagaattgcattggcacgtgcattatttatgaatcctacggtattgttgcttgatgaaccgacaaaccatcttgatttggaagcgtgtgtgtggcttgaagaatgcttaaagaaatttgatcgcattcttgttgttatctcacattcccaagattttctaaatgaagtgtgtactaacatcattcacatgcaaaataagaagttgaagttctacaccggaaattatgatcagtatgttcaaacaagagctgaattggaagaaaaccaaatgaagcagtacaaatgggaacaggaacaaattgcatccatgaaagactacattgccagatttggtcatggatctgcaaaacttgctagacaagcacagagtaaagagaagacccttgcaaagatggaaagagaggggctaacagaaagagtagtaagagacaaagttttagttttcgttttgttgatgtagggaagcttcctccaccggttctgcagtttgttgaagtaacttttgggtacactccagagaatctcatctataagactgtagactttggggtggatctagattcaagaatagccttggtgggtccaaatggagctggaaagagtactttcttgaaattgatgacaggagacttatctccattggacggtatggtgaagcggcacaatcatcttcgtattggtcagtttcatcaacacttggcagagagattagatcttgataaatctgctcttcaatacatgatgtcagaatatccgggtttagaagaagaaaagatgagagcagcgattggtagatttggtttgactggaaaagctcagatcatgcccatgaagaatctttcagatgggcagagaagtagggtaatttttgcatggcttgcatggagagaacctcatttgcttttgctggatgagccaaccaatcatcttgacattgaaactatagattcgcttgctgaggctcttaaccagtgggatggaggtcttgttttagtcagccatgatttccggcttatcaatcaagttgcccaagagatttgggtttgtgaaaaccagaccgtaagaagatgggagggtgatattatggacttcaaacaacatttgcgaggcaagctggtttttggtgataattagattctatcagatattgaggggatccgatctgccattatatttatagggaaatctgttttacatgttttggtttttggttgcttttagcatccatattacatagcattgatgttctgcctcctagccattagcgaacatttcctggaggaatatgtcagtaaatctcattttttttctagatgttaattgttacgttatttccctaatttttcccagacaaacagtatgtgatttggcaaccaagtatctggttggattgtggatgtaacttatcatcttccctctataggttcaatgattaaca

SEQ ID NO: 3951 - DNA, 2385 bp, Beta vulgaris
  misc_feature (905)..(905): n is a, c, g, or t
  misc_feature (988)..(988): n is a, c, g, or t
  misc_feature (1050)..(1050): n is a, c, g, or t
  misc_feature (1185)..(1185): n is a, c, g, or t
  misc_feature (1196)..(1196): n is a, c, g, or t
  misc_feature (1217)..(1217): n is a, c, g, or t
  misc_feature (1235)..(1235): n is a, c, g, or t
  misc_feature (1511)..(1511): n is a, c, g, or t
  misc_feature (1513)..(1513): n is a, c, g, or t
  misc_feature (1516)..(1516): n is a, c, g, or t
  misc_feature (1518)..(1518): n is a, c, g, or t
  misc_feature (1525)..(1525): n is a, c, g, or t
  misc_feature (1556)..(1556): n is a, c, g, or t
  misc_feature (1563)..(1563): n is a, c, g, or t
  misc_feature (1571)..(1571): n is a, c, g, or t
  misc_feature (1580)..(1580): n is a, c, g, or t
  misc_feature (1588)..(1588): n is a, c, g, or t
  misc_feature (1590)..(1590): n is a, c, g, or t
  misc_feature (1630)..(1630): n is a, c, g, or t
  misc_feature (1636)..(1636): n is a, c, g, or t
  misc_feature (1651)..(1651): n is a, c, g, or t
  misc_feature (1658)..(1658): n is a, c, g, or t
  misc_feature (1662)..(1662): n is a, c, g, or t
  misc_feature (1727)..(1727): n is a, c, g, or t
gggcactttctctccttttccaaaccctctttcatttataatcgttcgcacctgggagagcctacttttctccctctgtcgtccgattccaacgtttcccgtcggaaaccctaaccctagatcgcttattttctctctcctactttttatttttccacacttaggcggcgaaattcacaccgatttcattcctttttgctcctccataaccttattgattgaaaatggtgtccgacgctagcaagaagaaggctgctcagaaaaaggcagctgcagcggcgaagagaggaggaaaagcagccgccacatcgaaagcggcggcagcagtagctcagagtgtcgataagttagctgatggagtttccgatattcagatttctgatcggaattgtactggtgttctttgctctcatcctatgtccagagatgttaggatagagtctttgtcagttactttccatggacatgatctgatagttgactcgatactggagctgaattatggaaggcgctacggtttgctgggtttaaatggttgcggcaaatctacccttctcactgcaataggactccgtgaacttcccattcctgaacatatggatatctatcatctttctagagagatcgaagcatctgacatgtctgcccttgaggcagtaatgagctgtgatgaggaaagggtgaagttagaacaggaagtagaagtattattagcacaggatgatggaggtggggagagactcgaacgtgtatatgagcgtctggaagctcttgatgtagccactgctgagaagcgcgcggctgaaattttgcatggtcttggatttgacaagatgatgcaggcaaagaagacaagagacttttctggtggttggagaatgaggattgcattggcacggtcgttnttcatgaaccccactatcttattgttggatgaacctacaaatcatcttgaccttgaagcttgtgtctggctggaggagaatcngaagaattttagtcgcattttggttgtggtttcacactctcaagattttttgaatggtgtcngcacaaacattatacacatgcaaagcaagcaattaaagatgtacactggtaattatgaccagtatgttcagactcgttctgaacttgaagagaatcagatgaaacagtacaaatgggagcaggaacaaatttccnacatgaaagantacattgctcggtttggtcanggttcagctaagttagcncgtcaagcacaaagtaaggagaaaacacttgcaaagatggagaggggagggctgacggagaaggtcgtcagagacaaagttctggttttccgtttcacagatgttggaaaacttccccctccagttttgcagtttgtggatgtgtcatttggctatactccagagcacattctttacaagcaccttgactttggtgttgaccttgactctaggattgccttggtgggtcctaatggtgctggaaagagtacgcttctgaagctgatgacggggatntnttntnctgaggnacggtgcggcgcacaatcacttaggattgcncagtccntcagcatnggcagaaangctggatngnaaatgcctgctctactgtatatgatgcgagatatccaggnaccgangaagagaaaatgagntcagcanttgnaggtttgggctatctggcaagcacaggtcatgcctatgaaaaattgtctgatgggcagcgtagcngagttatttttgcctggttggcttaccggcaacctcaaatgcttttgctagatgagcctactaatcacttggatatcgagacgatagattcattggctgaggcattgaatgagtgggatggcggcatggttctcgttagtcacgatttcaggctcataaaccaggttgcccatgagatatgggtgtgtgagaatcagacagtcactcgttgggaaggtgatatcatcgccttcaaggagcatctcaagaagaaagctggattaggtaactaaattagagctgacgattactacgatggattagctaattgaagcttgaggattatcacaatggattagctaatttgtcgaatgctctataaagtacctatgctggtacctcgacttttggttggtccttaacctcaatgagctgagctcctttccgacgtttggttagaaatctgcagcagagccaagaaggttttggttattagacttgtagtctcaaacccgcaagttgagcattactgtggccctgaattgaggtgaattttttgttcttgttttctttttccctgtgaagacctataaaacaatctcagtagttgactaatgggagtattgccatgtaaacgagatcattcgtgaacctccatgtccagattctatattactat

SEQ ID NO: 3952 - DNA, 2162 bp, Brachypodium distachyon
ccatggtgtccgacgccagcaagaagaaggccgcgcagaagaaggcggcggccgcggccaagaggggggccaaggtgccctcgtcgacctcctcctcctcctcctccgcttccgccaaggccgccgccgacgcgctcgccgccattcacctctccgaccgcacctgcaccgccgtcctcacctcccacccgctctcccgggacatccatatagagtctctcactttgacattccatggccatgatctacttgtagatacggagctggaacttaactatggaaggcgctatggcttgcttggtttgaatggctgtggaaagtcctgccttcttaaagcaataggatgcagagagcttcctatccctgaacacatggatatatatcacctcagccatgagatcgaggcttcagaaatgtctgcactagaagcagtcattagttgtgatgaagaaagagtcaagttggaaaaggaagctgaagttttggctgctcaagatgatggtggaggtgaagctttggaacgcgtgtatgagcggttagaagcaattgatgtatctactgctgaaaagcgtgctgctgagattttgtttggcctgggttttaacaagcagatgcaggccaagaaaactagggatttttctggtggttggcgcatgagaattgcattggcaagagctctgttcatgaatccaaccatccttttgcttgatgagcctactaatcatcttgatcttgaggcgtgtgtctggttggaagaaacgctaaagaaatttgagcgtatacttgttgttatatcacactcccaagactttctaaatggagtatgcacaaacatcatacatatgcagaataggaagcttaagctgtacactggtaatttcgatcagtatgtccaaacacgagctgaactggaagaaaatcaaatgaaacagttcagatgggagcaggagcagattgcttcgatgaaagagtacattgcacgttttggtcacgggtctgccaaactggcacggcaggctcaaagtaaagagaaaacactagctaagatggagcgcggcgggctgacagagaaggttgcaagagacaggatactaacattccgctttacagatgttggcaatctcccaccaccggtgctgcagtttgttgaagtgacgtttgggtacacagaggataacctgatctacaagaagcttgattttggtgttgaccttgactctagagttgcactagttggtcccaacggggcggggaaaagcacacttctgaagctgatgactggcgagctggtaccactggacggtatggtgaggcggcacaaccaccttcggatcgcacagttccaccagcatctggcggagaagctggacctggatctttcggccctgcagtacatgatgaatgaataccctggtaacggggaggagaggatgagggcggcgattggcaggtttgggctgtctggaaaatcgcaggtgatgccaatgaggaacctgtcggacgggcagaggagccgtgtgatcttcgcatggctggcatggagggagccacagctgctgctgctggacgagccgacgaaccatctggacatcgagacgatcgactcgctggcggaggcgctgaacgagtgggacggtgggctggtgctggtgagccatgacttcaggctgatcaaccaggtggcgcaggagatctgggtctgtgagaagcaggcggtgacacggtgggaaggcgatatcatggagttcaaggagcacctgaggaacaagtctggcctgtcggacgactgaggttcccgtgccgaggccgcaggtgatgccctgcatctcaatgtatgggataacacgtttcctgctggttgatcgagtaagtgccaagtcaaaaagggtattgtggagaatgggtaggagttgaatttgtcatcttgagtgaatccgctgcatatgaaggatgatgccgagagtaatgctgtctgcagttagttatctatgcgctgcgcagcacggcacggcaccaatcggatgcgtgtgttatgtgtagtttatgaccttgagaatgcatggtttgattatcatcttttgtctgtttgtgagatgttatttactgtttctgaaagtatttatttatggttttggtcttcgcgtggttggtgtggcgccgag

SEQ ID NO: 3953 - DNA, 2127 bp, Adiantum capillus-veneris
cgaacccttcgcgttgtagcggagaggaaggccaccatttttgctcggtttcgcaaaccctgttctctgcggtgccatctcttctgaggaccttccattcggcaggcaggacatacatagtatctagtttacggaaagcctttgccataaagaacaatggtgtcagatgcaagcaagaagaaggcagctcaaaagaaagcagctgctgcagcaaagcgtggctccaaagccactgccaccactgcagcctcatctaagaccaatggggtctcaaattcaacctcaaatgaagttgcagatgagatcgcttccatgcagataactgatagaacatgtacagggatccttgcatcgcatccacaatcgagagatattcatattgaaagtttatcagttacgttccatggccacgatctaattgttgactcaagtcttgaactcaattatggaaggcggtatgggttgcttgggttgaatggttgtggaaagtcaacccttctagcttctataggttgtagagagctgcctattccagatcatatggatatctaccatttgacccgcgaaattgaagcaactgatttgacttctttgcaagcggtcgtgaacgtagatgaagaaagggtcaaactagaaaaagaagctgaacttttggctgctcaggatgatggtggtggtgaggttctagaaagattatatgagcgtttggaggctatggatgcagctacagcagagaagagggcagctgagatcttatatggtctaggtttcactaaaagcatgcaacagaaaaagacccgggatttttcaggcggatggcgaatgagaattgcattagccagagcattgttcatgaatccaacgatcctacttcttgatgagccaacaaaccatcttgatcttgaagcatgtgtgtggcttgaggaaactttaaagaagtttgaccgcatcctcgtcgtcgtgtcacactcacaggattttctcaatggtgtctgcaccaacatcatacatatgcaaagcaaaaagttgaagttttatactggaaattttgaccagtatcttcaaacccgagaagagctggaagaaaatcagatgaagcagtacaagtgggagcaagagcagatagcgaatatgaaagagtatattgccaggtttgggcatggctctgctaaattagccaggcaggcacagagtaaagagaagaccttggcaaaaatggaaagagggggcttaacagaaaaggtggctagggataaggtgcttgttttccgctttactgatgttggcaagctacccccaccagttctacagtttgtagaggtggattttggttacactccagagcatatgatatatagaaaacttgactttggagtagacttggattcgagggtagccttggtgggacccaatggtgcaggtaagagcactctattgaagctgatgactggtgagctggctcctattgatggcatggtacggcgccacaatcatcttcggattgcccagttccaccagcatttggctgacaaactcaatctcgatgtgccagccctgcaatatatgatgtctgaatatccaggcctagaagaggagaagatgcgtgcagcgattggaagatttgggctcactgggaaggcccaaattatgcccatgagaaatttgtctgacggccagaggagtagagtcatatttgcttggctagcttggcgtttgcctcatatgcttttgcttgatgagcccactaatcatcttgacatagagacaatagatgctttagctgatgctctaaatgaatgggatgggggccttgtgcttgtaagccacgatttcaggctaatcaaccaggtggcaaaggagatttgggtctgtgagaaccaatcagtaacaaggtgggaaggtgatataatggacttcaaacagcatctcaaagcgaaagcaggcctttaaggagggagggcatttcggagaccattaagaatttgagtcaacatatttattatcaaatagttggaattttgctattcgagtaaaaaatgtcaagataaagatgtgactagttgaagctcataacgaagcctttttttgcttcattatataattaaattcaaatactttttttttgag

SEQ ID NO: 3954 - DNA, 2102 bp, Orobanche aegyptiaca
tgagaatggtagcaaatttgatgatttggccagtggggttggggatcttcacatatcagatcggacgtgtacgggagttctctgctcgcaccctctgtccagagatattcggatagaatcactttcactcactttccatggccatgatctaatagtcgactctgaactggaactcaattatggccggcgttatggtttgcttgggttaaatggctgtgggaagtctactcttctttctgcaataggttgccgggagcttcctatcccagaacacatggatatttttcaccttacgagagagattgaagcttctgacatgtcttccctcgaggccgtaataagttgtgatgaggagaggctgaaactggagaaagaagcggaagtcttggctggacaggatgatggtggtggtgcagcactggaacgtatttatgaacgtcttgatgcgttggatgcatcaactgctgagaagagagctgctgagatcttgttcggtcttggctttgataagaaaatgcaagctaagaaaacacgagatttttctggtggctggaggatgaggattgctttagcaagagctcttttcatgaacccgacagtattgttgctagatgaacctacaaatcatcttgacttagaggcttgcgtctggttggaggagatgttgaaaaaattcgagcgaatcctggttgtggtttcacattctcaggattttcttaacggcgtctgcaccaacataatccatatgcagagcaagaagttgaagatttacacaggtaacttcgaccaatatctccaaacccgttccgaacttgaagagaaccagatgaaacaatacaaatgggagcaggagcagatctcttcgatgaaggaatacatagcccgttttggacatggatctgccaaattggcccgccaggcccagagtaaggaaaaaaccctagcgaagatggagcgtggtgggctcacggaaaaggtggctcgggacaaggttctcattttccgatttgtcgatgtgggaaaactccctcctcctgttctccagtttgttgaagtgacattcggctacactcctgataacctcatttacaaaaacatagatttcggcgtggaccttgattcgagagtagcccttgtgggccccaatggtgccgggaagagtactcttctgaagctgatgacgggtgatttggtcccactggacggcatggttcgacgtcataaccacttgagaatcgctcagtttcaccagcatctgaccgagaaactcgacctggagttgtcggccctgcagtttatgttgaaggagtaccctggtaatgaggaggagaagatgcgtggtgccgtgggcaagttcgggctcagcggcaaggcccaagtgatgccgatgaagaatctgtccgacgggcagaagagtcgggtgatattcgcctggctggcttataggcagccgcagatgctgcttctggacgagccgacgaatcatttggatatcgagacgattgattctctggcagaggcgttgaacgaatgggacgggggtctggtactcgttagccacgattttaggctgataaaccaggtcgcccacgagatttgggtttgtgagaaccagaaggtgacgcgttgggggggtgatattatggacttcaaggcccacttgaaggccaaggctgggttggcctagtcgagttcttattgccgttgatatgatagtggcacagccagttctctgacctggccttggctttcgatgaacatctcggccggaaagcaggtcacattgaaatttgagaattgggtcaccgtgattactggtgatgggtaatgagcgtgtttgttttgtgggcccttggtgtagggagtcgagtggaagctttgattttggcttcctttgtggctgttgctgtgttggcagagggggcagtgctccatagagttatttttttttttgagtatttgcatactgtatggatatttgatggtgtacttgtattttgaggattttggaccaatttattttagttttagtagtattatttaaattataaactgattgaactttgatggttaattcattttcggttatttatagttttaca

SEQ ID NO: 3955 - DNA, 2158 bp, Plantago ovata
tcagaagaaggcggcggccgccgctaagagaggcggtaaggctgtggcggcttcttctaaggctgacaacggcagcagcaaggcggatagtttggctaacggtgttggggagcttcatatctctgatcggacgtgtaccggtgttctgtgttcgcatccgatgtccagagatatccggatagagtctctttcactcactttccatggacatgatcttatagttgattctgagctggagctcaattatggcaggcgctatggtctgcttggtttgaatggttgtggcaagtctactcttctcacttctattggtatgcgagagctccctatccctgatcacatggatatttatcaccttagccgagagattgatgcttcagacatgtcatctctcgaggctgtcataaactgtgatgaagagaggatgaagttggagcaagaagctgaagcactggctggacaggatgacggtggtggtgataaacttgatatgatttatgaacgcttggaagcgatggatgctgctactgctgagaaacgtgctgctgagatcctgtttgggcttggctttgacaagaaaatgcaggcaaagaaaacacgtgatttttctggtggttggaggatgagaattgctctagcaagagcccttttcatgaacccgacaatattgttgcttgatgaacctacaaatcatcttgatttggaggcatgtgtctggttagaagagatgttgaagaatttcaaccgaattcttgttgtggtttcccattcccaggatttcttgaatggtgtctgcactaacattatccacatgcaaagtaagaagttgaagatgtacactggtaactttgaccagtatgttcaaacccgtaccgaacaagaagagaaccaaatgaaacaatacaagtgggagcaggatcaaatagctaatatgaaggaatacattgcacgctttgggcatggttctgctaagcttgctcgtcaagcccagagtaaagagaaaactttggcaaagatggagcgtggtggtctaacagagaaagtggctagggataaagttcttattttcaatttcactgacgttggaaagctccctccacctgttcttcagtttgttgaagtcaagttcggctacaccccggataatcttatatacaagagcattgattttggtgttgaccttgattcaagggtcgctctggttggacccaatggagctggtaagagtaccctgctgaagctgatgacgggggagttagttcctctagatggcatggtccgacgtcacaatcatcttaggattgctcagtaccatcagcatttggctgagaagcttgacctggacatgtcggctctgcagtatatgatgagagagtacccgggaactgaagaagagaagatgagagctgccgtgggtcggtttggacttactgggaaagctcaagtgatgcccatgaagaacttgtcagatggacaaaaaagcagagtcatttttgcatggttagcctacagggtgccacatatgctactgctggacgagcctactaaccatttggatattgagaccattgactcgcttgctgatgccttgaatgaatgggatgggggtatggttcttgttagccacgatttccggcttataaaccaggtggctcatgagatttgggtttgtgagaatcaaagtgtgaccagatgggagggtgacatcatggactttaaggcacacttgaaggcgaagtctggactttaaaccagacaactatggagcgacagctctgttgtgcgctttctgatgtttttcactgctattgtgcatgtcaaaggaggcgttcacctgggccggccgttgctggagcatggtattgtgagtccctatgtaaagagaaaccctggctgagctttcttttatacaggtattttgctatattattattacctactatccgaggtagcctgcagtgactgagatgatagcctgcactgatatggattttgcatactatttaatgttgtaacgaatggttataagccattgtttctagtattttaataatttattattatgtcgaaggagaatttatttagctactgaaggataataattgttttcgggcttgtggttgatgtttgtgaacagccaggaagaaccctgagtttg

SEQ ID NO: 3956 - DNA, 1860 bp, Coffea canephora
catcggagcacgcccctcatcctctctgttccgattcaaggaaataattactcctaccaaattgagaagagaaaaagaaaaagaaatacgcacacacgctgttccattgcaaaaacgatacttgaaaccctagatctcagctgtcaagatggtttcggacgcgagcaagaaaagagacgcgcagaagaaggcggcggcggcagctaagagaggaggtaagtcagctgcagcatcgtctaaagctgccaaggaagttgccgcggcggcggcggcagccaccacagcggcggagaatggaagcgctgatagtttggcaaatggagttgggatgctccagatatcggatcggacttgtaccggcgtgctttgttctcatccgctgtccagagatattcggattgaatccttgtcacttacattccatggacatgacctcatagttgactctgaactggaactaaattatggcagacgttatggtttgctaggattgaatggctgtgggaaatctactcttcttgctgcaatagggtgtcgtgaactgccaattccagatcatatggatatttaccacctcaccagagagattgaagcttcagacatatcttcacttgaggctgtcataaactgtgatgaggagagattgaagttggaaaaagaagctgaagccttggctggacaggatgatggtggtggtgaacaacttgagcgtgtttatgaacgtttggaagccatggatgcggctactgctgaaaagcgagctgctgaaatcttgtttggacttggtttcaccaagaagatgcaggaaatgaaaacccgagacttttctggtggctggagaatgaggatcgctctagcaagggctctgttcatgaatccaaccatactcttgctggatgaacccacaaatcatctcgatttagaggcttgtgtttggttagaggaaactctcaagaagtttgaccgcatattggttgtggtctctcactcccaggattttctgaatggtgtctgcaccaacatcatccatatgcaaggtaagaagttgaagccttacactggtaattatgatcagtatgttcagactcgggccgaacttgaggagaatcagatgaaacaatataagtgggagcaggagcagatagcttcaatgaaagagtacatagctcgctttggacatgggtcagccaaactagctcgtcaggcacagagtaaagagaaaactctggccaagatggagcgaggtggcctgacagagaaggtggcgagggacaaggttttggttttccgctttactgatgttgggaagcttccacctcctgtcctacagtttgttgaagtttcttttggctatacacctgataacctcatctacaagaatcttgattttggggttgaccttgactcaagggttgctctggttggacccaatggggctggtaaaagcacattgcctaagctgatgacaggtgatttggttccccttgatggcatggtccgccgtcacaaccacttgaggattgcacaattccaccagcacttggctgagaaacttgatctggagatgccagctcttcagtttatgataaaagagtaccctggcaacgaggaagagaggatgagggcagcaatcggcaagtttgggctttctggtaaagctcaagttatgcccatgaagaatttatcagatggccaaaggagcagggtgatttttgcctggttagcttggaggcaaccccacatgctgttgttggatgagcccactaaccatttagatatcgagacaattgactccttggctgaggcactgaatgagtgggacggtggccttgtacttgttagtcatgattttaggcttat

SEQ ID NO: 3957 - DNA, 1880 bp, Centaurea maculosa
  misc_feature (206)..(206): n is a, c, g, or t
  misc_feature (208)..(208): n is a, c, g, or t
  misc_feature (229)..(229): n is a, c, g, or t
  misc_feature (231)..(231): n is a, c, g, or t
  misc_feature (237)..(237): n is a, c, g, or t
  misc_feature (240)..(240): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (399)..(399): n is a, c, g, or t
  misc_feature (441)..(441): n is a, c, g, or t
  misc_feature (444)..(444): n is a, c, g, or t
  misc_feature (449)..(450): n is a, c, g, or t
  misc_feature (465)..(465): n is a, c, g, or t
  misc_feature (483)..(483): n is a, c, g, or t
  misc_feature (516)..(516): n is a, c, g, or t
  misc_feature (532)..(532): n is a, c, g, or t
  misc_feature (543)..(543): n is a, c, g, or t
  misc_feature (570)..(570): n is a, c, g, or t
  misc_feature (573)..(573): n is a, c, g, or t
  misc_feature (1266)..(1266): n is a, c, g, or t
  misc_feature (1284)..(1284): n is a, c, g, or t
  misc_feature (1653)..(1653): n is a, c, g, or t
  misc_feature (1671)..(1671): n is a, c, g, or t
  misc_feature (1721)..(1721): n is a, c, g, or t
  misc_feature (1799)..(1799): n is a, c, g, or t
cgcgggctgtcaatgggatggggtcgcttgtgatttccgatcgtacgtgtactggagttctgtgttctcatcctttgtccagggatattcggatagagtctctgtctcttacttttcacggacatgatcttattgttgacacagagctggagctcaactatgggagacgctatggtttgcttgggctgaatggctgcgggaaatcncncttcttacttcattggaatgngngaactnccnatccctgagcacatggatatattccatctcaccagnganatcgangcttctgatatgtcttcactcgaggctgtgatgaactgtgatgaggagaggttgaaattggaagcagaggctgagctcttggctggacaggatgctggcggtggagaagcactngaacgtatctatgaacgtttggatgccatggatgcaaacacngcngaganncgtgcagccgagatnctgaacggtcttggtttngacaagaagatgcaagcgaagaaaacacgaganttctccggtggttggngaatgcgaatngctttggcacgtgctctgtttatgaanccnaccatcttgctgctcgatgaacccacaaatcatcttgatctcgaagcttgtgtgtggctggaagaaaccctaaaaaatttcgagcgcatacttgtggtggtgtcacattctcaagatttcttgaacggtgtctgcaccaacataatccacatgcaaagtaagaagttgaagatgtataccggtaatttcgaccaatatgttcaaactcgatctgaactggaagagaatcagatgaagcagtacaaatgggagcaggaccagattgctggtatgaaagagtacattgcccgtttcggacacgggtctgctaagctcgctcgtcaggcccagagtaaggagaagactctagccaagatggaacgcggtggtctgaccgagaaggtcgctagggacaaggttctcgtcttccggttcgtcgatgtgggcaagcttccgccgcccgtccttcagtttgtcgaggtttctttcggttacacacccgacaacctcatctacaagtgcctcgactttggtgtcgacctcgactcccgtgtggcgttggtgggacccaacggggccgggaagagcacgctgctgaagctgatgacgggggagttgcatcctctcgacggcatggtgaggcggcacaaccacttgaggatcgctcagtaccaccagcacttggcggaaaagctcgacctcgatatgtcggcnttgttgtatatgatgcgngagtatcccggaaacgaggaggagaagatgagggcgtccatcgggaggtttgggctgacgggtaaagcccaggtgatgccgatgaagaacttgtcggacgggcaaaagagtcgtgtgatattcgcgtggttggcgtttcggcagcctcagatgctgcttttggacgaaccgaccaaccatttggatatcgagacgatcgactcgttggccgaagcgctgaacgagtgggacggtgggttggtgctggttagccatgacttcaggctgataaaccaggtggctcatgagatatgggtgtgtgagaaccaggctgtgaccagatgggaaggtgatattatggggttcaaggagcatttgaagaccaaggcngggttatctggttagggnggtggtgtgggttgggctccatattatagcagccatgggtcaagtccttntgggttgaggccttgagggttggcagagtctggtttggttggtatagatggtgaagtgggcttattatgatgactatnaatgaggaggatgatggggttgtgaaattttgtggcctctaagtttgttttttttcttgcactataatattttgaatttta

SEQ ID NO: 3958 - DNA, 2621 bp, Physcomitrella patens
gtgcccaccagaaagttctactgtggatgtcacggtccaaaaaatagcatgtggtaggaatgagaaacgccacaacagcggcttgacatgagcgagagtattgatcaatttttattatagtaccggaattttctagagcccgagagaaaggaccaagtcttccaggatagtgtgatctggtgcaacaagattgacatttctcgtgcagacgagggagtgactgtagggattggaaggcgctgtcgttccctgcggtaggaggtcgatttccaattgttgctctgcctcggaacattgcgggccttacaatttggctgtctgtgtctcttctcacttctagaaacttttccaactgcatgcacgctactatctcgatttgacggattccgtggtttctgactccgcctaggcacaagcagcaatggtatccgacgctagtaagaagaaggctgcggccaagaaagccgccgcagcagagaagcgtggatctaaatcggctgcagctgtagcgcagtctaagctgaaagaggtgcaggctggggccaccgccgaaagtttggctgaggagatggcggcagccaggattacggatcggacatgtacgggtgtcttggcatcgcatccgcagtccagggatattcatattgaatcgttatctgtgactttccacggtcatgagctggtgtctgactctactcttgaactcaattatggaaggcggtatggacttcttgggttgaacggctgcggcaaatcgacacttcttacagccattggactccgagaagttccaataccagagcatatggacatctaccatttgaccaaggaaatcgatgccacggatctgactgctcttgaagctgttaagaatgtggacgaagagagattgaaattggagaaggaagctgagaagcttgctgctcaagacgatggtggtggggagctattggatcggatttatgagagattggaacttatggattctgcgacggctgagatgcgagccgcacaaattttgcatggtctagggttcaccaagaaaatgcaagctaagaaaacacgtgatttttctggaggatggaggatgaggatagcgttagcaagggctctcttcatgaatccaacgatacttttgttggatgagccaaccaatcaccttgacttggaggcatgtgtgtggctggaagagaccctgaagaaattcgatcgaatattggtggtcgtatctcattcccaagattttctgaatggtgtgtgcaccaacatcatccatatgcaaagcaaaaagctcaagttttacactggaaattacgatcagtattgtcaaacacgagcggagttggaggagaatcagatgaagcaataccgctgggagcaagagcagatagcaggcatgaaggaatatattgccagatttggacatggttctgcaaaactggcccgacaagctcaaagcaaagaaaagacactggcaaagatggagagaggtggacttacagagaaggttgttaaggataaggtcttgactttcaggtttacagacgttgggaagctacctcctcccgttctccaatttgtggatctcacgtttggttacactcctgatcagcttatctatgagaaggttgattttggtgtagatctcgactctaggattgctcttgttggaccaaatggagcagggaagagcactctgttgaagctcatgactggcgacgtcacgcctacggatggcatggtgcgccggcataatcaccttcgcattgcccagtatcaccagcatcttacagaaaagctctctcttgaaatgtcagcactccaatatatgatgagcgaataccctggtttggaggaggagaaaatgagggcagctattggacggtttggactgacagggaaggctcagattatgcctatgggcaatctctccgatgggcagaagagccgtgtcatctttgcctggctagcttggagactgccccacttgctcttattggacgagcccaccaatcatttggatattgaaaccattgattctctcgcggaagctttgaatgagtgggatggaggtatggttcttgtcagtcacgatttcaggctcattaaccaagtcgccaaagagatctgggtatgtgagaagaagtccataactaagtggaatggtgatattatggattttaaacgacacctgaagaaaagtgcaggtttgtaaagctagaaagtgtggaaagtaatgtctctaagtagtagccttggtaagatattcttatcctgaagtgctaaaccacttaccatctttaaaaatagaatagtgatgttttacggaaataggaatgtcaggacgaacggttggcctcgaaggttaaagaatatccctaggttagttccaaatgattttttctcggaatcttagtcggttttgatttgaagcgcatttcatgcttcatcaacaactgcttgagttgggtctagcttcaacggcatagattcttgtaacattcggtgagtgggctatgtagtagtcaaagaaaggtatctgctatatttgatcctagaaattattgtgcacaaggttcatcaaaacaactgtctggaaaaaatcatttacttgacacagc

SEQ ID NO: 3959 - DNA, 2954 bp, Physcomitrella patens
atggatgattcactgaagtcggtttgggccaaccgaagcaaaacccaagggcacggtcaaggggcgaagaccacggtggggggggggactgacggagttgacaacgtgtggtctctttcaaaccggaaaaccctaaaagtgcagttcgttcgcgtttcgtccaacgaaggtcccgacctccgtccagtggggacgagaacatgggtcgacttccctttcaagaggtgcgacgagcgcatacgcctctgctcatttgcaaggctgcgactccgccgcagcgaaatcttgcacggccgctctgctcctcggatttgtcaaggcactgcaacaactgcgaacagatccatctttggagtgaggagaacatagtttgtgctcgtttgaattctagcacacgagacaatggtgtcagacgccagcaagaagaaggccgcggccaaaaagctcgctgctgccgagaagcgtggatccaaatcagcggccgttgttgcacagacgaagctgaaagatgtcactaacggtacctctgcggacaccctggcggaagagttggctgctgctaacataactgaccggacttgtacgggtgttctagcatctcatgcccagtcaagagatatccacatcgagtccttatctgtaacattccatggtcacgagctggtggcagactcaactttggaactgaattacggaagacgatacggtttgcttggactgaacggttgtggaaaatctacgcttttgaccgctatcggtcttcgagaagtcccaatcccggagcatatggatatataccatttgaccagagagatcgacgctacagacatgacggcgcttcaggctgtcatgaatgtggattcagagaggcttctcctggagaaagaggctgagaagctctcccaacaagatgacggtggaggcgagcccttggagcgtatttatgagaggttggaggccatggactctgccacagcagaaatgcgggcagcccagatcttgcatggtcttggattcactaagaaaatgcaaaacaaaaagacgcgagacttttcgggagggtggagaatgaggattgctttggctcgtgctttgttcatgaacccaacaatcctcctactggatgaacccaccaatcacttagatttggaggcttgtgtgtggttggaggagaccctgaagaaatttgagcggatcctggttgttgtctctcactcccaagattttttgaatggtgtgtgcacaaacatcattcacatgcaaaacaaacagctcaagttttacacaggaaattatgatcagtactgtcaaacaagggctgaattggaagagaatcagatgaagcagtatcgttgggagcaagagcagatatcagctatgaaggaatatatcgctcgatttgggcacggttctgcaaagctcgctcgtcaagctcaaagtaaagagaaaacgctagccaagatggaaagaggtggactcgcagaaaaggttgttagggataaggttttgactttcaggtttacggatgttggaaaactgccaccacccgttcttcagtttgttgatctgaagtttggctacacacccgatcagcttatatatgagaaggttgactttggcgttgatcttgactctcgcatagccctcgtgggacccaatggagctggaaagagtactctcttaaaactcatgactggtgagttggagccattggatggtatggtccgtcggcacaatcatcttcgaattgctcaatatcatcagcaccttgcagagaccttatcccttgaaatgtcagcacttcagtatatgatgtcggagtaccctggcctcgaggaagagaagatgcggtctgccattgggcgctttggactcactggtaaagctcaagttatgcctatgggcaatctctctgatgggcagaaaagtcgtgttatttttgcgtggttggcgtggagactaccccatctgctccttctggatgagccaactaatcatttggatattgaaactattgattctcttgctgaggctcttaacgagtgggacggaggtcttgttcttgtcagtcacgacttcaggctcatcaatcaggttgccaaagagatctgggtgtgcgagaaaaagacgatcactaggtggaatggtgatattatggatttcaagagacatctcaagagatctgcgggactgtaggttatagatggtgagttttgtgccggtggctaccttgcttgcaagttcagagagctcgcgctgctaccgaagaagacttttagagataatgacgcaaatgttgggggtggatgtaatatttgaagtttgaactcgtctcaccctagataccagcaacatttttcctccgtgaaacgttccaagcgtcagcttctgaaatgagctcctacaaacgctgtggtgctccttgattgccacaaaatggcttagctgcggcgaatgttggaattagattaagatcgtggaagcatgatttttatttgagattttttggatagagaaacctgcagtacatgctattttttgtacatgtgcgtgagttggtttctggacacgttccaagtgggttgcaatattgcacagccacgccgcggaaatgtggaggctgtcgattctcctggtatttcattcatgacatagtagttttctggaggatgtgaccgacgggcaccctttctactcagttgggtcagcattcccacttcataaggtatgcattctgcagagaccattttaaagagtccttagtaaggctcatttttgtaacttttcaatacgaattagttgaccttcatatttctttcattctctactacctggcgtttcaggtcatcttcgacagtttattaaaatagtgtaaatgcttaatattcatggagtcctgtagttgacatttggagagggtcgattctggaaattcaagaatcttttccatatgc

SEQ ID NO: 3960 - DNA, 2524 bp, Ceratodon purpureus
cctctctctcgccatcgccgcacctcccccgcatcgcccccgccctggcaccagattacaggattttgtgtgtgcagttaggcacaagcaacaatggtgtctgatgcaagcaagaagaaggctgcggcaaagaagcttgccgccgccgagaagcgtggatccaaggctgcggcagttgttgcgcagacgaagctgaaagatgtgacgagtggaaccaccgctgacactctggcagaggaattggctgctgctaacatcactgatcggacttgtaccggtgtcctggcatcgcatgcgcagtccagggatattcacattgaatccctttccgtgacgtttcacggtcacgagcttgtagccgactctacgctggagctgaattatggaagacgatacggtctgcttggtctgaacggatgtggaaaatcaactctgcttactgcaattggactacgagaagtaccaattccagagcatatggatatttaccacttgactcgtgaaatcgacgccaccgacatgacatcacttgaggcggtcatgaacgtcgatgaggagagattggttctggaaaaagaggctgaaaagcttgctcagcaagaagacggtggtggtgaacccttggagcgcatttatgagaggttggaagcaatggattccgccactgcagagatgcgcgctgcccagattttgcacggtctaggatttacgaagaaaatgcaaaataagaagacccgtgacttctcaggagggtggaggatgcggatagctttggctcgtgctttgttcatgaatccaaccattctcttgttggatgaacctacaaaccatcttgatttggaggcatgtgtgtggttggaggagaccctaaagaagtttgagcggatcttggtggttgtgtctcactctcaagatttcttaaatggtgtttgtacgaacattattcatatgcaaaataagcaactcaagttctactctggaaactacgatcagtactgccaaacacggtctgagctggaagagaatcaaatgaagcagtataggtgggagcaggagcagatctcagcaatgaaagagtacatcgctaggtttggtcacggttctgccaagctagcccgacaagctcaaagtaaagagaagaccctggccaagatggagaggggtggactggcagagaaggtcgtcagagacaaggttttgactttcagattcacagacgttggaaaattgccaccaccagtgctccagtttgttgacctgaagttcggttatacacctgatcagttgatctacgagaaggtcgatttcggcgttgatctcgactctcggattgcgcttgtgggacccaacggagcaggtaagagtactctcttgaagctcatgactggtgagctcgagccactcgatggaatggtccgtcggcacaatcatctccggattgcgcaataccaccaacatctcgcagaaaccctgtcactcgagatgtcggcgcttcagtatatgatgtccgagtaccctggtttggaggaagagaagatgagatccgctattgggcggttcggccttacaggtaaggcacaagttatgccaatgggtaacctttctgatggacagaagagtcgtgtcatctttgcgtggttggcatggagacttccccacatgcttcttctcgatgagccaaccaaccatctggatatcgagaccattgactctcttgcagaggctctgaatgagtgggacggtggtctggttctcgtgagtcacgatttcaggctcatcaaccaggtcgctaaggagatttgggtatgtgagaagaagactatcaccaggtggaatggtgacatcatggacttcaagagacacctcaagaaaaccgcaggattgtagagggcgacccatgcgtccccacttttagctagtagtttttgatacagtattacgaatggaagccatttagggatattgatgcaaatgttgggggtggatgcaaaccttcaagtgtaaactcatcctcacccatgggtacgaagaacattttttctcctgaacacggcatcagctcttctccaagcgcacgggtatacaccactgacgtgtatcattcatgacggtaagagagctgcatcggagctgagatcggagtattaattggaatttttcccttattgacccgcacacatgcgtgagtgaattaatttctagacatacgttctgagtgggctgcaacagtgcagagccattcctcgaaagtgctgtggagcgtgataatgacgctcccgtgctcctactttttattcatggttggatagtttcctgacgggctcctggaggccttgttggttgatactacttccattattttagagggtattctgcctactcgcagagatatttgtaaagagtcctggaatgtcttaatgttgcattctcagaataagactcccagttttgtaatttcgttctagtacgataatatattcttatatattagtgcgtggttccgatttccacgtcgagcttgaat

SEQ ID NO: 3961 - DNA, 2581 bp, Physcomitrella patens
atttgcaagcaaggctgcgactcccccaccgccgcagcagcagcgagctcctctttccttcactctccctttctcttccgcatctaattccacggctcccgaactggacacagatccagtattttttagtgtgcatttaagcacacgcaacaatggtctcagacgcaagcaagaagaaggccgcggccaagaagcttgctgcagccgagaagcgtggatctaagtctgcggctgttgttgctcagtcaaagttgaaagatgtgtccaacggtaccacagctgataccctggcggaggaattagctgccgccaatatcacggatcggacgtgtacgggtattttagcgtcgcacgcccagtcaagggatattcatatcgaatctttgtctgtaacgtttcacggtcacgagctggttgcagactcaactttggaattgaattatggaagacggtacggattacttggactcaatggttgtggaaagtcgacgctgcttactgcaatcgggcttcgagaagttccaattccagagcacatggatatttaccacttgactagagagattgatgccacagacatgacgtcgcttcaagctgttatgaacgttgattctgagaggttactcttggaaaaggaggctgaaaagctttcccaacaagatgatggtggtggtgagccgttggagcgcatttatgagagattagaggccatggattcagctacagctgagatgcgagcagcgcaaatcttacatggtctcggatttacaaagaaaatgcaaaataagaaaacgcgggacttttccggaggttggagaatgagaatagcactggctcgtgctttgttcatgaacccaacgatcctcttgctggatgaacccacaaatcatcttgatttggaggcttgtgtgtggttggaggagaccttaaagaagtttgagcgaattttggtggttgtatcacattcccaagattttttgaatggtgtgtgcacgaacatcattcacatgcaaaacaaacaactcaagttttacacaggaaattatgatcagtattgtcagacacgagcagagctggaagagaatcagatgaaacagtatcgctgggaacaagagcagatctcagcaatgaaggaatatatcgccaggttcggacacggttctgcaaagcttgctcgacaggctcaaagtaaagagaagacactcgctaagatggaaagaggtggactagctgagaaggtagtcagggataaggttttgactttcaggttcacagatgttggaaaattgccgccacctgtgcttcagtttgttgacctaaagttcggctacacacctgaccagttgatctacgaaaaggtggattttggagtggatcttgattctcggattgcccttgtgggaccaaacggagcaggaaagagtactctcttaaaactcatgactggtgagctagagccactagatggtatggtacgccggcacaaccatcttcgcattgctcaatatcatcagcatcttgcggagactttatcccttgagatgtcagctcttcaatatatgatgtctgagtatcccggtttggaggaagagaaaatgcgatctgcaatcgggcgctttgggctcacaggcaaagctcaggtcatgccaatgggtaatctttctgatgggcagaaaagccgtgtgatttttgcgtggttagcgtggagacttccccacctactcttactggacgaaccgacgaatcatttggatattgaaacaattgattctcttgcggaggctctgaatgagtgggatggaggtctggtccttgttagtcacgacttcagactaattaaccaggttgccaaagagatttgggtatgtgagaagaaaacaattaccaggtggaacggtgacatcatggatttcaagagacaccttaagaagaccgcgggactctaggttactattgttgagtgatgcagcggaggactgctatgtccccaatttctgacggttactgctactaccattgaagacatttaggggtaatgacgcaaatgttgggagtggatgtcgtatattaaatgtgaacttgtcctcatcttgggtaccaacatcattttttcctccatggaactccatcagcttctgcattcaaagcggactacaaaatccgctttgtgtccttccgcaggtaccaccgatgagtaacatctgtgtgagtaaagcatgaaggtaggatcggcttattaatttttggatggggaaacctgcagtgcgtgtcctttttttgagcacgtgcgtgagttggttttcggacatttgttccaagtggactgcaacagtgcaaagccactacgcggaaatgtgaagcctggtgatgcccctggtatcccattcgcaatggttttctggagatgtgagcgacgggcgcctcttaggcaatttaggtcgtaatttcatttattaaggtattctttctacagagctatttgctaagagtcctgtaatgccttcgtctatgcattatcagaataagtctcacatttctgtaatttttaatatgatatatgtgaagtgttgattttttccac

SEQ ID NO: 3962 - DNA, 2079 bp, Trigonella foenum-graecum
ataaaaaggataattcttctgccatataaatacagttaattgccaatggatttaaaatgatcaatgttgtattgtattgtattgatgttttggtttatgctgcaattacagatagaatctctatctgttactttccatggacatgatcttatagttgattctgaattggagctaaactacggaagacgttatggtttgcttggattaaatggttgtggaaaatctaccctgcttacggcaatcggttgtcgtgagcttcctattccagaccacatggatatttatcaccttagccgggaaattgaagcctcggacatgtctgcattggaggctgtcattagctgtgacgaggaacggttgaggttggagaaagaagctgaaattctgggagcacaagatgatggcggtggtgaagcacttgaacgagtttatgaacgattggaagctatggatgcatcaactgcagagaagcgtgctgctgaaattttatttggtcttggtttcaacaaggagatgcaggcaaagaagacacgtgatttttctggtggatggagaatgaggattgctttagcacgagccctatttatgaacccaaccattcttctacttgacgaaccaaccaatcaccttgatttggaagcatgtgtgtggttggaggagaatttgaagaagtttgaccgtattctggttgtgatttcacactcccaagatttccttaatggtgtctgcacaaatatcatccacatgcaaaacaaaaagctgaagctctatactggtaattatgatcaatatgttcagacacgtgctgaactagaagagaaccagatgaagcagtacaagtgggagcaggagcagattgcctcaatgaaggaatacattgcacgatttggccatggatcagcaaagctagctcgccaagctcagagtaaagagaaaactcttgcaaaaatggagcgcggtggacttacagcgaaggtggtaagagacaaaattttagttttccgctttgttgatgtgggaaaacttcccccacctgtcctccagtttgtggaggtgacatttggttacactcctgataatctcatctacaagaatatcgactttggggttgatttagactctcggattgctttggttggacccaatggagctgggaagagcacattcctgaagcttatgacaggtgatttggttcccttagatggcatggttcgtcgccataatcaccttcgcattgcacaatttcaccagcacttgactgaaaagctagacctggaactgtctgctctccaatttatgattaaagagtaccctggaaatgaggaagagaggatgagagcagctattgggaagttcggattgtccggtaaagcccaggtgatgcctatgagaaatttatcggatggacagaggagtcgtgtgatctttgcatggttagcgtatagacagcctcacttgctactattagatgagccaactaatcatttggatatcgagacaatcgactcattagccgaagcattgaatgaatgggatggtggcatggtgcttgttagtcatgatttcaggctcataaatcaagtggcccatgagatatgggtgtgtgctgatcaaacagtgaccagatgggaaggtgatattatggatttcaagcagcacctgaaggcaaaggcgggtttagctgactgaaaagatggtgaactcattacaatgtagattggtgttgctacttgagatggatttctctcatggtgattatagtcaaattaaatgggggagaatcggacatagaaaaatcatgggcttatttattttgagctaagaagtccttaacctctgtaatatttttaattatttgtggtgcttatcaatatggttgcttagatgttgagcaacttgatatatagataatggaatggtagtagatgtgatacgtatctagatttactagttgtaactgttgtacacgactagcattattatacatcagcagtacttctttcctctggctcattatgaaccattaacccttcataatttcttcatacttcacatgggaatgatatatttgtttaactt

SEQ ID NO: 3963 - DNA, 1865 bp, Musa acuminata
gtgggcatgacctcatagtggattctgagttagagctcaactatggcaggcgctatggtttgttaggactaaatggctgtgggaagtcaactctcctgtcagcaataggatgcagagagctccctattcctgaccacatggatatatatcaccttacgagggagattgaagcttcagacatgtcttctttggaggctgtgataagctgtgatgaagaaagattgaagttggagaaagaagttgaaatgttagctggcgaggatggaggtggtggtgaagcgttggatcgtatctacgagcgattggaagcactggatgcatcaaccgctgagaagcgggctgctgagattttgtatgggcttggttttaataaacaaatgcaagcaaagaaaacccgggacttctctggtgggtggcgtatgaggattgcattggctagagcattgttcatgaatccaactatccttttgcttgatgaacccaccaatcatcttgacttggaagcatgtgtctggctagaagagactctgaaaaagtttgatcgtatcctagtcgtggtatcacactctcaggattttcttaatggcgtctgtaccaacatcatacacatgcagaacaagaagctaaaattctacactggcaattatgaccagtatgtccagactcggtctgagctggaagaaaatcaaatgaagcagtacaagtgggagcaggagcaaattgcttcgatgaaggagtacattgctcggtttggtcatggttctgctaagctggctcggcaagcccagagtaaggaaaaaactcttgccaagatggagcgtggtggactaacagaaaaggtggtgaaggacaaagtactggtattccgcttcacagatgttggtaaacttcccccaccagtcctgcagtttgtgggagtcacttttggctacactccagataacctcatttataagaaccttgattttggtgtggacctcgactccagaatagccttggtagggcctaatggtgctgggaagagcacattgctcaagctgatgaccggtgatcttgctcctttggatggaatggttaggcggcacaatcatctcaggattgcccagttccatcagcatctggccgagaagcttgatctagagatgccagcgctccagtatatgatgaaggagtacccaggaaacgaggaagagaagatgagggctgcgatcgggaagtttgggttgtcaggaaaggcacaggtgatgccgatgaataacttgtcagatggtcagaggagcagggtgatctttgcttggctggcctggaggcaaccgcatctgctgctgcttgatgagcccacgaatcatctggatatcgagacgatcgattccctggcggaagcactgaatgagtgggatgggggtctggttttggtgagccatgacttcagattgatcaaccaggtggccgaggagatatgggtctgcgagaatcaagcggccacaaggtgggagggtgacattatggacttcaagcagcatctgaggagcaagactgagttctctgattgatatgtgaagggagggcagcagagttactctaaaggttagcatttttattccatgactacctaatcatcttagttgatttttacagttacgtatcactttgatctaccctttcgaatgctattattatatgggtcttaggcagaagcctctactatgttggtggtaggcacaagtactccacactatggtcgattaccttttgttacaagaactatgttatttgttgtcttgtctgtactatcacctacgttgcatttgcgatctaaacatgaacgagatgatgattagtgaagaattaattactctgttgga

SEQ ID NO: 3964 - DNA, 1949 bp, Lolium multiflorum
ggcacgaggatccgctctcccgtgatatccacatagagtccctttcattaacatttcatggccatgaccttatcgtggattcagagctggagcttaactatggcaggcgttatggtttgctcggcttaaatggttgtggaaaatctacccttctcacagcaataggccacagggaacttcccatccctgaacacatggacatccaccacctcacccgtgagattgaggcatcggacatgtctgcgctgcaagctgttatctgctgtgatgaagaaagaatcaagttggaaaaggaagctgagattttgtctgcacaggatgatggtggcggtgaagctctggatcttgtatatgagcggttagaagcaatggatgcatcaactgctgaaaagcgtgctgctgagatattgtttggtctaggttttgacaagaagatgcaagcaaagccaactagagatttctctggtggttggcgtatgaggattgcgttggcaagggcgctgttcatgaatccgaccatccttttgcttgatgagccaactaaccatcttgatcttgaggcttgtgtctggctggaagaaaaattaaagaattttgagcgtatacttgttgtcatctcacactcccaagattttctgaatggagtgtgcactaacatcatccacatgcagaacaaaatcctcaagttatatacaggtaattatgaccagtatgtgcaaacccgctctgaacttgaagagaatcaaatgaagcagtacaaatgggagcaggaacagattgctggtatgaaggagtacatcgcacggtttggtcatggatctgcaaagcttgctcgtcaggctcagagcaaagagaaaactcttgcaaagatggagcgtgctggtcttgctgagaaggttgtcaatgacaagattctggtgttccgctttacagatgttggcaaactcccaccaccagtgctacagtttgctgacgtgacatttggatacactccagataatctcatttacaagaaccttgactttggtgttgaccttgactcaagagttgcactggtcggccccaatggtgcgggtaaaagcacacttctgaagctcatgaccggtgacctaactccattggacggcatggtcaggcgccacaatcacctacgcattgcacagttccatcaacatctcactgagaagctggacctggacatgccagccctgcagtacatgatgaaggaataccctgggaatgaggaggagaagatgagagctgcaattggcaagttcggcctgtcagggaaggcacaggtaatgccaatgaataatctgtcagatgggcagaaggcccgtgttatctttgcttggctggcattcaggcagccacagatgctgttgctcgacgagccaacaaatcatcttgacattgagaccatcgactcccttgctgaagcactgaaggaatgggacgggggattggtccttgtgagccatgacttcaggctgatcaaccaggttgctcaagagatctgggtgtgtgagaaacaggcggtgaccaggtgggaaggtgatatcatggatttcaagcaacacctgaagaagagggctggtctctagagtgcctttgctttttggtcctcggctctttggagatctatagacaacccaaagttttgcctctgtatcagaaaagttttaattttctagagtaactacatgtatgagtatcattgtatcgagttaagacattccagtacgtcatttttataaccagatgattcatattattttaatatcttgttggtgttagttattcgtcattattgatttacttatgatggtccgttgtgttgtatcctggagttctgtgtttgtaaccaaaggatggtttatttgactggtatctagtagtagtgttcaaattaaaaaaaacaaaaagtaaacctcggccgcgaccacgct

SEQ ID NO: 3965 - DNA, 1850 bp, Sorghum bicolor
agctgcccaaattcgcctgcgcatcctggtctcccgtccccgcacgcacacgcacctaccattcccggctcccggcacggccgcgcccgagagcgacgcccgccacccacccaccccgccgccgccgccgccgcctcgattcatctggcaatcgaggggactcccagatacagatacaccacgccacgccaaatcgaacaacacctatcataatcacatattcgtccatctcccagtcccaccctcctcctcctccctcgtcgccaacctccaacccccccgcgccgatcgcgtcggagatgctgggcgtcgcgcggaggcggctcggatccggatgcgtgctctcccagctggcgcaggccctccgccccgccgccgccgctcccgccaggacctactccgccgccgccaaggagataactgtacgggaagcattgaataccgcattagatgaagaaatgtcggcagacccttctgttttcttgatgggagaagaggttggtgagtaccaaggcgcatacaagatatctaagggtttgcttgacaagtatggccctgatagggttctcgatactccgatcactgaggctggcttcactggcattggtgttggcgccgcctaccatggtcttcgacctatagtagagttcatgacatttaacttttcgatgcaggcaattgatcacataattaattcagctgccaagtcgaactacatgtcagctggccagatatctgtacctattgtcttcaggggtccaaatggtgctgctgctggagtcggtgcccaacactcgcagtgctatgcagcttggtatgcacatgttcccggattgaaagttctagctccatattctgcagaagatgctcgaggtttgctaaaagcggcaatcagggatccagatcctgttgtgttccttgaaaatgaacttctttatggtgaatcgtttcctgtttctgctgaggtacttgattctagcttctgccttccgattggcaaggctaagatagagcgacagggtaaagatgtcactatcactgcattctccaagatggtcggatatgctcttcaggctgccgatatactggccaaggaaggtatcagtgctgaggtaatcaatcttcgctcgattagaccgctggatagagctgctattaatgcatctgtgaggaaaaccaatagattggtaaccgtagaagaaggtttccctcaacatgggattggtgctgaaatatgcatgtctgttgtagaggacagctttgagtatcttgatgcaccagttgagaggattgctggagctgatgtccccatgccgtacgctgccaaccttgagaggatggctgttccacaggtggatgacatcgtccgggcagccaagcgtgcttgctacagagctgcagtaccgatggcagcaacagcctaattcacacagaaccctgcctgttgcatttctttgtctaatgtccatactccagaaagacaaatgttccataatggtatgacgagtacccactgccgctgcaactcaactagcatgagctgattttgtagagccaccaagaggtgtccagtactccagtcccgttgtcttcgccgccgcagccggatggctgcgcattactctgcgtctgtttatggttcacgaatgattgcagcctctggagatgaagttttttacatgaggcgaggtggtgtgtcaataacatgtagtattcggaagtgggactctcaagaggtccccaaatagtggttctggttgcgccttttcttgataacgtcttttctatgctagtgctagaaactcctttgtctatctatccatggtcctgccagccagccaaactctggg

SEQ ID NO: 3966 - DNA, 1697 bp, Saccharum officinarum
cacgccacgccaaatcgaacaacacctatcataatcatattcgtccatctcccagtcccaggccgcccgcgtcttcctctccctctccctcccgcggatcgcgtcggagatgttgggcgtcgcgcggagacggctcggatccggatgcgtgctctcccagctggcgcaggccctccgccccacggccgcctccgctcccgccaggacctactccgccgccgccaaggagatcactgtacgggaagcgttgaataccgcattagatgaagaaatgtcggcagacccttctgttttcctgatgggagaagaggttggtgagtaccaaggcgcatacaagatatccaagggtttgcttgacaagtatggccctgatagggttctcgatactccgatcactgaggctggcttcactggcattggtgttggtgccgcctaccatggtcttcgacctatcgtagagttcatgacatttaacttttcgatgcaggcaattgatcacataattaattcagctgccaagtcgaactacatgtcagctggccagatatctgtacctattgtcttcaggggtccaaatggtgctgctgctggagttggtgcccaacactcgcagtgctatgcagcttggtatgcacatgttcccggattgaaagttctagctccatattctgcagaagatgctcgaggtttgctaaaagcagcaatcagggatccagatcctgttgtgttccttgaaaatgaacttctttatggtgaatcctttcctgtttctgctgaggtacttgattctagcttctgccttccgattggaaaggctaagatagagcgtcaagggaaagatgtcactatcactgcattctccaagatggtcggatatgctcttcaggccgctgatatactggccaaggaaggtatcagtgccgaggtaatcaatcttcgctcgatcagaccgctggatagagctgctattaatgcatctgtgaggaaaaccaatagattggtaaccgtagaagaaggcttccctcaacatgggattggtgctgaaatatgcatgtctgttgtagaggacagctttgagtatcttgatgcaccagttgagaggattgctggagctgatgtccccatgccgtacgctgccaaccttgagaggatggctgttccacaggtcgatgacatcgttcgggcagccaagcgggcttgctacagagcagcagtaccgatggcagcaacagcctaattcaacagaaccctgcctgttgcatttctctgtctaatgtccatactccagaaagatatgtcccataatggtatggcgagtacccactgccgctgcaacgcaactagcatgagctgattttgtagagccaccaagaggtgtcccgtactccagttccattctcttcgccgcgatggctgcgcatgactctgcgtctgtttatgtttcacgaatgattgcagcctctggagataagattttacatgaggcgaggtggcgtcaataacatgtagtattcgggaggagaactcacaagaggtccctcaatagtgattctagtcagcgccttcttgactacgtcttttccatgcttgtgctagaaacttctccattgtcctggcagccagcaaaacttttgagatgtattcccagaatggaagccaacatggttcgggccaattccttattgacagacatcaat

SEQ ID NO: 3967 - DNA, 1557 bp, Panicum virgatum
ccacgcctcctcatctacctccaagtccccacctcctcacccggtcgtcgccagcctccatcccgccgcccgcgccggagatgctgggcgtcgcgcggaggcggctcggatccggatgcgtgctcgggcagctggcgcaggccctccgcccggcggccgccgcgaggagctactccgtcgccgccaaggagataactgtgcgggaagcattaaactccgcactagatgaagaaatgtccgcagatccttctgttttcttgatgggagaagaggttggggagtaccaaggtgcatacaagatatccaagggactgctcgacaagtatggccctgatagggttcttgatacaccaatcactgaggctggctttactggcattggtgttggtgctgcttaccatggtcttcgacctatagtagagttcatgacatttaacttttcaatgcaggcaattgatcatatcattaattcagctgccaagtcgaactacatgtcagctggtcagatatctgttcctattgtcttcagaggtccaaatggagctgctgctggagttggtgctcaacactcgcagtgctatgcagcttggtatgcgcatgttcctggattgaaagttctagcaccatattctgcagaagacgctcgaggtttgctgaaagcagcaatcagggatccagatcctgttgttttcctggaaaatgaacttctttatggtgaatcatttcctgtttctgatgaggtactcgattctagcttctgccttccaattggcaaggctaagatagagagacaaggaaaagatgttacaatcactgcattctccaagatggttgggtatgcccttcaggctgcagatatactagccaaggagggtatcagtgccgaggtaatcaatcttcgttcaattagaccactggatagagctgctattaatgcatctgtgaggaaaaccaacagattggtaacagtagaagaaggcttcccacaacatgggattggagctgaaatatgcatggctgttgttgaggacagctttgagtatcttgatgcgccagttgagaggattgctggagctgatgtgcccatgccttacgctgccaacctagagaggatggctgttccacaggttgaggacattgtccgagcggcaaagcgggcttgctacagagcagtaccaatggcggcaacagcctaattcacagacccaatcgcttctcgatcttccatttcgttgtctgtgtgtccagaaagatgtgtcgcataatggtacgagtgcccactaccgctcccgctccaactcaactagcgtgagctgattttgtagagcaaccaagaggtgtgtccagttcagttctccgccgccacagcagccggatggctgcctgactctgcatcactttacggttctcaactcgggttcgcgagccatgcaggatttacatgagggggattgtgtcaataacataacatgtattttaaagggagctccaagaggtcctggaatagaaattctggttgcgccttgtttaaaatctctgtttccatgctggatatcc

SEQ ID NO: 3968 - DNA, 1663 bp, Oryza sativa
cagtacacccctatctcacccaccaccatcccaaggcggcgcgacgacccatctcgccgccgcgaattctctctccggcgaactccaactcgaaccctccctccgccgactccgctcacgagacctaaaccctccttccctctcctctcgtctcgttcccaccaccatgctgggcatcgcgaggaggcgcctcggatccggatgcgcgctggggcaactcatgcaggcgctccgaccggccgccgccgccgccgcggcgaggacctactccgccgccgccaaggagatgactgtgcgtgaagcattgaattctgcccttgatgaggagatgtctgctgacccttctgttttcttgatgggagaagaggttggagaataccaaggggcatataagatatcgaagggtttgttagacaaatatggccctgatagggttcttgacacaccaatcacagaggctggttttactggaattggtgttggtgctgcctatcaaggtcttcgccctgtggttgagttcatgacatttaacttctctatgcaggcaattgatcacatcataaattcagctgccaagtcgaactacatgtcagctggtcagataaacgttcctattgtttttagagggccaaacggtgctgctgctggtgttggtgctcagcactctcagtgttatgcggcttggtatgcgcatgtaccaggattgaaggtcctaactccttattctgcagaagatgctcggggcttgctaaaagcagcaatcagggatccagaccctgttgttttcttggaaaatgaactgctctatggtgaatcattccctgtttctgcggaagttcttgattctagcttctgtcttccgattgggaaggctaagatagagcaagaaggaaaagatgttacaattaccgcattctccaagatggtcggatatgctcttcaggctgcagagatactttccaaggagggaatcagtgctgaggtgatcaatcttcggtcaattaggccattggatagagctactatcaatgcatcagttaggaaaaccaacagattggtaacccttgaagaaggatttccacaacatggggttggcgctgaaatatgcatgtctgttgtagaggacagctttgaatatcttgatgcgccagttgagaggattgctggagctgatgtgcccatgccctacgctgccaaccttgagaggatggctgttccacaggttgaggacattgttcgtgcagcgaagcgagcctgctacagagcagtaccaatggcagcaacagcctaattcagtgacagtttttgtttctccatcttgtcttcttcccaatggccaggagtatgtaccacagcataatggtgtcttcccaagtctcaactagtgtaagctgattttgtagatccaccatgaggtgtcaatccccttctttctttagtcgcagtcggatggctgcatccgttcatagtccaaactgaatatacacatttgaaccatgcgacttctggagattttacatgaccggttgatgtcaataacatgtatgtaatggagctccataagtcggcaaaccaaacccccattagattcaatgtttgttcgtccatgcctctgaattgaatgcactggactctacaagttcatggtcctgttatccagaaa

SEQ ID NO: 3969 - DNA, 1541 bp, Saccharum officinarum
ctcccatcccggcaccgcgtctcctcctcggctcctccctcctttccatcccgcttctatcggtgcctccatctccaggccgcgtcgaattcctccgtccaccgcgccggtccggtcgccgaggaggaggaggatgctgggcgccgcgaggaggcagcttggatccggtcccatgctgggacaggttttgcgaaggctccgcccagcggcggcggcggctgaggtggcgaggggctactccgctgcggcgaaggagatgactgtccgtgatgcgttgaattctgcactggatgaagagatgtctgctgatccttctgtttttcttatgggagaagaggttggagagtatcaaggtgcatacaagatttctaagggcttgcttgacaagtatggtcctgatagggttcttgacacacctatcacagaggctggctttactggcattggtgttggtgcagcttatcatggtcttcggcctattatagaatttatgacatttaatttctcgatgcaggctattgatcatatcatcaattcagctgccaagtcaaactatatgtcagctggtcagatatctgttcctattgtttttagaggaccaaatggagctgctgctggagttggtgctcaacactcacagtgttatgcagcttggtatgcacatgttccaggacttaaggttctcacaccatactcttcagaagatgcccgaggcttgctcaaagctgctattagggatcctgatcctgttattttccttgaaaatgagttgctttatggcgaatctttcccagtttctgctgaagtgcttgattctagtttttgcctaccaattggcaaagctaagatagaacgcgagggtaaagatgttaccattactgcgttctccaagatggttggctatgctctccaggctgcagagatactgtccaaggaaggaatcagtgctgaggtgatcaaccttcgatcgatcagaccacttgacagagctgctattaatgcatctgtcaggaaaactaaccgattggtgactgttgaagaagggttcccccaacacgggattggtgccgagatatgcatgtctgttgtagaagaaagctttgagtaccttgatgcaccagttgagaggatcgctggagctgatgtacctatgccctatgctgccaaccttgagagaatggctgttccacaggtcgatgacattgtgcgggcagcaaagcgggcctgctacagggcagtaccaatggcagcagctgcctgattggtggacaagcctttctgttttccttccctcggctttcgctctctagccagagaacatgtattcataaggtgcaggcaaattggccggaccccagactccaagcgagctaattttgtagatctgccatggtgttatttattccgttagtcgatatatgctgcattctttctactttcaagtccatttgcttttctatgatttctacagacggccaaataatcttgttaaggccctgattgaatgcaaagtatcttttggagtaacatgaagtgtttgg

SEQ ID NO: 3970 - DNA, 1831 bp, Pennisetum glaucum
cctgcatcgcgggtcgcggccatcatcgtaacccatccctccctcctccctgccattctcccgttccgttccgccgcggcgtctcctccctccccatccccccacctctatcgccgcctccgtccccaacgcccgctcgaatttccgcacccgccgccgcgccgatcgccgaggacgaggatgctgggcgccgcgaggaggcagcttggatccggtcccatgctggggcaggtgctccgtcggctccgcccggcggctactgaggcggcgagggggtactccgtcgcggcgaaggagatgactgtccgtgatgcgttgaactctgcactggatgaagaaatgtctgctgatccttctgtttttctgatgggagaagaggttggagagtatcaaggtgcatacaagatttctaagggtttgctcgacaagtacggtcctgatagggttcttgacacacctatcacagaggccggctttactggcattggagttggtgcagcttatcatggtcttcggcctattgtagaatttatgacatttaacttctcgatgcaggctattgatcacatcatcaattcagctgccaagtcaaactacatgtcagctggtcagatctctgttcctattgtttttagaggacctaatggagctgctgctggagtcggggcgcaacactcccagtgttatgcagcttggtatgcgcatgttccagggcttaaagttctcacaccatactctgcagaagatgctagaggcttgctaaaagctgctattagggatcctgatcctgttattttcttggaaaatgagttactttatggagaatcattccctgtttctgatgaagtgcttgattctagtttctgcctgccgattggcaaagctaagattgaacgtgagggtaaagatgttaccattactacatactccaagatggttggctatgctctccaggctgcagagatactgtccaaggaaggaatcagtgctgaggtgatcaaccttcgatccatcagaccacttgacagagctgctatcaatgcatctgttaggaagaccaaccgattggtgactgttgaagaagggttcccccagcatgggattggtgctgagatatgcatgtctgttgtagaagaaagctttgagtaccttgacgcgccagttgagaggatcgctggagctgatgtaccaatgccctatgctgccaaccttgagagaatggctgttccacaggtagatgacattgtccgggcagcgaagcgggcctgctacagggcagtgccaatggcagcaactgcctgatcggtggacaagcccttttgtttcccttgctttcacactctatagccagaagaaacatgtagtattcataaggtgctggcaaattgcccagactccaagcgagctaattttgtagatctgccatggcgtgctctattccgttagtcgcagatggatgattgcattcttttctggtttcaagccccagcccttttctacgattttatacacgcggcctcatcatgttggcatgcaaacgggtcactttgttgtgacccgtcagttccgtggcatcgcatcttttgctgcttggaccacaaggtcagtctggcaataaaactactcgccacgattgtcagtctatggcaataaaactactcgccacgatcgtgcatgcttaatttattgtttacccgcctgatattcacagcaggggacatcgcatcttcgagtaaatgagtattccatgtaaatgtattaccaaggccctgtatttgatggtaatggtagaacctttttctgatttcgttccggatagaactgaaacggt

SEQ ID NO: 3971 - DNA, 1558 bp, Panicum virgatum
ctcttcctcccttcttcctccctgccattctcccgttccgttgcggcgtctcttccctccccaccccccgcctccaccgccgcctccgtgcctagcacccgctcgaatttccgcatccgctgccgcgcccgatcgccgaggacgaggatgctgggcgccgcgaggaggcagcttggatccggtcccatgctggtgcaggtcctgcggcggctccgcccggcggcggcgaccgaggcggcgagggggtactccgccgcggcgaaggagatgactgtccgtgatgcattgaactctgcactggatgaagagatgtctgctgatccttctgtcttcctgatgggagaagaggttggagagtatcaaggtgcatacaagatttctaaaggcttgcttgacaagtatggtcctgatagggttcttgacacgcctatcacagaggctggctttactggcattggtgttggtgcagcttatcaaggtcttcggcctattgtagaatttatgacatttaatttctcgatgcaggctattgatcatatcatcaattcagctgccaagtcaaactacatgtcagctggtcaaatctctgttcctattgtttttagaggacctaatggagctgctgctggagttggggcacaacactcacagtgttatgcagcttggtatgctcatgttccaggacttaaggttctgacaccatactctgcagaagatgctagaggcttgctaaaagccgctattagggatcctgaccctgttattttcctggaaaatgaattgctttatggagaatcattccctgtttctgctgaagtgcttgattctagtttctgcctgccaataggcaaagctaaggtagaacgtgagggtaaagatgttaccattaccacatactccaagatggttggttatgctctccaggctgcagagatactgtccaaggaaggaatcagtgctgaggtgatcaaccttcgatcaatcagaccacttgacagagctgctatcaatgcatctgtcaggaagaccaacagattggtgactgttgaagaagggttcccccagcatgggattggtgctgagatatgcatgtctgtcgtagaagaaagctttgagtaccttgatgcaccagttgagaggatcgctggagctgatgtacctatgccctatgctgctaaccttgagagaatggctgttccacaggtagatgacattgtgcgggcagcaaagcgggcctgctacagggcagtgccaatggcagcaacggcctgaacctgatcggtggacaagcctttttgtttcccttggctttcaccttctagccagaaacatgtagtattcatagtatttcataaggtggtggcaaattgcccagaccccagagactccaagcgagctaattttgtagatctgccatggcgtgctttattccgttagtcgcagatggatggatgattgcattctttctggttccgaacccccttttctatgatttgtatacaacctaatcatgttggcatgcaaacggatcactttgttgtgacgcttcatttctgtc

SEQ ID NO: 3972 - DNA, 1457 bp, Setaria italica
ccgccgccgcggctccagcgaggacctactccgccgccgccaaggagataactgtgcgggaagcattgaattctgcgctagatgaagaaatgtctgcagatccttctgttttcttgatgggagaagaggttggggagtaccaaggtgcatacaagatatccaagggtttgcttgacaaatatggccctgatagggttctcgatacaccaatcactgaggctggctttactggtattggtgttggtgctgcctaccatggtcttcgacctatagtagagttcatgacatttaacttttcaatgcaggcaattgatcacatcattaattcagctgccaagtcgaactacatgtcagctggtcagatatctgttcctattgtcttcagagggccaaatggtgctgctgctggagttggtgctcaacactcgcagtgctatgcagcatggtatgctcatgttccaggattgaaggtcctaactccctattctgcagaagatgctcgaggtttgctgaaagcagcaatcagggatccagatcctgttgttttcctggaaaatgaacttctatatggtgaatcatttcctgtttctgatgaggtactcgattctagcttctgccttccaatcggcaaggctaagatagagagacaaggaaaagatgttacaatcactgcattctctaagatggtcggatatgctcttcaggctgcagatatactggccaaggagggtatcagtgctgaggtaatcaatcttcgttcaattagaccgctggatagagccactattaatgcatctgtgaggaaaaccaatagattggtaacagtagaagaaggcttcccacaacacgggattggcgctgaaatatgcatgtctgttgtggaggacagctttgagtatcttgatgcgccagttgagaggattgctggagctgatgtgcccatgccctacgctgccaacctagagaggatggctgttccacaggttgatgacattgtccgagcagcgaagagggcttgctacagggtggtaccaatggcggcaacagcctgattcaccccgttcctcaaccctccattccgttgtctatgtccagaaagatgtgtggcataatggtacgagtagagtactccctaccgctccaattcaagtagcgtgagctgattttgtagagcaaccatgaggtgtccagttccgttaactccgcccgcggcagccggatggctggcctgactctgcgtcattctattacggttcaactcgggggttcgcgaatcatgcaggatttacatgagggggtgatggtgtcatcaataacatgtatttgaaaggagctctaagaggtcctcggatatagaatttctggttgcgcacttgttctgttttttaatctatgtttccatgatattgtcctgccttgccacacgctatgaaatgttatccgagagtggaaggcgg

SEQ ID NO: 3973 - DNA, 1725 bp, Sorghum bicolor
agacaaatccacgctttccttcgcctcctcctcctccatcgcggtcgcggccaaggccaacgaaccaatcccccctacggcccacaccttcctcctccccgcgtgccatcctcccatcccggcagggcgtctcctcctccctcctttccatcccgcctctatcgccgcctccatctccaggccgcgtcgaatttctccatccaccgcctccatctccaggaggaggatgctgggcgccgcgaggaggcagcttggatccggtcccatgctgggacaggttttgcgaaggctccgcccagcggcggcggcggctgaggtggcgaggggctactccgccgcggcgaaggagatgaatgtccgtgatgcgttgaactctgcactggatgaagagatgtctgctgatccttcagtttttctgatgggagaagaggttggagagtatcaaggtgcatacaagatttctaagggcttgcttgacaaatatggtcctgatagggttcttgacacacctatcacagaggctggctttactggcattggtgttggtgcagcttatcatggtcttcggcctattatagaatttatgacatttaatttctcgatgcaggctattgatcatatcatcaattcagctgccaagtcaaactatatgtcagctggtcagatatctgttcctattgtttttagaggaccaaacggagctgctgctggagttggtgctcaacactcacagtgttatgcagcttggtatgcacatgtaccaggacttaaggttctcacaccatactcttcagaagatgcccgaggcttgctcaaagctgctattagggatcctgatcctgttatttttctggaaaatgaattgctttatggagaatctttcccagtttctgctgaagtgcttgattctagtttttgcctaccgattgggaaagctaagatagaacgtgaaggtaaagatgttaccattactacctactccaagatggttggctatgctctccaggctgcagagatactgtccaaggaaggaatcagtgctgaggtgatcaaccttcgatcgattagaccacttgacagggctgctattaatgcatctgtcaggaaaaccaaccgattggtgactgttgaagaagggttcccccaacatgggattggtgccgagatatgcatgtctgttgtagaagaaagcttcgagtaccttgatgcaccagttgagaggattgctggagctgatgtacctatgccttatgctgccaaccttgagagaatggctgttccacaggtcgatgacattgtgcgggccgcaaagcgggcctgctacagggcagtaccaatggcagcagctgcctgattggtggacaagcctttctgttttccttccctcggctttcgctctctagccagagacatgtagtattcataaggtgcaggcaaattggccggaccccagactccaagcgagctaattttgtagatctgccatggtgtgctttattccgttagtcgatatttgctgcattctttctagtatcgagtccatttgcttttctatgacttctacacacggccaaataatcttgctaaggtcctgattgaatgcagagtattttttggagtttaggaatggttttgtgaaatactttggttttggagtaacatgaagtgtttggatgcaacacactttaggctttgtttggatgtagtcggatccacatgtgttgg

SEQ ID NO: 3974 - DNA, 2089 bp, Zea mays
ctccaacggtgttggaccgcgggccgcggcccgcctagtaggccaacgtcgtgcgcatgctctcagtaaaatcacaccacgcgggggctttacctgcaaaaagcgcgcaaataaaaatctcacgcaggagacaaatccagtaatccacactttccttcgcctcctccatcgtggtcgcggccaaggccaacgaaccaattcctctaccattcctcctccctcctttcctgccattctcccatcccggcagggcgtctcctcctcctccctccctcctttccatcccgtttcttcgccgcctccatctccaggccgcgtcgaattcttccatccaccgcaccggtcgacgacgacgacgaggatgctgggcgcagcgaggaggcagcttggatccggtcccatgctgggacaggttttgcgaagactccgaccagcggtggcggctgaggtggcgaggggctactccgccgcggcgaaggagatgactgtccgtgatgcattgaactctgcattggatgaagagatgtctgctgatccttccgtttttctgatgggagaagaggttggagagtaccaaggtgcatacaagatttctaagggcttgcttgataggtatggtcctgatagggttcttgacacgcctatcacagaggctggttttactggcattggtgttggtgcagcttatcatggtcttcggcctattatagagtttatgacatttaatttctcgatgcaggctattgatcatatcatcaattcagctgccaagtcaaattatatgtcagctggtcagatatctgttcctattgtttttagaggaccaaacggagctgctgctggagttggtgctcaacactcacagtgttatgcagcttggtttgcacatgttccaggacttaaggttctcacaccatactcttcagaagatgcccgaggcttgctcaaagctgctatcagggaccctgatcctgttattttcctggaaaatgaattgctttatggagaatctttcccagtttctgctgaagtgcttgattctagtttttgcctaccgattggcaaagctaagatagaacgtgagggtaaagatgttaccattactgcgttctccaagatggttggctatgctctccaggctgcagagatactgtccaaggaaggaatcagtgctgaggtgatcaaccttcgatcaatcagaccacttgatagagctgctattaatgcatctgtcaggaaaaccaaccgattggtgactgttgaagaagggttcccccaacatgggattggtgccgagatatgcatgtctgttgtagaagaaagcttcgcgtaccttgatgcaccagttgagaggattgctggagctgatgtacctatgccctatgctgccaaccttgagagaatggctgttccgcaggtcgatgacattgtgcgggcggcaaagcgggcctgctacagggcagtaccaatggcagcagctgcctgattggtggacaagcctttctgttttccttccatcggttttcgctctctagccagaaacatgtagtattcataaggcgcaggcaaattggccggaacccagactccaagcgagctaattttgtagatctgccatggtgtgctttgtcccgttagtcgatatatgtggcgttatttctagattcaagtccatttgcttctctatgatttttgtacaccgctaaataatcttcttaagcccctgaatgaatgcaaaatatttaagatgttttaggaaaatactatggttttgtgaaataccttggtttaggagtaacatgaaggcgctcaaagtgaaatcactaagctaatagatgacttgataattttaaacttcttgacacataataaaccttagagaacaaatgcgtaaaaatggaccaaggccgatttaaaataagattttgttgtttgctgatcaatatgaccatttagagatattatttgccagtaattttttttctatagtttaaaggcacaagtgaacttcgactaagataaagggatgattcggatggttaatacctcaaccaagacatcataagacatgtgaagaccaactagtaca

SEQ ID NO: 3975 - DNA, 1610 bp, Oryza sativa
gctttccttctcccctcccaccaactaatcgatctcctctctctctctctctctccctctctatcccattcgcgaggcggcgtctcctcctcctccccgtctctctcgcttcccccccaaatccggcggcgaatccagggccccgcgccgcgccgacgaccaccgccgatcgcgaccaggagggaggatgctgggcgccgcgaggaggcagctcggatccggccccatgctggggcaggtgctgcggaggctccggccggcgacggcggctgcagcggatgcggcgagggcgtactccgcggcggcgaaggagatgactgtccgtgaagcgctgaactctgcactcgatgaagaaatgtctgctgatccttctgtttttctgatgggtgaagaggtgggagagtatcaaggtgcatacaagatttcaaagggcttgcttgacaagtatggtcctgagagggttctggatacaccaatcacagaggctgggtttactggcattgctgttggtgcagcgtatcaaggtcttcgacctgttgtagagttcatgacattcaatttctcaatgcaggcaattgatcatatcatcaattcagctgccaagtcaaactacatgtcagcgggtcagatatctgtccctattgttttcagaggacctaatggagctgctgctggagttggcgctcaacactcgcagtgttatgcggcttggtatgcacatgttccgggtcttaaggttctggttccatattctgcagaagatgctcgtggcttgctcaaagctgcgattagggatccggaccctgttgttttcttggaaaatgaactgctctatggagaatcattccctatttctgctgaagtgcttgattctagtttcgctctgccaattggcaaagcaaagatagagcgtgagggtaaagatgttacaattactgcatactccaagatggttggatatgctcttcaggccgcagatatattgtccaaagaaggaatcagtgctgaggtgataaaccttcgttcaattagaccacttgatagagctactatcaatgcatctgttagaaaaacaaatagattggtgaccattgaggaaagcttcccacagcatgggattggtgctgagatatgcatgtctgttgttgaggaaagctttgaatatcttgatgcaccagttgagagaattgctggagctgatgtacccatgccctatgctgccaatcttgagaggatggctgtcccacaggttgacgatattgtccgtgcagcgaagcgtgcgtgctacagagcggtgcccatggcagcaactgcctgataggagagacctcttttacatcatctttcttttcccgtccggccaacatatgattcataatggtgtccaacaattgcccaaactcaaagcgagctaattttgcaagatatttccatgacccccacctattcttttagctgcagttgcatcactgcgttcgttggtggtgacccaaatttccctctttttttttggtgtgtatgcgagaattatgcagcttatggtgattggttcacagtacacactggcgctagttacataaatgaaagaaaaatctgagctcttgatggac

SEQ ID NO: 3976 - DNA, 1650 bp, Hordeum vulgare
aaaacacaaaggcgataaacgcagccaagcaagtcggcgcgacaatttcggcggcgtcctctccatccatctcctcctcaccctcccccgccgcctcaacacggcgccatcctcatcacgaacccaccaaacaaacaaaaggcggacccaaccccctcctcccccgccttccccggagcacgaacctcccctcccaatcccatccccgtcggtagccgatcgcgtcgacgatgctgggcgccgcgaggagatccggatgcgtgctggggcagctgatgcagaccctccgcccggcggccacggcggcgaggagctactccgcgaccccgaaggagatgactgtacgtgaagcattgaattccgcccttgacgaggagatgtctgccgacccttctgttttcttaatgggagaagaggttggagagtatcaaggtgcgtacaagataacaaagggtttgctagacaagtatggtcccgatagggttctcgatacaccaatcacagaggctggttttactggcattggcgttggtgctgcctaccaaggtcttagacctgtagtagagttcatgacatttaacttctcgatgcaggcaattgatcacatcatcaattcagctgccaaatcaaactacatgtcagctggtcagatatcggttcctattgtttttcgaggaccaaatggggcagctgctggagttggtgctcaacactcgcagtgctatgcagcatggtatgcccatgttccaggattgaaggtcctaactccttattctgcagaagatgctcgaggcttgctaaaagcagcaatcagggatccagaccctgttgttttcctggaaaatgaactactttatggtgaatcgtttcctattaaggctgaagtacttgattctagcttcagtgtcccaattggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccattggatagagctgctatcaatgcatccgttaggaaaaccaatagattggtaaccgttgaagaaggctttccacaacatggtgttggtgctgaaatatgcatgtccgttgtggaggacagctttgagtatcttgacgcaccagttgagaggattgccggagctgatgtacctatgccctatgcggcaaaccttgaaagattggcagttccccaggttgaggacattgtccgcgcagcaaagcgagcttgctacagatcatcatcaatggcggcaaccgcctaagcacaaatgcatgttttgtttctcggccttcttctttgttccttgtccagaaaagatgtaccgaatcgcataattgtatcctccaactcgtgtgagctaattttgtagatctgcatgctgcattgttgattccgatctgtcggcggcagtcggatggctgcatccagttgatggttcatccctagacatttgaatcatgcaacttctggaggtttacatttgagggatgtctcaataacatgtatgtaactgaattacaggcgttcacacctataataaaatatataaaaaaaactcgaaggtacgcccc

SEQ ID NO: 3977 - DNA, 1580 bp, Hordeum vulgare
taaacgcagccaagcaagtcggcgcgacaatttcggcggcgtcctctccatccatctcctcctcaccctcccccgccgcctcaacacggcgccatcctcatcacgaacccaccaaacaaacaaaaggcggacccaaccccctcctcccccgccttccccggagcacgaacctcccctcccaatcccatccccgtcggtagccgatcgcgtcgacgatgctgggcgccgcgaggagatccggatgcgtgctggggcagctgatgcagaccctccgcccggcggccacggcggcgaggagctactccgcgaccccgaaggagatgactgtacgtgaagcattgaattccgcccttgacgaggagatgtctgccgacccttctgttttcttaatgggagaagaggttggagagtatcaaggtgcgtacaagataacaaagggtttgctagacaagtatggtcccgatagggttctcgatacaccaatcacagaggctggttttactggcattggcgttggtgctgcctaccaaggtcttagacctgtagtagagttcatgacatttaacttctcgatgcaggcaattgatcacatcatcaattcagctgccaaatcaaactacatgtcagctggtcagatatcggttcctattgtttttcgaggaccaaatggggcagctgctggagttggtgctcaacactcgcagtgctatgcagcatggtatgcccatgttccaggattgaaggtcctaactccttattctgcagaagatgctcgaggcttgctaaaagcagcaatcagggatccagaccctgttgttttcctggaaaatgaactactttatggtgaatcgtttcctattaaggctgaagtacttgattctagcttcagtgtcccaattggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccattggatagagctgctatcaatgcatccgttaggaaaaccaatagattggtaaccgttgaagaaggctttccacaacatggtgttggtgctgaaatatgcatgtccgttgtggaggacagctttgagtatcttgacgcaccagttgagaggattgccggagctgatgtacctatgccctatgcggcaaaccttgaaagattggcagttccccaggttgaggacattgtccgcgcagcaaagcgagcttgctacagatcatcatcaatggcggcaaccgcctaagcacaaatgcatgttttgtttctcggccttcttctttgttccttgtccagaaaagatgtaccgaatcgcataattgtatcctccaactcgtgtgagctaattttgtagatctgcatgctgcattgttgattccgatctgtcggcggcagtcggatggctgcatccagttgatggttcatccctagacatttgaatcatgcaacttctggaggtttacatttgagggatgtctcaataacatgtatgtaactgaat

SEQ ID NO: 3978 - DNA, 1514 bp, Brachypodium distachyon
gctctcttcctcctccacctactaacgcatccctcctcctccccatctccaattccacctttccgaggcggcgtctgcacaaccatcgaatccattccttctgcccgctgctctgatcgcgaagggggaagatgctgggcgcagcgaggaggcagctcggatccgggcccatgctggggcaggtgctgcggaggctccgcccggcgtccgcggacgcggcgagggggtacgccgccgcggggaaggagatcaccgttcgtgaagcgttgaacactgcactagacgaagaaatgtccgctgatccttcggtctttttgatgggcgaagaggttggagaatatcaaggtgcatacaagattacaaagggcttgcttgacaagtatggtcctgatagggtgctcgatactccaattacggaggctggttttactggcattggtgttggtgcagcctatcagggtcttcggccagtcatagagttcatgacatttaatttctcaatgcaggcaatcgatcatatcatcaactcagctgccaagtcaaactacatgtcagctggtcagataaatgttcctattgttttcagaggaccaaatggagctgctgctggagttggtgctcaacattcacagtgctatgcagcttggtatgctcatgttccagggcttaaggttctggcgccatattctgcagaagatgctcgaggcttgctaaaagctgcaataagggatcctgatcctgttgtttttctggaaaatgaattgctgtatggagaatcattccctgtttctgatgaagtgcttgattctagtttctctctgccgattggcaaagctaagatagaacgcaagggaaaagatgttaccattactgcattctccaagatggtcggttatgctctacaggctgcagatatattgtccaaggaaggaatcagcgctgaggtgatcaaccttcgatcaattagaccactggacagagctgccataaatgcatctgttaggaagacaaatagattggtgactcttgaagaaggcttcccccagcatggtgttggtgctgagatatgcatgtctgttgtcgaagaaagctttgagtatcttgatgcaccagttgagaggattgctggagctgatgtacccatgccctatgctgccaaccttgagagattggctgttccacaggtggaggatatcgtacgtgcagcgaggcgggcttgctacagagcggtgccattggcggcaactgcctgatcaattttccttttactttctcttttgcttttaccacttggccaggaaagagaaactgtgttccataatggtatccacaattgcccaaactcaaagcgagctgatttttgtagatgtaagcattcgtttgtgcctgtccattttatttttgttgtgaattatgcagcttacgttgattgatttgcacggccaaatcatgctggctatataaatggaaaactgaggttctcgatcagttcgctaatggtaacgactaatgat

SEQ ID NO: 3979 - DNA, 1599 bp, Brachypodium distachyon
aattgcggcggcgtcttctccatctctcctcatctccatcctccacatctccctcccgccgtctctcaaaggcgacgcgcaaccccgccccaccatcgaagccgagcccaaccaatcgccccccttccagcccctcctcagtcgacgacgatgctgggcgccgccaggagatccggatgcgtgctggggcagctgattcagacgctccgccccgcggcggcggcggcggggccggcggcgaggagctactccgctgccgcgaaggagatgactgtgcgtgaagcgttgaattccgcccttgacgaggagatgtctgcagatccttctgttttcctgatgggagaagaggtcggagagtaccaaggtgcatacaagataacgaagggtttgttagacaagtatggccctgatagggttctagatacaccaatcacagaggctggttttactggcattggtgttggtgccgcctaccaaggtcttcgtcctgtaatagagttcatgacgtttaacttttcgatgcaggcaattgatcacatcatcaattcagctgcaaagtcgaactacatgtcagctggtcagatatctgttcctattgttttcagaggaccaaacggtgctgctgctggagttggtgcgcaacactcacagtgctatgcagcttggtatgcacatgttccaggattgaaagtcctaactccttattcggcggaagatgctcgaggcttgctaaaagcagcgatcagggatccagaccctgttgttttcctggaaaatgaacttctttatggcgaatcatttcctattaaagatgaagtacttgattctagttttagtgtcccaatcggcaaggctaagatagaacgggaaggaaaagatgttacgattaccgcgttctccaagatggttggatatgctcttcaggctgcagagatactgtccaaggagggaatcagtgctgaggtgattaatcttcggtcaattcgaccattggatagagctgctattaatgcatctgttaggaaaaccaatagattggtgaccgtggaagaaggcttcccacagcatggggttggtgctgaaatatgcatgtctgttgtggaggacagctttgagtatcttgatgcaccagttgagaggattgcgggagctgatgtgccgatgccctatgctgcaaacctcgaaaggctggcggttccacaggtggaggacattgtccgtgcagcaaaacgagcttgctacagagcagggacgatggcagcaaccgcataaactcaaatgccccttccgtttctcagcctcctcttttttgttccgtccagataaaaaaaatgtatcatgtcgcataacggtatcctcccaacacagcgtgagctaatttttgtagatccgccatgatttgtctattcctatcgacctttcggtctctgcaggatgtccgcacccggttcatctttcatcctgggacatttgaatcgttccacttctggagatttacatgacggaggaggtagtgttgcaaataacatgtaaatgtaatttgaactcgagaagttcaggtatcggtatttacaattttgctgcgtgcgtcttatcgcc

SEQ ID NO: 3980 - DNA, 1510 bp, Triticum aestivum
ctctccatccatctccctcaccctcccgcgccgcctcaacacggcgccatcctcatcacgaacccaccaaacaaacaaaaggcggacccaactccccctcctccaccttccccggagcacaaatctcccctcccaatccccacccccgtcggtagccaatcgcgtcgacgatgctgggcgccgcgaggagatccggatgcgtgctggggcaactgatgcagaccctccgcccggcggcaacggcggcgaggagctactccgcgaccccgaaggagatgactgtgcgtgaagcattgaattccgctcttgacgaggagatgtctgccgacccttctgttttcttaatgggagaagaggttggagagtaccaaggtgcgtacaagataacaaagggtttgctggacaagtatggtcccgacagggttctcgatacaccaatcacagaggctggttttactggcattggcgttggtgctgcctaccaaggtcttagacctgtagtagagttcatgacatttaacttctcgatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgcccatgttccaggattgaaggtcctaactccctattctgcagaagatgctcgaggcttgctaaaagcagcaatcagggatccagaccctgttgttttcctggaaaatgaactactctatggtgaatcgtttcctattaaggctgaagtacttgattctagcttcagtgtcccaattggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccattggatagagctgctatcaatgcatccgttaggaaaaccaacagattggttaccgttgaagaaggctttccacaacatggtgttggtgctgaaatatgcatgtccgtagtggaggacagctttgagtatcttgatgcaccagttgagaggattgccggagctgatgtaccgatgccctatgcggcaaaccttgaaagattggcagttccacaggttgaggacatcgtccgtgcagcaaagcgagcttgctacagatcatcatccatggcggcaaacgcctaaagcacaaatgcaagttttgtttctcggccttcttcttccttccttgtccagaaaagatgtaccgaatcgcataattgtatcccccaactcgtgtgagctaattttgtagatctgcatgcattgttgattcctatctgtcggcggcagtcggatgactgcatttagttcatggttcatccctatacatttgaatcatgcaacctctggaggtttacatcactgagggatgt

SEQ ID NO: 3981 - DNA, 1613 bp, Triticum aestivum
catccatctccctcaccctcccgcgccgcctcaacacggcgccatcctcatcacgaacccaccaaacaaacaaaaggcggacccaactccccctcctccaccttccccggagcacaaatctcccctcccaatccccacccccgtcggtagccaatcgcgtcgacgatgctgggcgccgcgaggagatccggatgcgtgctggggcaactgatgcagaccctccgcccggcggcaacggcggcgaggagctactccgcgaccccgaaggagatgactgtgcgtgaagcattgaattccgctcttgacgaggagatgtctgccgacccttctgttttcttaatgggagaagaggttggagagtaccaaggtgcgtacaagataacaaagggtttgctggacaagtatggtcccgacagggttctcgatacaccaatcacagaggctggttttactggcattggcgttggtgctgcctaccaaggtcttagacctgtagtagagttcatgacatttaacttctcgatgcaggcaattgatcacatcatcaattcagctgccaaatcaaactacatgtcagctggtcagatatccgttcctattgtttttcgaggaccaaatggggcagctgctggagttggtgctcaacactcgcagtgctatgcagcatggtatgcccatgttccaggattgaaggtcctaactccctattctgcagaagatgctcgaggcttgctaaaagcagcaatcagggatccagaccctgttgttttcctggaaaatgaactactctatggtgaatcgtttcctattaaggctgaagtacttgattctagcttcagtgtcccaattggcaaagctaagatagaacgggaaggaaaagatgttacaattactgcattctctaagatggttgggtatgctcttcaggctgcagagatactgtccaaggagggaatcagtgctgaggtgatcaaccttcggtcaattagaccattggatagagctgctatcaatgcatccgttaggaaaaccaacagattggttaccgttgaagaaggctttccacaacatggtgttggtgctgaaatatgcatgtccgtagtggaggacagctttgagtatcttgatgcaccagttgagaggattgccggagctgatgtaccgatgccctatgcggcaaaccttgaaagattggcagttccacaggttgaggacatcgtccgtgcagcaaagcgagcttgctacagatcatcatccatggcggcaaacgcctaaagcacaaatgcaagttttgtttctcggccttcttctttgttccttgtccagaaaagatgtaccgaatcgcataattgtatcccccaactcgtgtgagctaattttgtagatctgcatgcattgttgattccaatctgtcggcggcagtcggatgactgcattcagttcatggttcatcccgaggcgtttgaatcgtgcaacttctggaggtttacatcactgagggatgtctcaataacatgtatgtaactgaattacagacgttcacatgattttgctgtggcttaggccgatctgtaagtgtgatcaatatcgcggagaaaactggaacattgaaa

SEQ ID NO: 3982 - DNA, 1455 bp, Musa acuminata
gggccaccaaaccgagtcgtcttcctctcccttctctccgatctttcctttggccgttctcgatttcgaggaagatgttgggactcgcgaggcggaagctcggattcggacttttgtctgcaacgagggttctgcctgctggatctgttttgcccaagaagtactcgaccgcagcgaaagagatcacagtgcgtgaagcacttaacactgcacttgatgaggagatgtcagcagatcccaaagttttcttgatgggtgaagaggttggagagtaccagggtgcctataagatatctaagggtcttcttgagaagtatggtcctgatagagttcttgatactccaatcacagaggctggattcacagggattggtgttggcgcagcttattatggtcttcggcctgtcgtggagtttatgacgtttaacttctctatgcaggcaattgatcatatcatcaattctgctgcaaaatccaactacatgtcagcgggtcagatatctgtccctatcgtatttagaggaccaaatggtgctgcagctggagttggtgctcaacattcacagtgctatgcagcatggtatgcacatgttcctggtttgaaagtgctaagtccatattcatctgaagatgctcgtggcttgctaaaggctgctattagagatcccgatccagttgtttttcttgaaaatgaacttctatatggagaatcatttcctgtttcagctgaagtacttgattccagtttctgccttccaatagggaaagctaagattgaacgagaagggaagcatgtaacagtcactgcattctcaaagatggttgggtatgctctgcaggctgcggaaatactttcaaaggaaggaatcagtgccgaggttataaatctccgttcaattagaccactcgacagagctactatcaatgcttctgtcaggaaaactaacagattggtcactgttgaagaaggttttcctcaacatggcgtaggtgctgaaatatgcatgtctgttatggaggaaagcttcgagtatcttgatgcaccagtggagaggattgctggagctgatgttccgatgccatatgctgcaaatcttgagaggatggccgtgccacaggtagacgacatagtacgtgctgcaaagcgtgcatgctatcgatcagtctccatggctgcagcagcttagtttggaagttttgcttttgatgtcacctttttgccttttgtctttccagttgggggagttaaatcatgaatgttgtgtgtcctttggttatctcctgtatacatctgacttggcataaaattgatgctattggcctttttatatttcatttcagtacttgactggaagtctaaagctactgaaattcttacatatatctgtagcgaaacattgctgagtactgtttaataatgtacaaggcccagaatactctccaagttttcttgat

SEQ ID NO: 3983 - DNA, 1570 bp, Avena sativa
tcccgttctcgaggcggcgtctgcgtctcctcccccaccggccccatctcatccctctcgctgcctctgatccggcgacacatacccgtgcccgccgctccgatcgcgaggaggagcgaagatgctgggcgcggcgaggaggcagctcggatccgggcccatgctggggcaggtgctgcggaggctccgcccggcggcggcggcgtccacggaggcgacgcgggggtactccgccggggcgaaggagatcactgtccgtgatgcgttgaactctgcactagatgaagaaatgtctgctgatccttctgtctttctgatgggtgaagaggttggagaatatcaaggtgcatacaagatcacaaagggcttgcttgacaagtatggtcctgatagggttcttgatacaccaattacagaggctggttttacgggcattggtgttggtgcggcctatcaaggtcttcggccggtcatagagttcatgacatttaatttctcaatgcaggcaatcgatcatatcatcaactcagctgccaagtcaaactacatgtcagctggtcagatcaatgttcctattgttttcagaggaccaaatggagccgctgctggagttggtgctcagcactcacagtgttatgcagcttggtttgcacatgttccaggacttaaggttctggctccatattcctcagaagatgctcgaggcttgctaaaggctgcaattcgggatcccgatcctgttgtttttctggaaaatgaattactctacggagaatctttccctgtttctgatgaagtgcttgattctagttttgctctgccaattggcaaagctaagattgaacgtgaaggtaaagatgttacaattactgcattctccaagatggtcggttatgctcttcaggctgctgagatactgtccaaggaaggaattagtgctgaggtgatcaaccttcgatcaattagaccactggatagggctgccataaatgcatctgttaggaaaacaaatagattggtgactcttgaagaaggcttcccccagcatggtgttggtgctgaaatatgcatgtctgttgtagaagaaagtttcgaatatcttgatgctccggtggagaggattgctggagccgatgtacccatgccctatgctgccaacctggagagattggctgttccacagattgaggatatcgtccgtgcagcgaggcgagcttgctacagagcggtacccatggcggcaactgcctgatcaagattcttcattttactttctcctcgattttcccgtcccctggccaagaaaacgcgtgttccataatggtatccacaattacccaaactcgaagctagtcaaatctttgtagatgtgccatggcatcttattcttttagctgcagacctgcagttggatcactgcattcgttgatgccccccaactttgttcttgttgtgaaattatatgcagcttacaatgattgattagtctcttgattgagtcacatggcctaatcatgctggtcacacaaatggaaatgtgagtttctggtgcaaaaaaaaaaaaaaaaaa

SEQ ID NO: 3984 - DNA, 1553 bp, Festuca arundinacea
  misc_feature (159)..(159): n is a, c, g, or t
  misc_feature (202)..(202): n is a, c, g, or t
  misc_feature (589)..(589): n is a, c, g, or t
  misc_feature (628)..(628): n is a, c, g, or t
  misc_feature (655)..(655): n is a, c, g, or t
ggcacgaggctcatcaccaaccccaccaaacaaacaaaagccgaacccggctcccccctcctcctccaccttcccaggagcccccaatctcctctcctcccaatcccccaccccccgccggtagccgatcgcgtcgacgatgctgggcgccgcgagganatccggatgcgtgctcgggcggctggcgcaggcccttcgcccngcggcggcgacgaccggagcggcgaggacctactcgtcggccgccaaggagatgaatgtgcgtgaagcattgaactctgccctagatgaggagatggctgcggacccttccgttttcttgatgggagaagaggttggagagtaccaaggtgcatacaagataacaaagggtttgttagacaagtatggccctgacagggttcttgatacaccaatcacagaggctggttttactggcattggtgttggtgctgcctaccaaggtcttcgacctgtagtagagttcatgacatttaacttctcgatgcaggcaattgatcacattatcaattcagctgccaagtcgaactacatgtcagctggtcagataaatgttcctattgttttnagaggaccaaatggtgctgctgctggagttggtgctcancactcacagtgctatgcagcttggtantcacatgttcccggactgaaggtcctaactccttattccgcagaagacgctcgaggcttgctaaaagcagcaatcagagatccagaccctgttgttttcctggaaaatgaactgctttatggtgattcgttccctatttctgctgaagtacttgattctagcttcactgtcccaatcggcaaggctaagatagaacgagaaggaaaagatattacaattactgcattctccaagatggttgggtacgcgcttcaggctgcagagatactgtccaaggagggaatcagtgctgaggtaatcaatcttcggtcaattagaccattggatagagctgctattaatgcatctgttaggaaaaccaatagattggtaacagtagaagaaggcttcccacaacatggggttggtgctgaaatatgcatgtctgttgtggaggacagttttgagtatcttgatgcaccagttgagaggattgcaggagctgatgtgcccacaccctatgctgcgaacctagaaaggttggcgtttccacaggttgaggacattgtccgtgcagcaaagcgggcttgctacagatcaacgtcgatggcagcaactgcctaaattcaaatgaaacttctgtttctcagccttctcttttcttctatgtccagaaaatatgtaccgcgtcgcataatgggttatcttcccaactatcgtgagctaattttgtagatctgttgtgaactgtcgattccgatgttcccatttcagctggagggatgcatacagtcatggttcacacccgggaaaacttgaattatgcaacctgtggagattttacatgactgacgaatatgccaataacatgtactacctcttttcatgttttaatcgacgtgaggtacatacattcgta

SEQ ID NO: 3985 - DNA, 1569 bp, Avena sativa
cccccctccacccgccgtctcaacacgaggcctggccatcctcatcacgaacccaccaacaaaccaaggcgaatccgcctcccccctcctccaccttcccaggagcccgaatctcccctcccctcccccaccccccgtcggtagccgatcgcgtcgacgatgctgggcgccgcgaggagatccggatgcgtgctcggccagctgatgcagaccctccgcccggcggcggctggcgcggcgaggagctattcatcggccgcgaaggagatgaatgtgcgtgaagcattgaattctgcccttgatgaggagatggctgcggacccttccgtgttcttgatgggagaagaggttggagaataccaaggtgcatacaagataacgaagggtttgttagacaagtatggccctgacagggttcttgatacaccaatcacagaggctggttttactggcattggtgttggtgctgcctaccaaggtcttcgacctgtagtagagttcatgacattcaacttctcgatgcaggcaattgatcacattatcaactcagctgccaagtcgaactacatgtcagctggtcagatgtctgttcctattgttttcagaggaccaaatggtgctgctgctggagttggtgctcaacactcacagtgctttgcagcttggtatgcacatgttccaggcctgaaggtcctaactccttattccgcagaagacgctcgaggcttgctaaaagcagcaatcagggatccagaccctgttgttttcctggaaaatgaattgctttatggtgaatcgtttcctatttctgctgaagtactcgattctagcttcaccgtcccaattggcaaggctaagatagaacgagaaggaaaagatgttacaattactgcatactccaagatggttgggtttgctcttcaggctgcagagatactgtccaaggagggaatcagtgctgaggtaatcaatcttcggtcaattagaccattggatagagctgctattaacgcatctgttaggaaaaccaatagattggttaccgttgaagaaggcttcccacaacatggggttggtgctgaaatatgcatgtctgttgtggaggagagttttgagtatcttgatgcaccagttgagaggattgcaggagctgatgtgcccacgccatatgctgcaaacctggaaaggttggcgtttccacaggttgaagacattgtccgtgcagcaaagcgagcttgctacagagcaacgtcaatgtccgcaaccgcctaaattcgaacggatcttttgtttctcgtccttctcttttctcctatgtccagaaaacatgtaccgcatctcataatgggttattatcctccctgactcagcgtgagctaattttgtagtagatccgttgtgaactgtcgattccgatgttcccatttcatcttcagggatgcatacggtcatggttcacacccgggaaaacttgaattgtgcaactcgtggagattttacatgaccgagggttatggcaataacatgcatgtaattgaactccagaaattaaggtgtcatttcattaca

SEQ ID NO: 3986 - DNA, 1552 bp, Hordeum vulgare
acctactacgccctccaattccaccgttccgaggcggcgtctgcgtctcctcccccacgccccgtccatctcgctgcctccagcccggtgacacatccgccgccgcgccaccgtcgaattcgcctcctctgcccgccgctacgatcgcggggacgaagatgctgggcgccgcgaggaggcagctcggatccggccatatgctggcgcaggtgctgcggaggctccgcccgacggcggcggcgtccacggaggcggcaagggggtactcctccgcggccaaggagatcaccgtacgtgacgcgttgaactccgccctagatgaagaaatgtctgccgatccttctgtctttttgatgggcgaagaggttggagaatatcaaggtgcatacaagattacgaagggcttgcttgacaagtatggtcctgatagggttcttgataccccaatcactgaggctggttttacaggcattggtgttggtgcagcctatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaacggagctgctgctggagttggtgctcagcactcacagtgttatgcagcttggtttgcgcatgttccaggactaaaggttctggctccatattcttcagaagatgccagaggcttgctaaaagctgcaattagggatcctgatcccgttgtttttctggaaaatgaattactctatggagagtcattccctgtttctgatgaagtgcttgattctagtttcgctctgccgataggcaaagctaagatagagcgtgagggtaaagatgttacgattactgcattctccaagatggtcggttatgctcttcaggctgctgagatactgtccaaggaaggaatcagtgctgaggtgatcaacctccgatcaattaggccactggatagagccgccataaatgcatctgttaggaaaacaaatagattggtgactcttgaagaaggcttcccccagcatggtgttggtgctgagatatgcatgtctgttgtagaagaaagctttgagtatcttgatgctccaattgagaggattgctggagctgatgtacccatgccctatgctgccaaccttgagagattggctgttccacagattgaggatatcgtccgagcggccaggcgagcctgctacagagcgttgcccatggcggcaactgcgtgatcgaaatttcactttactttgcccatgctttttcccgtcgcccgcccggccagaaacgtgtgtgttccataatggtatccacaattgcccaaactcgaagcgagttaaatttttgtaggtgtgccttggcatgtttattcttttagctgctgcagttggatctcaccgcattcgctggtgcctccctccactgtcttgtgaattattacgcacgcagctttcgttgattgattagcacggcctaataacggtggttacataaa

SEQ ID NO: 3987 - DNA, 1589 bp, Hordeum vulgare
agaccacctactacgccctccaattccaccgttccgaggcggcgtctgcgtctcctcccccacgccccgtccatctcgctgcctccagcccggtgacacatccgccgccgcgccaccgtcgaattcgcctcctctgcccgccgctacgatcgcggggacgaagatgctgggcgccgcgaggaggcagctcggatccggccatatgctggcgcaggtgctgcggaggctccgcccgacggcggcggcgtccacggaggcggcaagggggtactcctccgcggccaaggagatcaccgtacgtgacgcgttgaactccgccctagatgaagaaatgtctgccgatccttctgtctttttgatgggcgaagaggttggagaatatcaaggtgcatacaagattacgaagggcttgcttgacaagtatggtcctgatagggttcttgataccccaatcactgaggctggttttacaggcattggtgttggtgcagcctatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaacggagctgctgctggagttggtgctcagcactcacagtgttatgcagcttggtttgcgcatgttccaggactaaaggttctggctccatattcttcagaagatgccagaggcttgctaaaagctgcaattagggatcctgatcccgttgtttttctggaaaatgaattactctatggagagtcattccctgtttctgatgaagtgcttgattctagtttcgctctgccgataggcaaagctaagatagagcgtgagggtaaagatgttacgattactgcattctccaagatggtcggttatgctcttcaggctgctgagatactgtccaaggaaggaatcagtgctgaggtgatcaacctccgatcaattaggccactggatagagccgccataaatgcatctgttaggaaaacaaatagattggtgactcttgaagaaggcttcccccagcatggtgttggtgctgagatatgcatgtctgttgtagaagaaagctttgagtatcttgatgctccaattgagaggattgctggagctgatgtacccatgccctatgctgccaaccttgagagattggctgttccacagattgaggatatcgtccgagcggccaggcgagcctgctacagagcgttgcccatggcggcaactgcgtgatcgaaatttcactttactttgcccatgctttttcccgtcgcccgcccggccagaaacgtgtgtgttccataatggtatccacaattgcccaaactcgaagcgagttaaatttttgtaggtgtgccttggcatgtttattcttttagctgctgcagttggatctcaccgcattcgctggtgcctccctccactgtcttgtgaattattacgcacgcagctttcgttgattgattagcacggcctaataacggtggttacataaatggaaaaactgaggtgttctcgtgcatgtgcc

SEQ ID NO: 3988 - DNA, 1584 bp, Triticum aestivum
ctactacgcccttcaattccaccgttccgaggcggcgtctgcgtctcatccccccatcccccgtccctctcgctgcccccagcccggcgacacacccaccgccgcgccaccgtcggattcgccccctcccccctgcccgccggtccgatcgcgcggaggaagatgctgggcgccgcgaggaggcagctcggatccggccccatgctggggcaggtgctgcggaggctccgcccggcggcggcggcgtccacggaggcggcaagggggtactcctccgcggccaaggagatcactgtacgtgacgcgttgaactctgccctagatgaagaaatgtctgctgatccttctgtctttttgatgggtgaagaggttggagaatatcaaggtgcatacaagattacgaagggcttgcttgacaagtatggtcctgatagggttcttgataccccaatcactgaggctggttttacaggcattggtgttggtgcagcttatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaatggtgctgctgctggagttggtgctcaacactcacagtgttatgcagcttggtttgcgcatgttccaggacttaaggttctggctccatattcttcagaagatgccagaggcttgctaaaagctgcaattagggatcctgatcccgttgtttttctggaaaatgaattactctatggagagtcattccctgtttctgatgaagtgcttgattctagttttgctctgccgattggcaaagctaagatagaacgcgagggtaaagatgttacgattactgcattctccaagatggtcggctatgctcttcaggctgctgagatactgtccaaggaaggaatcagtgctgaggtgatcaaccttcgatcaattaggccactggatagagccgccataaatgcatctgttaggaaaacaaatagattggtgactcttgaagaaggcttcccccagcatggtgttggtgctgagatatgcatgtctgttgtagaagaaagcttcgagtatcttgatgctccaattgagaggattgctggagctgatgtacccatgccctatgctgccaaccttgagagattggctgttccacagatcgaggatatcgtccgagcggccaggcgagcctgctacagagcgttgcccatggcggcaactgcgtgatcgaaatttcactttactctgcccatgctttttcccgtcgcccgcccggccagaaagaaacgtgtgtgttccataatggtatccacaattgcccaaactcaaagcgagttaaatttttgtaggtgtgcctttgccatgttattcttttagctgcagtcggatctcaccgcactcgctggtgcctccctccactgtcttgtgaattattacgcatgcagctttcgttgattgattattactacggcctaatcatggtggttacataaatggaaaactgaggtgttctcatgc

SEQ ID NO: 3989 - DNA, 1604 bp, Triticum aestivum
ccacctactacgcccttcaattccaccgttccgaggcggcgtctgcgtctcatccccccatcccccgtccctctcgctgcccccagcccggcgacacacccaccgccgcgccaccgtcggattcgccccctcccccctgcccgccggtccgatcgcgcggaggaagatgctgggcgccgcgaggaggcagctcggatccggccccatgctggggcaggtgctgcggaggctccgcccggcggcggcggcgtccacggaggcggcaagggggtactcctccgcggccaaggagatcactgtacgtgacgcgttgaactctgccctagatgaagaaatgtctgctgatccttctgtctttttgatgggtgaagaggttggagaatatcaaggtgcatacaagattacgaagggcttgcttgacaagtatggtcctgatagggttcttgataccccaatcactgaggctggttttacaggcattggtgttggtgcagcttatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaatggtgctgctgctggagttggtgctcaacactcacagtgttatgcagcttggtttgcgcatgttccaggacttaaggttctggctccatattcttcagaagatgccagaggcttgctaaaagctgcaattagggatcctgatcccgttgtttttctggaaaatgaattactctatggagagtcattccctgtttctgatgaagtgcttgattctagttttgctctgccgattggcaaagctaagatagaacgcgagggtaaagatgttacgattactgcattctccaagatggtcggctatgctcttcaggctgctgagatactgtccaaggaaggaatcagtgctgaggtgatcaaccttcgatcaattaggccactggatagagccgccataaatgcatctgttaggaaaacaaatagattggtgactcttgaagaaggcttcccccagcatggtgttggtgctgagatatgcatgtctgttgtagaagaaagcttcgagtatcttgatgctccaattgagaggattgctggagctgatgtacccatgccctatgctgccaaccttgagagattggctgttccacagatcgaggatatcgtccgagcggccaggcgagcctgctacagagcgttgcccatggcggcaactgcgtgatcgaaatttcactttactctgcccatgctttttcccgtcgcccgcccggccagaaagaaacgtgtgtgttccataatggtatccacaattgcccaaactcaaagcgagttaaatttttgtaggtgtgcctttgccatgttatttttttagctgcagtccagtcggatctcaccgcactcgctgctgcctccctccactgccttgtgaattatttacgcatgcagctttcgttgattgattgttactacggcctaatcatggtggttacataaatggaaaactgaggtgttctcatgcaaaaaaaaaa

SEQ ID NO: 3990 - DNA, 1443 bp, Pennisetum glaucum
agataactgtgcgggaagcattgaattctgcgctagatgaagaaatgtctgcagatccttccgttttcttgatgggagaagaggttggggagtaccaaggtgcatacaagatatccaagggtttgcttgacaaatatggccccgatagggttcttgatacaccaatcactgaggctggctttactggtattggtgttggtgctgcctaccatggtcttcgacctatagtagagttcatgacatttaacttttcaatgcaggcgattgatcacatcattaattcagctgccaagtcgaactacatgtcagctggtcagatatctgttcctattgtattcagagggccaaatggtgctgctgctggagttggtgctcaacactcgcagtgctatgcagcttggtatgcccatgttcctggattgaaagttctaacaccatattcttcagaagatgctcgaggtttgctgaaagcagcaatcagagatccagatcctgttgttttcttggaaaatgaacttctatatggtgaatcgtttcctgtttctgatgaagtacttgattctagcttctgccttccaatcggcaaggctaagatagagcgacaaggaaaagatattacaatcactgcattctctaagatggtcggatatgctcttcaggctgcagatatactggccaaggagggtatcagtgctgaggtaatcaatcttcgttcgattagaccgctggatagagccactattaatgcatctgtgaggaaaaccaatagattgctaacagtagaagaaggcttcccacaacacgggattggtgctgaaatatgcatgtctgttgtggaggacagctttgagtatcttgatgcgccagttgagcggattgctggagctgatgtgcccatgccctatgctgccaacctagagaggatggctgttccacaggtcgatgatattgtccgagcagcgaagcgggcttgctacagggtggtgccaatggcggcaacggcctgattcaccgtggtttctcaatcttccattccgctgtctctgtccagaaagatgtgtgtgtggcataatggtatgagtagagtactcactacctctccaactcaagtagcgcgagctgattttgtagagcaaacatgaggtgtccagttccgcccgcggcagccggatgggctggtcgtacccggtgtcattctactacggttcaactcggggtttcgcgaatcatgcaggatttacatcattattacgtgaggggaagatggtgtcatgaataacatgtatttgaaaggagctctaagagaagaggtcctcggataggaagtctggttgcgcgcttcctctttttcttccaatctctgtttccatactaggaactctagacacggtcctgcactcctgctcctgcctttgccttgcgctttgtgaaatgttatccgag

SEQ ID NO: 3991 - DNA, 1417 bp, Elaeis guineensis
  misc_feature (60)..(60): n is a, c, g, or t
  misc_feature (458)..(458): n is a, c, g, or t
  misc_feature (470)..(470): n is a, c, g, or t
  misc_feature (476)..(476): n is a, c, g, or t
  misc_feature (485)..(485): n is a, c, g, or t
  misc_feature (494)..(494): n is a, c, g, or t
  misc_feature (509)..(509): n is a, c, g, or t
  misc_feature (515)..(515): n is a, c, g, or t
  misc_feature (1377)..(1377): n is a, c, g, or t
  misc_feature (1379)..(1379): n is a, c, g, or t
  misc_feature (1385)..(1385): n is a, c, g, or t
  misc_feature (1391)..(1391): n is a, c, g, or t
  misc_feature (1404)..(1404): n is a, c, g, or t
  misc_feature (1407)..(1407): n is a, c, g, or t
ccaagatgtggggcatcgcgaggcgaaagatcggattgggaaccttcccctcaccgattntagggcaggtattgcagaggattcggccgatgggatccgcgttgccaaagagctactcaactgcagcaaaagagatgacagtgcgtgaagctctgaactctgcacttgatgaggagatgtctgcagatcctaaagttttcttaatgggcgaagaggttggggagtatcaaggtgcgtacaagatttcaaaaggtctgcttgagaagtatggtcctgagagagttcttgatactccaattacggaggctggatttgctggtatcggagttggtgcagcttattatggtctacggcctgtcatagaatttatgacattcaacttctccatgcaggcaattgatcatatcattaattctgctgcaaagtcaaattacatgtcagccggtcagatatctgtncctattgttttnagaggnccaaatggngctgctgcnggagttggtgctcancattcncagtgttatgcagcttggtatgcacatgttcctggtttgaaagtgctaagtccatattcatctgaagatgctcgtggcttgttaaaagcagctataagggaccctgatcctgttgttttccttgaaaatgaacttctatatggagagtcatttcctgtttcagctgaagctcttgattccagtttctgccttccaatagggaaagccaagatagaacgagaaggaaagcatgtttctattaccgctttctcaaaaatggttggttacgctctgcaggctgcagagatactttcaaaggaaggaattgatgccgaggttataaatctccgttcaataaggccactagacagagctactatcaatgcttcagttaggaaaaccaacagactggtgactgttgaagaaggtttcccacagcatggtgtaggtgctgaaatatgtatgtccattattgaggatagcttcgagtatctagatgcaccagtggagagaattgctggagctgatgttcctatgccttatgctgcaaacctggagaggatggctgttcctcaggttgatgacattgtccgcgcagcaaagcgggcatgctacagatcggtccccatggctgcagctgcttagtttgaggggttctttttgatgaaaccaatttctccttttgtttttccagttagagaagatgcagcataagatttatttgtgttctttccctctagtgatctgattttgtgcataatagagattgaggtctccatgatgttctttccttgcagttgaaagactgcttggttcatggcacgaaataattctttttaaactcgttggtatatcctactgaaacagctgtagtttagatgtncnaaatcntagctnaaacatgatcacnggnttaataatgc

SEQ ID NO: 3992 - DNA, 1579 bp, Zingiber officinale
  misc_feature (629)..(630): n is a, c, g, or t
  misc_feature (632)..(632): n is a, c, g, or t
  misc_feature (655)..(655): n is a, c, g, or t
  misc_feature (700)..(700): n is a, c, g, or t
  misc_feature (1019)..(1019): n is a, c, g, or t
  misc_feature (1379)..(1379): n is a, c, g, or t
  misc_feature (1417)..(1417): n is a, c, g, or t
  misc_feature (1492)..(1492): n is a, c, g, or t
  misc_feature (1503)..(1503): n is a, c, g, or t
tctcctttctctaccctgccaggccaacaaccggctgtttgcctttttcatcctcggctgcgctcctccccctctcgcccgatcgctctcgcttctttcgattctgaggaaaatgttggggatcgcgagacggaaggtcggactgggattgttccgtgctcctattctacaggagaggttgcatagggttttgcctgcaggatcagttttgtccaagaagtactcgacaagtgcaaaagagattcaagtgcgtgaagcacttaactctgcgcttgatgaggagatgtcagcagatcccaaagtcttcttgatgggtgaagaggttggagaataccaaggggcctataagatatcaaagggtcttctagagaagtatggtcctgaaagagttcttgatactcccatcacagaggctggatttgcgggcattggtgttggtgcagcttattatggtctccggcctattgtggagtttatgacgtttaacttctctatgcaggcaattgatcatatcattaattctgctgcaaaatcgaactacatgtcagcaggtcagatatctgtccccattgtatttagaggaccaaatggtgctgcagctggagttggtgcacaacattcacagtgtnntncagcatggtatgctcatgttccnggcttgaaagttttaactccatattcgtctgaagatgctcgaggnttgctaaaggctgctattagggatcctgatccagttgtttttctggaaaatgaacttttatacggagagtctttccctgtttcagctgaagcacttgattctagtttctgtcttcccatagggaaggctaagattgaacgagaaggaaaggatgtaacaatcacagcattctcaaagatggttggatatgctctgcaggctgctgatgtactttccacggaaggaataagtgccgaggttataaatctgcgttcaattaggccactagacagagccaccatcaatgcctctgtcaggaaaactaacagactcattaccntcgaagaaggtttccctcaacatggtgtaggagctgaaatatgcatgtcagtggtggaagaaagcttcgagtatcttgatgcaccagttgaaaggattgctggagccgatgtcccgatgccttacgctgccaatcttgagagaatggctgttcctcaggtagatgacattgtccgtgctgcgaagcgggcatgctatcgagcagtgcctctagctgctgcagcttagtcagacacttcataccaacattgtctttgcggttattggagagatttcccgtgaagactgatcttagcctgaaattcgtgttgcaggcttattcttttgcatttatctatgtgactgcagatgctgctggtcntaaatcttcgaaaactcatccatgtagattgttgagantcttcaataatgtataatgccagaatcctcaaaaagtgtttattaatctggctcacaagtttccttgagaaagtnttccttttagnctggatctttgtattgactaatgatactgaattaaagagtttgtgtttaggttttcttgaatggacgacattcaaa

SEQ ID NO: 3993 - DNA, 1737 bp, Ricinus communis
ggggaattatttgattttctttttgattgaaaatagaagactaattatcaaagataaagattaaaaagaataaaaaattagtgaaagcattggttattattttggtacctttttttgataatctttttaacaggatcggatctgtttccatcttcggccgtcgattatctcaaacaaggtatttgagcggtagaagttgaagattagacaagtatgttggggattatcaaacaaaaagctcttgggaagtccttgcagaggattcgacctgctgttgcttcagcatggagagcttactcatccgccgcaaaggagatgacggttagagaagcattgaactctgctcttgatgaggaaatgtccgctgatcctaaagtgtttttaatgggagaagaggttggagaataccagggtgcctataagataactaaagggctgttggacaaatatggtcctgagagggttcttgatacaccaattactgaggctggatttactggcattggagttggtgctgcttaccatggtctcaagccagttgttgagtttatgacatttaacttctctatgcaggcaattgaccatattattaattctgctgcaaaatcaacctacatgtctgctggtcaattatctgtgcccatagtttttagaggacctaatggtgctgctgcaggagttggtgcccaacactctcaatgttatgcatcttggtatgcctcctgccctggcttgaaagtgctggctccatactcatctgaggatgctcgtggtctgctaaaagctgctataagagaccctgatcctgttgttttccttgaaaatgagttattatatggcgagtcgtttcctgtttcagctgaagtactggactccagtttttgcactccaataggaaaagccaagattgagagggaaggaaaggatgtgactattacagccttttcaaaaatggttggctatgccctcaaggcagctgagctacttgcaaaggaaggaatcagcgctgaggtgataaacttgcgctccatcagaccactagacagacccacaatcaatgcttcagtccggaaaaccaacagacttgtgacagtggaggaaggattcccacagcatggagttggggctgaaatctgtgcctctgttattgaggacagcttcggttatcttgatgcaccagttgagagaattgctggggctgatgttcctatgccgtatgcagccaatctcgagagaatggctgtaccgcaggttgaggatattgtccgtgcagcaaagagagcttgctacagatctgtacccactgctgcaactgcttaatcaatattgagtcagtcctgaaaaccttttaaatgcagattgtatttgtttttgcctctactcgacattgctggggaagactggggaggaacacctcattgaacacccactgaataacatggaggatgttgatgatcattgaataacatggagaatgttgataacagcagaaattttgtagccttcttttgtcaaattacctgatctaaacctacttttatgcctaagccaaatatgtgttttatatgatacgttctcttttttggaaaggccagttgttgtggaagatcttcttcaaatgatatgttgagttcacttaattttcacaaaagtcgattagatttttgaatctttagcattatcattcaagaaattggtgctgtagtacggtgatgattggtcgtcaattagaatccg

SEQ ID NO: 3994 - DNA, 1867 bp, Cucumis melo
ccaaatctcccgtctgatcggatccacctctttgcagcgatctaactccataaacgccggtcagagcaatcttttgttcgagaaaaaaatgtggggaatcgttcggcaaaaagtcggcgcaggagcctcctctattccggctttgcaaaggcttcgtccagccgcctcggcaccgagatactattcatctgccgcaaaagagatgaccgtgagagatgctctgaactctgcacttgatgaagaaatgtctgctgatcctaaagtttttttaatgggagaagaggttggagaatatcagggtgcttataagataaccaaagggcttttggagaaatatggtcctgagagggttcttgataccccaatcacagaggccgggtttactggtattggcgttggcgctgcttaccatggtctgaagcctgttgtggagtttatgacatttaatttctccatgcaggccattgatcatattattaattctgcagcaaaaacaaattatatgtcagctggccaaatttctgtaccaattgtctttagagggcctaatggtgcagctgctggagttggtgcccagcactcccagtgctatgcagcatggtacgggtcctgccctggcttgaaagttttggccccatattcatctgaagatgcacgtgggcttttaaaagctgctataagggatccagatcctgtggtgtttcttgaaaatgagttattatatggtgaatcattccctgtttccgcagaggtccttgattccagtttcaccgctcctattggaaaagctaagattgaaagagaagggaaggatgtgactattactgctttctcgaaaatggtgggctatgcacttaaggcagctgaagtactttccaaagaaggaattagtgccgaggtcattaacctgcgctctattcggccactagacagagccacgattaatgcttcagttaggaagaccaatagattagtaacagttgaagaagggtttcctcagcatggggttggagctgagatctgcacatctgttgtagaggaaagttttggctatcttgacgcgccagtggagaggatcgctggggctgacattcctatgccttatgcagccaatcttgaaagaatggctgttcctcaggttgaggacatcgttcgagcagcaaaaagagcatgttacagagccgtaccattggccgcaactggttaatttgcccttccaatctggaaaagttttcccatcttagggtaagatttaatgacttattctgtcattttctgttcctgttccctcaatcaaggagaaatttcactcttcccttgtacaataaaaccttttgatgtttaaaaacttcccccgctttcttttagccaaagacaattacaaccattattcttttaacgagcaagtccaattgaaactacaagataagatacttttgtgacaaagaaatatctttttcttgccaaaatcttcacggatgtaggataagatcggtggtccgtagaatgattttgagttttagtgaatatattttgttgatacttgtagaataataattggcttagcagatgcactgtactggggatggaaccaagttgttaaaaattaacttgggagaatatattgtcaaagaagggaatttcaattttgtcaactctatattacatagtcagattttgcttcttcttcttctactttgcccaccaaaccctttgtttgtcttgtaagtttgaatcttcccttggtcttggtttttcataatgtcaacacccaatggacctactggctatgaattatatatctatatatatacatattctaataaatttatttaattttcacatggttaaaaaaaaaaaaaaaaaa

SEQ ID NO: 3995 - DNA, 1979 bp, Eucalyptus grandis
atgtgcaaactacttttgtcaaagcttcgttttatggtcttcgcagtgtacctgatgtctcctcagatggccgcacccacgctctcgtgcactgaagaaaactcaaataaacgaagtccagttgtcaaaatgcttcttcgatccagcaaaatgctcattataaaaacacatagtgatgttttttttttgggggcaaaaacacgtagtgatgttgacccgggcgtaagacggcggcccgacgagcgcacaaaaagccatttcggcctttgcctattcaaagccagaggcatcgcaatttcgcgttggctgaaaattctgtttaatgtgattttgagtccttttattgtaagacgcacgctcgtcctcttctcgctgcccccgccccgccgaacccgcccgtcgtctctgactcgatccgcctcggcccctccctctctcgcgctcgcgcacgccggccgccggtcgccgctcctccgtctctcgccgccgcggctcgcctctccctctccagtggtacctaccgttcgggtcagaagatgttgggggttgttaggcgaaaagttagcggtggcagctcgcctctcacgattcttgggcagacattgccattcctccgtgcggcagcggcaccattgaggagttactcatctgcatttaaagagatgacagtgcgagacgctctcaattcggcgcttgatgaagaaatgtcagctgatccacgggtattcttaatgggtgaagaggttggggagtatcaaggtgcatacaagatatcaaagggtctacttgataaatatggccccgacagggttctcgataccccaatcacagaggctggtttcactggaattggagttggcgctgcttaccatggtctcaaacctgttatagagtttatgaccttcaacttctccatgcaggcaattgaccacatcattaattcagctgcaaaatcgaattatatgtctgccggccaactgtcagtacctattgtttttagaggtccaaatggagctgctgcaggagttggcgctcaacactctcactgttatgcctcgtggtatgcctcttgcccaggcttgaaagtattgactccatactcttctgaagatgcccgtgggctgttgaaagctgccataagggaccctgatcctgtagttttcctcgagaatgagttattatatggtgagtcattccctgtttcagctgaagtgctagattccagcttttcccttcccattggaaaagccaagattgagaaggaagggaaggatgtgacgataacggctttttcaaagatggtgggccttgccctcaaggcagctgatattcttgcaaaggaaggaattaatgctgaggtcattaatttgaggtctattcgacctcttgatagagccactatcaatgcttcagtccggaaaaccaatcggcttgtgaccgttgaggaagggttccctcagcatggcgtcggtgctgagatctgcacatcagttattgaggagagcttcggttatctcgatgcaccagtcgagagaatctctggtgctgatgttcccatgccttatgcagccaacttggagaggatggctgtccctcaggttgaagatattgttcgtgcggcaaagcgagcttgctacagatccgtgccaatggctgcagcagcttgaatcgacgggagaaaaaccaataaagattttttttcgagccgaatgttggcctttcctgaattagttaggtttccggtttaatggatatggatgtccacatacagaggcgacatcttctccttttgttggttggccttcttgaggggtggttgctttttgccagaagtgttgaactgctataattttcttggaaagttcatcttttcttatcatgaaggaataacttttgctgtccgaaagtggaaaatggcaatggcgttggaaagaagcttcgttgacatttttattttcgaaataaagtatagcaagacg

SEQ ID NO: 3996 - DNA, 1631 bp, Prunus persica
gaaagaacggagagaaaacaaaatacagaattattaaaacggaaggtaattgaagaaagagcggtggctgctgtttcccttcacgctcatttttacacatctcgtcgccgatccgatccccactccaaacccgccaacaagtttgattttgaggaaaagaggcaacgatgttggggattttaaggcaaaaagtgggagctggaagctcatctgctatgattttggggcagtccatgcagaggatccgccccaccacatcggcattgagagctttttcatcttccgcaaaagagatgacagtgagggatgctttaaactctgcactcgatgaggaaatgtctgcagacccgaaagtgttcttgatgggtgaagaggttggggaataccaaggtgcttacaagatatccaaaggacttctcgacaagtatggccctgacagagttcttgatacccccatcacggaggctgggttcactgggattggagttggtgctgcttactatggtttgaaacctgttgtagagtttatgacctttaacttctcaatgcaggcaattgaccacatcatcaattctgcagcaaaatcaaattatatgtctgcaggccaaataaatgtccccattgttttcagaggaccaaacggtgctgctgctggtgttggtgcccagcactctcaatgttatgcagcatggtatgctgccgtccctgggttgaaagttttgagcccttactcatctgaagatgctcgtgggctcctaaaagctgccattagggaccctgatcctgttgttttccttgagaatgagttgctatatggtgagtcatttcctgtttcagctgaagttcttgattccagtttttgccttccaatagggaaagctaagattgagaaagaaggaaaggatgtcactattacagctttttcaaaaatggtcggctatgctctgcaggcggctgagatactcgctaaggaaggaatcagtgctgaggtcataaatttgcggtcaattcgtcctctggacaggaacaccatcaatgcttcagtcaggaaaaccaacaggctggtaacagttgaagaagggtttcctcagcatggtgttggtgctgaaatctgcacatctgttgttgaggatagctttggctatcttgatgcaccggttgagagaattgctggggctgatgttccgatgccttatgctgctaatttggagagattggctgttcctcaggtagaagacattgttcgtgcggcaaagagagcgtgctacagatcggcgtcattggctgcaagtgcttaattttactactcgaatgcagaaatttctcccaatcaaggagatatagagattgtacattatttctcctcatcctgtggggaggaactgcttgtcaaataactggtagatcatcctgtgcggggaggagctgcttgtgtaataactcgggagaacattgacaagagcgaggaatttttttttgactctgttttgtccttgatatttgtggctgtcaacattaaactgatcgcattttggaagccattttcagggttttgtacttgaatttctaaaccacaccatcttattccagaaatgttaatggtgctgcttcagtgtttatcttccaatggc

SEQ ID NO: 3997 - DNA, 1725 bp, Populus trichocarpa
tatcggaaaaaagtacgcgcggagtaattaacattaataataatataataagaaaaaaaagagagtaagtgaagaaggtggtggaggtggctgttttgatcgtcattccctcatctcatctcccctaccagatcaccagatcctgctctgcctgtgagaaaaaaaatatttatttatttcttagatcatcgccttaaacaaatttttgagatagagaaagagagaatatgtttggaattgtaaggcaaaagattagtgccggaggttctcccctcctggcttttgggcagaggattcgccctgcggtatcggcatggagaggttattcatctgcagcaaaagagataacagttagagaagcgctaaactctgcgctcgatgaggaaatgtcagctgatcctaaggtctttttgatgggtgaagaggttggtgaatatcagggtgcatataagatatccaaggggcttttagacaagtatggtcccgagagagtccttgatacaccaatcacagaggctggttttactggcattggagttggtgctgcttaccatggtctcaagccagttattgagtttatgacattcaacttctctatgcaggcaattgatcacatcattaattcggctgcaaaatcaaattatatgtcttcagggcagatatcagtgcccattgttttcagagggcctaatggtgctgctgctggagttggtgctcaacactctcactgttatgcttcgtggtatgcctcctgccctgggttgaaagtactggctccttactcatctgaagatgcccgtggtctgttaaaggctgccataagggaccctgatcccgttgttttccttgaaaatgagttgttatatggtgagacattccctgtttctgctgaagtactcgactccagtttttgcgttccaattgggaaagccaagattgagagagaagggaaggatgtgaccattacagccttttcaaaaatggttggctatgctctcaaggctgctgagatacttgcaaaggaaggaatcaacgctgaggtgattaacttgcgctcaattaggccgctagatagagacacaatcaatgcttcagtcaggaaaactaacagactggtgacagttgaagaagggtttcctcagcatggcgttggtgctgaaatctgtgcgtctgttgttgaagagagctttggttatcttgatgccccagttgagagaattgctggagctgatgttcccatgccttatgcagctaatttagagagattggctgttccacaggttgaagatattgttcgtgcagcaaagagagcttgctacagatctgtgccaatggctgcagctgcttgatgatactcattaaagtctagaaaccctcttaaattcaggaatctgagagatgtacatttttctcctcctggtttctgctgggaaggaacagctcattgaataacatggagtgtgttgatgacagcgggaatttttgtccatgttttgtcaaatttggtacctgatatgaacccgtttcacacgtgagccaataaatatgtttacttgtggatttttagagcgcattctcctttgaatggtccatgatgtttccaagtttatcttcatatgatcaatttgattcccttttattcataaattgatgtattacatgctcttcatgacatcagcttgaattttagagcccctagttaataaattaacgtgttctgggtgt

SEQ ID NO: 3998 - DNA, 1626 bp, Euphorbia peplus
ctaagtggctattcgattcgatcctatttgtactatctgctaccggatccgatccatttccgatcagctgtctccagtatttgagtagaagagaagaagaagacgaaagatgctggggattgtaaggcaaaaagttttagggcagtcgcttcagaagattcggcctgccgctgcagcatggagaaacttctcatctgcctctaaagagatgacggttagagaagcacttaactctgctcttgatgaggaaatgtctgctgatcctaaagtgtttttgatgggagaagaggttggggaatatcagggtgcatataagattactaaagggcttttggataagtatggtcctgagagagttcttgataccccgattactgaggctggatttactggaattggagttggtgctgcttaccatggtctgaagccagttgttgagtttatgacatttaacttctctatgcaggctattgaccatattataaattcagctgcaaaatcgtgctatatgtctgctggccaattatctgtacccatagttttcagaggacctaatggagctgccgcaggagtcggtgcccagcactcccaatgttatgcggcatggtatgctgcctgccctggcttgaaagtactcgctccttactcagcagaggatgctcgtggacttttaaaagcagccataagagaccctgatcctgttgttttccttgaaaacgagttgttgtatggtgagtcattcccgatttcagatgaggtactagactccagtttttgtgtcccaattggaaaagccaagattgagagagaagggaaggatgtgactatcacagccttctcaaaaatggtgggctatgctcttaaggctgctgagatacttgcaaaagaaggaatcagtgcagaggtgataaatttgcgctcaattcggccactagatagacctgcaatcaatgcttcagtgcggaaaaccaacagactggtgactgttgaggaaggattccctcaacatggtgttggcgctgaaatttgtgcatctattgttgaggagagcttcggttatcttgatgccccagttgagagaattgctggagccgatgttcctatgccttatgcagccaatcttgagagattggcagtaccacaggttgaggatattgtgcgggcagcaaagagggcttgctacagatctacacaaatggctgcagccgcttaatcaatacaacaaaaacaactcaaattcaggatttctacagagcaattgttctttggctgcggttttgatacttttgggggtagacctgggaggaacacttagattgaataactcgtgaatattgaaaaacatggagaatgttgatgatgccagaatacttttttgtcaagttcggccactttgatgttggaccgattttatactatgccgcaaatttatatttgttttatggcataatttttctggaagggtctatatggtgttctcaaagacatcttccaatactttcagtgtacgtaaatgtctggttcacaattgaccaatcattatgacatcaaaatcatatcatatcatgtaagaatgtgatgcataattgggttttgcaacaagcaaccacaattttttcgtacaga

SEQ ID NO: 3999 - DNA, 1523 bp, Tripterygium wilfordii
agtggtgactctcttcgcttccatttcacacatctcgtcgtcgatcggatccggctccagtttggttagtgtgccgaactcttggaggctcaattgattaagtttaatctggtgattaaagcggcgttctgttaaagaagaagagatgtggggggttgttagtcaaaaggttttagcgcagtccttgcaacgccttcgccctgcagcatcagcatggagaggttttgcctctggaacaaaagagattaatgtgagagaggctctaaactctgcacttgacgaagaaatgtcagctgatcctaaggtctttttgatgggtgaagaggttggagaatatcaaggtgcatacaagatttccaaggggctattggaaaagtatggccctgagagagttcttgataccccaattacagaggctggttttacagggatcggagttggtgctgcatactatggtcttaagcctattgtggagtttatgacgttcaacttctcaatgcaggcaatcgatcacattataaattctgctgcaaaatcaaactacatgtctgctggccagatgtctgtaccaattgttttcagaggacccaatggtgctgctgctggagttggtgcccaacattcgcattgttatgcagcatggtatgcctcttgccctggtttgaaagtgctatccccgtattcatctgaagatgcccgtggactgctaaaagctgcaataagggacccagatcctgttgtttttcttgaaaatgagttattgtatggtgagtccttccccgtttctgatgaggtacttgattccagcttttgcattccgatagggaaagctaagattgagagggaaggaaaggatgtgacaattacagcattttcgaaaatggttggctatgcgctcaaggcagcagagacacttgagaaagagggaattagtgctgaggttataaatttacgttccattaggccactggatagggccacaatcaattcttctgtcaggaaaaccggcagactggtaacagttgaagaaggatttcctcagcatggtgttggagctgaaatctgcacatctgtagttgaggacagctttggttatcttgatgccccggttgagagaatcactggagctgatgttcccatgccatacgctgccaatcttgagagaatggctgtcccacaggttgaagatatagtccgtgcggccaagagagcttgctacagatctgtcccaatggctgcaactgcctaaaagactcttaaaactgtcttattgctatcttttcaatcgaggttggttctacgtggctgcattcttctttaagtgcatctcctgtcacatataagccatacagtttatgcaagactttgcctaaagtctaggcctccatcatatgtaataatcttgtttttctctccccactcccaactttttttttgcttttctggaaatggagtcattgtacattttttttaaccttcgccaacacttttggggaggaattggtcatcgaataactcggaga

SEQ ID NO: 4000 - DNA, 1746 bp, Quercus alba
ttttctacaccgaacgccttaataagatcggataccacaccattcttgttccaagagcaatatttagaggcaaagatgttggggattataaggcaaaaagtaggtgccggaggcgcttctcttctgaggacacgttctgccgtttcggcattgagaagctactcatcagcaggaaaagagatgatggtgagagatgctctaaattctgcgcttgatgaggaaatgtctgctgatccgaaagtgtttttgatgggtgaagaggttggtgaatatcaaggtgcatacaagatatccaaagggcttttggacaagtatggtcctgatagggttcttgatacaccaatcactgaggctgggtttactgggattggagttggtgctgcttaccatggtctgcggcctgttgttgagttcatgacatttaacttttctatgcaggcaattgatcacatcattaattctgctgcaaaatcaaactatatgtctgctggccagatatctgttcctatagttttcagagggcctaatggtgctgctgctggtgttggtgcccagcactctcattgttatgcctcgtggtatgcctcctgccctgggttgaaagttttaaccccatactcatctgaagatgctcgtggactgctaaaagctgccataagagatcctgatcctgttatttttcttgaaaatgagttgttatatggtgagtcattccccgtttcagctgaagttcttgattccagtttttgcttaccaatagggaaagctaagattgagagagaaggaaaggatgtgactattacagctttttcaaaaatggtgggctatgctctcaaggcagctgagattcttgcaaaggaaggaatcagtgctgaggttataaacttgcgcacaatccggccattagatagatccacaatcaatgcttctgtcaggaaaaccaacagactcataacagtcgaagaaggttttccccagcatggtgttggagctgaaatctgcacatctgtagttgaggaaagcttcggttatctcgatgctccagttgagagaattactggggctgatgttcctatgccttatgcagctaatcttgagagattggctgtcccacaggttgaagacattgttcgcgcggcaaagagagcatgctacagatctgtaccaatggctgcggctgcttaattcaaccaatcccatccagaaacttttccgaatccaggagatatagagtgtacattttttcatttctcatcacatgggaagaagctacttcgctgaaataacttggagaacattgacacaaaggcgggaaattttgtgacttgtcatttttatttggcagtggacttggaacaaattcgatttccatccaatacattgctttcttgcaacgcctcttgtactgtttaagcgtttgtcttctgatcattgtttgtttaatttggtaaactctggctggaatggtcatatatatgttgcatacgccccttagccttagggatgttagatgcatgaatgataaagtggggtgttaaagaaaaaaacaataaagtttggagtttttgcaatctttatcctttgatgatgtttattagtcagtcatgttaagttcaaggttaccatttctatgagcatattgtggtaggcaacacacttaactacgtctcagagcctaatgaacctttctttgttaggcaaagaatcaaatgtcatatgaaattcctaggttaacattttctgtac

SEQ ID NO: 4001 - DNA, 1623 bp, Cucumis sativus
tctcattggatccaactctttgcagcgatctaactccataaacgccggtcagagcaatcttttgttcgagaaaaaaatgtggggaatcgttcggcaaaaagttggcgctggagcctcctctattccggctttgcaaagtcttcgtccagccgcctcggcatcgagatactattcatctgccgcaaaagagatgaccgtgagagatgctctaaactctgcacttgatgaagaaatgtctgttgatcctaaagtttttttaatgggagaggaggttggagaatatcagggtgcttataagataaccaaagggcttttggagaaatatggtcctgagagggttcttgataccccaatcacagaggccgggttcactggtattggcgttggcgctgcttaccatggtctgaagcctgttgtggagtttatgacatttaatttctccatgcaggccattgatcatatcattaattctgcggcaaaaacaaattatatgtcagctggccaaatttctgtgccaattgtctttagagggcctaatggtgcagctgctggagttggtgcccagcactcccagtgctatgcagcatggtatgggtcctgccctggcttgaaagttttggccccatattcatctgaagatgcacgtgggcttttaaaagctgctataagggatccagatcctgtggtgtttcttgaaaatgagttattatatggtgaatcattccctgtttccgcagaggtccttgattctagtttcaccgctcctattggaaaagctaagatcgaaagagaagggaaggatgtgactattactgctttctcgaagatggtgggctatgcacttaaggcagctgaagtactttccaaagaaggaattagtgctgaggttattaacctgcgatctattcgaccactagacagagccacaattaatgcttcagttaggaagaccagtagattagtaacagttgaagaaggctttcctcagcatggggttggagctgagatctgcacatctgttgtagaggaaagttttggctatcttgacgcgccagtggagaggatcgctggggctgacattcctatgccttatgcagcaaatcttgaaaggatggctgtccctcaggttgaggacatcgttcgagcagcaaaaagagcatgttatagagccgtaccattggccgcaactggttaatttgcccttccaatccggaaaaattttcccatcttagggtaagatttaatgacttatctgtcattttctgttcctgttccctcaatcaaggagaaatttcactcttcccttgtacaataaaacctattgatgtttaaaaacttccccccgctttcttttagccaaagacaattacaaccattattcttttaacgggcaagtccaatcgaagtacaagataagatacttttttgtgacaaagaaatatctttttcttgccaaaatcttctcacggatgtaggatttaagtttggtggtccgtagaatgattttgagttttagtgaatatatattttgttgatacttgtaaagtaataattggcttagcagatgcaggacactgtactggggatggaaccaagttgttaaaaattaacttgggagaatat

SEQ ID NO: 4002 - DNA, 1770 bp, Fragaria vesca
taaaagggtccaaagcaaacacaaaaacgacacaattggaagtggtggctgctgctcactccacgcccacttttaccctcccctccctcgccgatccgatcccaactccaacccgccaccaagtgagtgttttctgtgactttgagccctagtagacgaagatgttggggattttaaggcaaaaactgggagctgcgagctcttccgctacgatgctggggcagttgcagaggatccgccccgccgtttcggcactgagaggcttctcttcttctgcgaaagagcaaatgacagtgagggatgctttgaactctgccctcgatgaggaaatgtctgccgatccgaaagtgtttattatgggtgaagaggtcggggagtatcaaggtgcttacaagataaccaaaggacttctggataagtatgggcctgacagggttctcgataccccaatcacagaggctgggtttactggaattggagttggtgctgcctactatggtctgaaacctgttatagagttcatgaccttcaacttctctatgcaggcaattgaccatatcatcaattctgctgcaaaatcaaattacatgtctgctggtcaaataaatgtgccaattgtgttcagaggtccaaatggtgctgctgctggtgttggtgcccagcactctcaatgttatgcagcatggtttggtgccgtccctgggttgaaagttttggccccttattcatctgaagatgctcgtggactgctaaaagctgccattagggaccctgatcccgttgtttttcttgaaaatgagttgctatatggtgaatcatttcctatttctgctgaagtacttgattccagtttttgccttccaataggaaaagctaagatcgagagagagggaaaggatatcaccattacagctttttcaaaaatggtcggctatgctctacaggctgctgagattcttgctaaagaaggaattagtgccgaggtcataaacttgcggtcaattcgtcctctggacagggctaccatcaacgcttcagttaggaaaaccaacagacttttaacagttgaagaaggatttcctcagcatggtgttggtgctgaaatctgtgcatccgttgttgaggagagctttggttatcttgatgcgcctgtcgagaggattgcaggggctgatgttcccatgccttatgcagccaatttggagagattggctgttcctcaggttgaagatattgttcgagctgcaaagagagcgtgctacagagctgtgccattggctgcaaatgcttagttttaccctttaaatgcagaaacttctctggaatgaggagttacagagactgtacattatttctcttctcatcctgtgtggggagaaactgcttgtcaaataactgggagatccatcctgcgcgaggaactgctcggtcaaataactcggaggacattgacaagagcgaggacattttttgactctattttgtttttctttgtggctgtcaacattgaaacctgttgggtttatggaagccattttatgggttatctacttggaaccacaaattttattccacaaaggtttatggtggtgcttcattgtttatttcatgatgatttttgtccacttgggtgtcttttgttttaccatgctgattgatatgaactctcaagaaacttatggttgaaacaagagataaaaagatgagaaaacaagataacactgaagttaatggcaaatgtctatgaaatcaagttattgttgctgatct

SEQ ID NO: 4003 - DNA, 1464 bp, Cucurbita pepo
aggaaggtggtggtgggctcgccgttttcaaacccctacattcccctaaatttctcgtctcatcggatctaaacctttgcagcgatccaaatccatatacgccggccgagctaagagctgtctttcgcgcgagaaaaatgtggggaatcgttcggaaaaaagttggagctggagcctcctgtattctgacttccggccaggctttgcagaggcttcgccctgccgcctcagcatcgagatactattcatctgccgcaaaagagatgactgtgagagatgctctaaactctgcacttgatgaagaaatgtctgctgatcctaaagtttttctgatgggtgaagaggttggagaatatcagggtgcctataagataaccaaagggcttctggagaaatatggtcctgagagggttcttgataccccaatcacagaggctgggtttactggtattggcgttggcgctgcttaccatggtctgaagcctgttgtggagtttatgacatttaatttctctatgcaggccattgatcatatcattaattctgcggcaaaaacaaattatatgtcagctggacaaatttctgtgccaattgtctttagaggacccaatggtgcagctgctggtgttggtgcgcagcactctcagtgttatgcagcatggtatggcgcctgtcctggcttgaaagtcttggccccatattcatctgaagatgctcgtgggcttttaaaagctgctataagggatccagaccctgtggtgtttcttgaaaatgaattattatatggtgaatccttccctgtttcagcggaggtccttgattccagtttcactgctcccataggaaaagctaagattgagagagaagggaaggatgtgaccattactgctttttcgaagatggtgggatatgcacttaaggcagctgaagtactttccaaagaaggaattagtgctgaggttataaacctgcgctctattcgaccactagacagagccacaattaatgcttcagttaggaagaccaacagattagtaacagttgaagaagggtttcctcagcatggcgttggagctgagatctgcacatctgttgtcgaggaaagttttggctatcttgatgcaccggtggagaggattgcaggggctgacattcccatgccttatgcagccaatctcgaaaggatggctgtccctcaggttgaggacatcattcgagcagcaaaaagagcatgctacagggctgtaccattggcggcttccggttgattttactcttccaatcttgaaaaaaattccagcttaggggtaagattttatgacttctctgtccttttccgttcctattgtctcaatccaggaggaatttcactcttcccttgtacaataaaccatttgctatttaaacatcactcgccttttagccaagacaattacatccatttctttaaggcagccaatctaa

SEQ ID NO: 4004 - DNA, 1714 bp, Momordica charantia
gccctccatttccccaagtctcccgtctgatcggatccaacccttgcactgatctaaactccggccagagctatctctcgcgcgagaaaaatgtggggaatcattcggcaaaaagtcggcgctggaggctcctccattctgatttccgggcagtctttgcagcgactccgccctgctgcatcagcatcgagatactattcttctgctgcaaaagagatgacagtgagagatgctctaaactccgcacttgatgaagaaatgtccgctgaccctaaagtatttttgatgggtgaagaggttggagaatatcagggtgcatataagataaccaaagggcttttggacaaatatggtccagagagggttcttgataccccaatcacagaggctgggtttactggtatcggtgttggcgctgcttatcatggtctgaagcctgttgtggagtttatgacatttaatttctctatgcaggcaattgatcatatcattaattctgcggcaaaaacaaactatatgtcagctggccaaatttctgtgccaattgtctttagagggcctaatggtgcggctgctggagttggtgcccagcactctcagtgttatgcagcatggtatggctcctgtcccggcttgaaagttttggccccatattcatctgaagatgctcgtggacttctaaaagctgccataagggatccagatcctgtggtgtttcttgaaaatgagttattatatggtgaatcattccctgtttcggccgaggtccttgattctagtttcaccgctcccataggaaaagctaagattgagagagaagggaaggatgtgactattactgctttttcaaggatggtgggctacgcacttaaggcagctgaaatactttccaaagaaggaattagtgctgaggttataaacctccgctctattcgcccactagacagagcaacaattaatgcttcagtgaggaagacaagcagattagttacagttgaagaagggttccctcagcatggtgttggagctgagatctgcacatctgtcgtcgaggaaagttttggctatcttgatgcaccagtggagaggattgcaggggctgacattcccatgccttatgcagccaatctcgaacggatggctgttcctcaggtggaggacattgttcgagcagcaaaaagagcatgctacagagccgtaccattggccgcaactggttgattttgcccttccaatctggaattttttttccatcttagggtaagattcaatgacttcattgtccctttcagtttctgttcccattccctcatccaagaagaaatttcagtcttcccttgtacaataaaaaccttttgattttagccgagacattttacaaccattccttcaacgggcatgtccaatcaaacttggagatatttttatgagcaaaaaaagaaaatccatttcttgccaaaattaatcacagaacatttgacagtggtaaaataataagtggcttagcagatgcaggagactgtagtgtacattgtttctgtgatggcgtctggtctgtgagttgttaaaataacttgggagaacattgtcgaagatgggaatttcattttttgtcaactctattccatagtcagatagattattcctcttctgctctgcccaaattcaaaccttttgtttgtcatgtaagtttcaatcttcccttgttcttcgt

SEQ ID NO: 4005 - DNA, 1295 bp, Amsonia hubrichtii
ccttcttcgtctctcaacttcctcaatttctctcccacacgccggcgacaggcgaccgtcaaccgggaactgtaaatcagctgtccctctgcaagagtgaccacagaatcgaagttttgtaaataatcaaccagaagatatggcaggcgcattgaggaagatagtgggctgccaaggaattccagtttcgggaattagagtaattgcgtctagggcgtactctgcttcggcgaaagaaatgacagtccgtgatgctttaaattctgcacttgatgaagaaatgtctgctgattctagggtctttctgatgggtgaagaggttggtgagtatcaaggtgcatacaagatttctaaagggcttttggagaaatatggtcctgacagggttgttgacactcccattactgaggctggttttactggaattggagtgggtgcagcttacaagggtctgaagcctgttatagagttcatgacatttaacttctcaatgcaggcaattgatcatatcatcaattcagctgcaaaatcaaactacatgtctgcgggtcaaatttcagtgcctatcgttttcagaggtcccaatggagctgctgctggagtcggagctcagcattcccagtgctatgctgcatggtatggttcagttccaggattgaaggtactggcaccgtactcagcagaagatgcccgtggcctgctaaaggctgctataagggacccagatcctgttgtttttcttgaaaatgaattgatgtatggtgagtcgttccctgtttcagctgaggcccttgattcaagctttgttcttccaattgggaaagctaaggtagaacgtgaaggaaaggatgtcacaattactgcattctcaaaaatggttggctatgctctgcaggctgctgatattctggcaaaggaagggttcagtgcagaggttataaatttgcgttccataaggccacttgatagagctacaatcaatgcctctgtcaggaaaaccaacagacttgttactgttgaagaagggtttcctcaacatggtgttggagctgagatctgtgcatctgttgttgaagagagttttgagtatcttgatgcacctgttgaaagaattgctggagctgatgttcccatgccttatgcagcaaatctggagagggtggcagttccacaggttgaggatattgtacgcgcagcgaagaggacatgctacagatcagttccacttgctgctgcagcctaaagttaacaagaatacactttgattttgatagtttctcttcacgaaacaaaag

SEQ ID NO: 4006 - DNA, 1797 bp, Malus domestica
gagaaataaaaagtaaaaaaatagagaatattaggtaattgaaagaaagtggttgctgctgctgctgctccgctgctccctcaacgctcattttttacacatcgcgtcgccgatccgatccccgctccaatccgccaaacagtaaatcgtttgttcttcctcctcatctttctcagtgctttcactgaaattggcgttcagtgtgattttttgggaaagaaacgaagatgttggggattttaaggcagaaagtgggagctggaagctcgtcagctatgattttggggcagaggatccgccccgccgcttcggcattgaggggtttcgcatcttctgcgaaagagatgacagtgagggatgctctgaactctgcgctcgatgaggaaatgtccgcggacccaaaagtgtttttgatgggtgaagaggttggggaatatcaaggtgcttacaagataacgaaaggacttctggacaagtatggtcctgacagggttcttgataccccaatcacagaggctgggtttactgggattggagttggtgctgcttactatggtttgagacctgttatagagttcatgacctttaacttctcaatgcaggcaattgaccacatcatcaattccgctgcaaaatcaaattatatgtctgctggccaaataaatgtgcccattgttttcagaggaccaaatggtgcggctgctggggttggtgcccagcattctcaatgttatgcagcatggtatgcagcctgccctgggttgaaagttttgactccttattcatctgaagatgctcgtggactcttaaaagctgccattagggaccctgatcctgttgttttccttgaaaatgagttgttatatggtgagtcatttcctgtttcagctgaagttcttgattccagtttttgcctcccaattggaaaagctaagattgagagagaaggaaaggatgtcactattacagctttttcgaaaatggttggctattctctacaggctgctgagatactcgctaaggaaggaatcagtgctgaggtcataaatttgaggtcaattcgtcctctcgataggaaaaccatcaatgattcagtcaggaaaaccaacagactggtgacggttgaagaagggtttcctcagcatggtgtcggcgctgaaatctgcgcatctgttgttgaggatagctttggttatcttgatgcaccggttgagagaatttctggggctgatgttcccatgccttatgcagccaatttggagcgattggctgttcctcaggtcgaagatattgtgcgtgcagcaaagagagcgtgctacaaatcttcctcattggctgcaagtgcttaatttttaccacttcaatgcagaaatttctctggattgaggagttatagaaattgtacattatttctctcctcatcgattgttgggaggaactgcttgtcaaataactggtagatcatcccgtgcggggaagaactgcttgtcaaataacttgggagaacgttgacaagggcgagaaattttttgacttgtgttgtttattatttttcgctgtccgcattaaacctattgtgttttggaagccattttctgggttgaagtacttgatttccggaaacgtcaatggctgctgcttcagtcttttccttccttccagtggttttggtcccaattggtgaatttcagttaactatgcgtgatcgatgtacactgcagagatttatgattgttggaaccgaaacgaatcaattggataaaaaatattagaaaggagaaggaaatatttgaattt

SEQ ID NO: 4007 - DNA, 1670 bp, Manihot esculenta
atggaatatcaaatatacaccatccgatgtccgccgcacaatatcagaatacaagttaacaacaaaacggaagctgattctgcgagtataactctgggaagggtttgtttgttagatcgccattttgacatctggttctggatcggatccttcttctttcgtcgaattcattcgatcgtctccgccaaagtacttgagcgaaaagaagaagaagaaaaagaagaaaatatgttgggaattataaggcaaaaagcttttgggatgtccctgcagacgattcggcccgcagcttcagtatggagaggttactcatccgccgctaaagagatgactgttcgagatgcactgaactctgctctcgacgaggaaatgtctgcggatcctaaagtttttttgatgggagaagaggttggggaatatcagggtgcatataagataactaaagggctcctggagaagtatggtccagaaagggttcttgatactccaattactgaggctggatttactggcattggagttggtgctgcttactatggtctgaagccagttgtggagtttatgacaattaacttctctttgcaggcaattgatcatataattaattctgctgcaaaatccaattacatgtctgctggtcggatttctgtgcccatagttttcaggggaccaaatggtgctgctgcaggagttggtgcccaacactctcaatgttacgcatcatggtatgcttcctgccctgggttgaaagtgctggccccatactcatctgaagatgctcgtggactgctaaaagctgccataagggaccctgatcctgttgtttttcttgaaaatgagttattatatggtgagtcatttcctgtgtcagctgaagttcttgactccagtttttgccttccaataggaaaagctaagatcgagagagaagggaaggatgtgactatcacagccttctcgaaaatggtgggctatgctctcaaggcagctgagatacttgcaaaggaaggaatcattgctgaggttataaatttgcgttccattaggccactagataaacacacaatcaacgcttcagtccggaaaaccaacagactggtgacagttgaagaaggattccctcagcatggtattggggctgaaatctgtgcatctattattgaggagagcttcagttatcttgatgcaccagttgagagaattgctggagctgatgttcccatgccttatgcagccaatcttgagagaatggctgtacctcaggttgaggatatagtgcgtgctgcaaagagagcttgctacagatctgcaccaatggctgcagctcaataatatttcagtctagaaaccttattaaatccaggaattctggagattgtaattttttgcccccctttacacatctgaggatcaactcattgaataacttggagatattgatgatcattgaataacatggagattgatgatggcggaaatcgtggcattctttctttgtcaaattcagccacctgatttggacctattttatgccaaagccaaaatgtgaatttacttgtgatttctgtatgtgcattcctttttggagaggtctattggtgttttgaagatcatcttcaaactaatattgtccaattcacttgatatttggtcaaaattgatgctttcag

SEQ ID NO: 4008 - DNA, 1489 bp, Platanus occidentalis
ggaccaaccatttaaccttctgtgcttttctctgcaatcgtatcccatcaaaagcctcatcgatctcgatataattttcccaagtttctggacctgatcatcttcatccagggttatctcgagcgcaagtaggaaaatgtttggaattgtacggcataaaatgggtcgcggaagctttaatgcctcgattttggggcagtctttacagaggatcaggcctgccgtagccacatcaagaagttactcaacggcgtccaaggagatgacagtgcgagatgctttaaactctgcactagatgaggaaatgtctgctgatcctaaagtctttctgatgggtgaagaggttggtgaataccagggtgcgtacaagatttccaaagggcttttggagaagtatggtcccgagagagtccgtgatactccaattacagaggctggctttgctggaattggagttggtgctgcttattatggtcttcggcctgttgtagagtttatgacttttaatttctctatgcaggcaattgatcacatcattaattctgctgcaaaatcgaactacatgtctgctggtcagatatctgtacctattgtcttcagaggaccaaatggtgctgctgctggagttggtgcccaacactcccagtgttatgcagcttggtatagttcttgtcccgggttaaaagtgttgactccatactcatctgaagatactcgtgggctgctaaaagctgctataagggaccctgatcctgttgttttccttgaaaatgagttgctatatggtgagtctttcccagtttctgcagaagttctcgattccagtttctgcctgccaattgggaaggctaagattgaacgagaaggaaaggacgtgacaattactgctttctcaaggatggttggttattctctccaggcagctgaaatacttgcaaaggaaggaatcagtgctgaggttataaatctgcgctcaattcggccactagatagacccacaatcaatgcttctgttaggaagaccaacagactagtgacagttgaagaaggcttccctcagcatggtgttggtgctgagatctgtacatctgttattgaggagagctttggctatctcgatgcaccagtggaaaggattgctggagctgatgttcccatgccatatgctgctaatctcgagagaatggctgtcccacaggttgatgatattgttcgtgcagcaaaaagggcgtgttacagatcagtttccatggctgcagctgcttagcttaagaagtgcagcgttgatcactctcctattttaatactctgtcggaatattgttccttttttttttttttttgggttctttgtattttgaagctctaccgtcagtggagagttcagataacctgagcagcttagctgctgtttagtttagcacatccaataatgctgagaaatgtttaattcaggtcctttaaaggaaaggagttgcatttcacggacg

SEQ ID NO: 4009 - DNA, 1422 bp, Olea europaea
acgagcaatttggcagcctagcaggtcaaaacgtttgtacgtttattaattctctctaaaatctttgttctcactctctgatccaaatctctcccgcaacaagcacacacaagccggggagtcaatatgctgggagttataaggcaaagagtggcttgcagaggcattcctactcggaattttgagcgaggaatacgagtagttgcatcccggtctttatcttccacagcaaaagagatgacagtacgagaggctttaaattcagcacttgatgaagaaatgtctgctgaccccaaagtctttttaatgggtgaagaggttggtgagtatcagggtgcatacaagatttccaaagggcttttggagaagtatggtcccgacagagttgtggatacgcccattactgaggctggatttactggaattggagttggtgcagcttactatggtctgaagcctgtgattgagttcatgacttttaacttctctatgcaggccattgaccacattattaattctgctgcaaaatcaaattatatgtcagccggtcagatatcagtgcctattgttttcagaggtccaaatggtgctgctgctggtgttggggctcaacattcccagtgctatgcagcatggtatgcttcatgcccaggattaaaggttcttgctccatattcatcagaggatgctcgtggcctgctgaaagctgctataagggatccagatcctgttgttttccttgaaaatgaattgctatatggtgaatcattccctgtttctgccgaaactcttgattccagtttttgtcttccaattgggaaagctaagatagaacgcgagggaaaagatgttacaatcactgctttctcaaaaatggttggctatgctcttcaggctgctgagattcttacgaaggaaggaattagtgccgaggtgataaatcttcgctcaattcgcccccttgacaggtcgaccataaatgcttctgtcaggaaaaccaataggcttgttactgttgaagaaggtttccctcagcatggcattggtgcagagatctgtgcatctgttcttgaagatagctttgagtaccttgatgcccctgttgagaggattgctggggcagatgttcccatgccctatgctgcaaatcttgagagaatttccgtcccacaggttgaggacattgttcgagcagcaaagagatcttgctacaaatcaagttcattggccgcaactgcttaaaagttacaatgatcaaaagttgaagaaggattaatctgtaagaaaactgacgaagctgagtgaagcaaatgatgcaaagccattgttgttattttagttttgtctgcaaaatttgttacttttcaggttctaattgcatattccaccacgttcatcaagtttgcaatatcatcgtttttt

SEQ ID NO: 4010 - DNA, 1596 bp, Actinidia deliciosa
  misc_feature (1547)..(1547): n is a, c, g, or t
  misc_feature (1549)..(1549): n is a, c, g, or t
  misc_feature (1552)..(1552): n is a, c, g, or t
aaaaaaacgagtacttgatctccgccctccggacttgaacgctcgacgatctcacaaccaccaccaccgctaccaaatcaccacgaagggctgtgttcagctgagaaagagaagatgttggggattgtgagacgaagaatcgcccgcgaaggcgttaacgcttcgatcgtggagcagtccttacagaagattcgaaatcaatctttgatttacgcgtcgaggagttattcgtctgcatcaaaagagatgacagtacgagatgctttgaattctgcacttgatgaggagatgtctgctgatcctaaagtatttgtgatgggtgaagaggttggtgaatatcagggtgcatacaagattaccaagggtcttttggataagtatggtcctgagagggtggttgatactccaataacagaggctggctttgcggggattggagttggtgctgcttaccatggtctgaggcctgttgttgaattcatgacatttaacttctccatgcaggcaattgaccacattattaattctgctgcaaaatcgaactacatgtctgctggtcaaatatctgtacctattgtctttagaggaccaaatggtgctgctgctggagttggtgcccaacattcccagtgttatgcagcatggtttggtgcatgtccaggattgaaggttctggctccatactcatcagaagatgctcggggccttctaaaagctgctataagggaccccgacccagttgttttccttgaaaatgaattgctatatggtgagtccttccctgtttcagcagaagttcttgattctagcttctgtcttccaattggaaaagctaagatagaacgtgaaggaaaagatgttactattactgctttctcaaagatggttggctatgctctcaaggcggctgaaattcttgcaaaggagggaattagtgctgaggttataaatctacgctcgattcgtccgcttgatagatccacaatcaatgcttctgtcaggaaaaccaacagacttgtaaccgttgaagaaggatttcctcaacatggtgtcggcgctgagatttgtgcatctgttgttgaggagagttttgagtatcttgatgcacctgttgagaggattgcaggggcagatgttcccatgccttatgcagcaaatcttgagaggatggccgtcccacagattgaagatattgtacgtgcagcgaaaagggcctgctacagatcagttccactggctgcaactgcttagatctgttcctaaagtcatctttctgtgttttccgcaacagttttcttttatctccaagtatctcttcatccacttttcggtgttgtaatcctcctcctccctctctctcctttgttagaaaagttggtgtaatactggaaaaggggtgggttggcgcatttaatttcatttgagagagaaataaatgtttgtgctggaaataaggtctggcaattttgtccgtcgatgtttgaaggatacagcacagcgttgtcgactgatttaattacgcaaatgcgatggttgaaagaagcaananaanatttttgcttttctaatgtgagctttctggtcgaaaaaaaaaaa

SEQ ID NO: 4011 - DNA, 1379 bp, Platanus occidentalis
cctcaagttccaaaagctgttcattttaatcagcgaaagcaggaaagatgattgggattgtaaggcaaaaaattggttgcggaggctttcgtacttcgattctggggcagtctttgaagtggatccggcctaccgaatccgcatcgagaagttactcaagtgcggcgaaagagatgacagtacgagatgctctaaactctgcacttgatgaggaaatgtctgctgatcctaaagtcttcttgatgggtgaagaggttggtgaataccagggtgcatacaagatttccaaagggcttttggagaagtatggtcccgagagagttcttgataccccaattacagaggctggctttgctggaattggagttggtgctgcttattatggtcttcggcctgttgtagagtttatgacatttaacttctctatgcaggcaattgaccacatcattaattctgctgcaaaatcgaactacatgtctgctggtcagatatctgtacctattgtttttagaggaccaaatggcgctgctgctggagttggtgctcagcactcccagtgttatgcagcttggtatagttcttgtcctgggttaaaagtgctggctccatactcatcggaagatgctcgtggcttgctaaaagctgctataagggatcctgatcctgttgttttccttgaaaatgagttgctatacggtgagtctttccctgtttctgcagaagttcttgattccagtttctgcttgccaataggaaaagctaagatcgaacgagaaggaaaggacgtgactattactgctttctcaaagatggtcggttatgctctccaggcagctgaaattcttgcaaaggaaggaatcagtgctgaggttataaatctgcggtcaatccggccactagatagacccacaatcaacacttctgtcaggaagaccaacaagctggtgacagttgaagaaggcttccctcagcatggtgttggcgccgagatctgtacatctattgttgaggagagctttggttatctcgatgcaccagtggaaagaattgctggagctgatgttccaatgccttatgctgcaaatctcgagaggatggccgtcccacaggttgaggatattgttcgtgcagtaagaagggcgtgctacagatcagttcccatggccgcatctgcataagctcaagtactgtagtgtgggtgttttagctaattttaatgtactttgttaggagactttgcgactttttttttccttattattttttaagtcctatcaatggagagcccagagcagcatagctgctagttggtttaccacatccaataatgctgggaaacgttaattcaggcccttgcaagcaaggttttgtaatatttt

SEQ ID NO: 4012 - DNA, 1622 bp, Citrus clementina
ttagaatattcgtgctcttcgtgtgggctgtgcgttgcaactttcaacctatttccctctccacggcgatcggatcgctgataactttcacttctggtaatctcgggcaggattttcattgaaacagagttgaagatgtggggaattattaggcagaaagtggctgctggaggaggttctcctgttgcgagaattcgccctgtggtatccaatttgagaaactactcatctgcagttaaacagatgatggtgagagaggctttaaactctgctcttgatgaggagatgtctgctgatcctaaagttttcttgatgggagaagaggttggggaatatcagggtgcttacaagatatccaaagggctattggagaaatatggccctgagagagttcttgataccccgatcactgaggctggttttactgggattggagttggtgctgcatactatggtttgaagcctgttgtggaattcatgacatttaacttctctatgcaggcaattgatcacatcattaattctgctgcaaaatcaaattacatgtcttctggccaaatatcggttcctattgtcttcagagggcctaatggtgctgctgccggagtgggtgcccaacactctcaatgttatgcagcatggtatgcctcagtccctgggttgaaagtactgagcccatacagttctgaagatgctcgtggactgctaaaagctgctataagggatccggatcctgttgtttttcttgaaaatgagttgttatatggtgagtcattcccggtatcagctgaagttcttgattccagtttttgccttccaattgggaaagctaaaattgagagagaaggaaaggatgtaactattacagctttctcaaaaattgtgggcctttcactcaaggcggctgagatacttgcaaaggaaggaataagtgctgaggttatcaatctgcggtcaattaggccactagatagatccacaatcaatgcttctgtcaggaaaactaacagactggtaacagtcgaagaagggttccctcagcatggagttggtgccgaaatctgtgcatccgttattgaggaaagcttcggttatcttgatgcaccagttgagagaattgctggagctgatgttccaatgccatatgcagccaatcttgagagaatggctgtcccacaggttgaagatattgtccgagctgccaagagagcatgctacagatctgtgccaatggctgctgcagcataaatgaactgattctgccctgaagctttgtcagatcctggaacaatagagggattgtacattttccccgttctcaacacttttttgggggaattgatcatgaaataattggagattgttgatgacagcaggaaattttgtggctcagttttctcttgttaatgtggaaaatcaacaagaaaccagagttttattgtttgattatcaatgtacttctacaagttttgtcagttacatgatatttcattaaatggtgcgtgaatctgagtcgtttgaattctttcttcggatttttgataattgtattgtcactgtgagaaaagagaaggtgatgtgggattacagaaataataaatttgatgcattgccaacaatcc

SEQ ID NO: 4013 - DNA, 1542 bp, Gossypium hirsutum
attttatatttattttaacgtagtagatgtagtagctgagctgaactcccccttttcattttcagccatctccttgccgattcattcctaagaaaattttcaacgttatttcaaaaagcagagaaaagaacgttaaggaggaaagatgttgggaatagtaaggcaaaaaatgttagggcagtcattgctgaagattcgtcctgcaatatcggtgttacgaagctactcatcagcagcaaaacagatgacagtgagagaggcattgaactctgctcttgatgaggaaatgtcagctgatccgaaagtctttttaatgggtgaagaggttggagaatatcagggtgcatacaagatatccaaggggcttttggagaagtatggacctgagagggttcttgatactccaattactgaggctggttttgctgggattggggttggtgcggcttactatggtctgaagcccgtagttgagtttatgacatttaacttctccatgcaggcgattgaccacattattaactctgctgcaaagtccaactacatgtctgctggccagatgtctgtacccattgtttttagaggacctaacggtgctgctgctggtgtaggtgcccaacactctcagtgttatgcatcatggtatgcttcttgtcctggattgaaagttctgtccccatacagttctgaagatgctcgtggactgctcaaagctgctattagagatcctgaccctgttgttttccttgaaaatgagttgttatatggtgaatcattccctgtttctgatgaagttcttgactccagcttttgtcttccagttgggaaagctaagatagagagaaaagggaaggatgtgactattacagctttttcaaaaatggtgggctatgctcttaaggcagctgagatacttgaaaaggagggaattgatgctgaggttataaatttgcgttctattaggccgctagatagatcaacaattaacgcttccgtcaggaaaaccaacagattaataacagttgaagaaggttttccacagcatggtgttggtgctgaaatctgtgcatcagttgtggaggagagttttgcttatcttgatgccccagttgagagaattgctggagctgatgttcccatgccatatgcagcaaatcttgagaggatggctgtgccacaggttgaagatattgtccgtgctgcaaagcgagcatgctacagagctgtaccattggctgctgctgcataattgaaccaatataggaactaaaggaatgcacgattgtttgtcctctcaactgttttgggaaggagccgtttcatttaataactgagacattgttggaaaggctggaaatttggtgacttcatttgtcatgtgaacataacctgttcaaccctgctgaagcccaagggctctgctactgtttttgaactcttgtgtttcaatcttacgtttgttcagctgaatgatttttaaatgcattgaattgatgttttgtttgagaattactaccaaagtagtaataaaataattaccat

SEQ ID NO: 4014 - DNA, 1623 bp, Euonymus alatus
gcaaataagcgaaataaacaaagactagtgggagtggcggctcttcttcgcgtctatttcacatctcgtcgtcgatcggatccggctccagcagcgttcttttaaagaagaagagatgtggggggttattagccaaaaggttttagcaaagtccctgcaacctcttcgtcctggagcatcagcatggagaggttttgcctctggaacgaaagagattaccgtgagagaggctctaaactctgcacttgacgaagaaatgtcagctgatcctaaggtctttttgatgggtgaagaggttggagaatatcaaggtgcatacaagatttccaaggggctattggacaagtatggccctgagagagttcttgataccccgattactgaggctggttttactggaattggagttggtgctgcatactatggtcttaagcctgttgtggagtttatgacgttcaacttctcaatgcaggcaatcgatcacatcataaattctgctgcaaaatcaaactatatgtctgctggccagatatctgtgccaattgttttcagaggacccaacggtgctgctgctggagttggtgcccaacattcgcactgttatgcagcatggtatgcctcttgccctggtttgaaagtgctatccccatattcatctgaagatgctcgtggactgctaaaagctgctataagggacccagatcctgttgtttttcttgaaaatgagttattgtatggtgagtccttccctgtttctgatgaagtatttgattccagcttttgcattccaataggggaagctaagattgagagagaaggaaaggatgtgacaattacagcattttcaaaaatggttggctatgcgctcaaggcagcagagacacttgagaaagagggaataagtgctgaggttataaatttgcgttccattaggccactggatagggccacaatcaattcttctgtcaggaaaactagcagactggtaacagttgaagaaggatttgctcagcatggtgttggtgccgaaatctgcacatctgtagttgaggacagctttggttatcttgatgccccagttgagagaatctctggagctgatgtttgcatgccatatgctgccaatcttgagagaatggctgtcccccaggtcgacgatatagtccgtgcagccaagagggcttgccacaggtctgtcccaatggctgcaactgcttaaaacacacttaactgtcctagctaccttttgaatccaggaaatggagtcattgtacattttccccctttgctggtcatcaaattactcgaagaaattaatttgttgagttacataaggaataatactactacagttaaaattcacgttttgattttcactggactactgttctagttctcctttcggagaagagctgttgctttgatttccactggactactgttctagttctcctttcggagaagagctgttgctgctctttccaaaattgtttttgtggttaatattttaatatactatttttccgtcactcatggggcatgctctgtgatattgtaagaaaatgcaggatcagctgacaatgtagttttgctttgagaatgaattcatggcccgaatgaact

SEQ ID NO: 4015 - DNA, 1133 bp, Tripterygium wilfordii
acagtccttgcaacaccttcgccctgcagcatcagcatggagaggttttgcctctgcaacaaaagagatgaatgtgagagatgccctaaactctgcccttgacgaagaaatgtcagctgatcctaaggtcttcttgatgggtgaagaggttggagaatatcaaggtgcatacaagattaccaaggggctattggacaagtatggccctgagagggttcttgataccccgattacagaggctggttttactgggatcggagttggtgctgcgtactatggtcttaagcctattgtggagtttatgacgttcaacttctcaatgcaggcaatcgatcacatcataaattctgctgcaaaatcaaactacatgtctgctggtcagatatctgtgccaattgttttcagaggacccaatggtgctgctgctggagttggtgcgcaacattcgcaatgttatgcagcatggtatgcctcttgtcctggtttgaaagtgctatccccgtactcatctgaagatgctcgtggactgctaaaagctgcaataagggacccagatcctgttgtttttcttgaaaatgagttattgtatggtgaatccttccctgtttctgatgaagtacttgattccagtttttgccttccaatagggaaagccaagattgagagagaaggaaaggatgtgacaattacagcattttcgaaaatggttgggtatgcgctcaaggcagcagaaacacttgagaaagagggaattagtgctgaggttataaatttacgttccattaggccattggatagggccacaatcaattcttctgtcaggaaaaccaacagactggtaacagttgaagaaggatttcctcagcatggtgttggggccgaaatatgcacatctgtagttgaggacagcttcgcttatcttgatgctccggttgagaggatctctggagttgatgttcccatgccatatgctgccaatcttgagagaatggctgtccctcaggttgaagatatagtccgtgcagccaagagagcttgctacagatctgtcccaatggctgcaactgcctagaacacacttaactgtcctagcaaccttttcaatccaggaaatggagtcattgcacatacta

SEQ ID NO: 4016 - DNA, 1616 bp, Citrus sinensis
cacgcgtccgtagaatattcgtgctcttcgtgtgggctgtgcgttgcaactttcaacctatttccctctccacggcgatcggatcgctgataactttcacttctggtaatccggattttcattgaaacagagttgaagatgtggggaattattaggcagaaagtggctgctggaggaggttctcctgttgcgagaattcgccctgtggtatccaatttgagaaactactcatctgcagttaaacagatgatggtgagagaggctttaaactctgctcttgatgaggagatgtctgctgatcctaaagttttcttgatgggagaagaggttggggaatatcagggtgcttacaagatatccaaagggctattggagaaatatggccctgagagagttcttgataccccgatcactgaggctggttttactgggattggagttggtgctgcatactatggtttgaagcctgttgtggaattcatgacatttaacttctctatgcaggcaattgatcacatcattaattctgctgcaaaatcaaattacatgtcttctggccaaatatcggttcctatcgtcttcagagggcctaatggtgctgctgctggagtgggtgcccaacactctcaatgttatgcagcatggtatgcctcagtccctgggttgaaagtactgagcccatacagttctgaagatgctcgtggactgctaaaagctgctataagggatccggatcctgttgtttttcttgaaaatgagttgttatatggtgagtcattcccggtatcagctgaagttcttgattccagtttttgccttccaattgggaaagctaaaattgagagagaaggaaaggatgtaaccattacagctttctcaaaaattgtgggcctttcactcaaggcggctgagatacttgcaaaggaaggaataagtgctgaggttatcaatctgcggtcaattaggccactagatagatccacaatcaatgcttctgtcagaaaaactaacagactggtaacagttgaagaagggttccctcagcatggagttggtgccgaaatctgtgcatccgttattgaggaaagcttcagttatcttgatgcaccagttgagagaattgctggagctgatgttccaatgccatatgcagccaatcttgagagaatggctgtcccacaggttgaagatattgtccgagctgccaagagagcatgctacagatctgtgccaatggctgctgcagcataaatgaactgattctgccctgaagctttgtcagatcctggaacaatagagggattgtacattttccccgttctcaacacttttttgggggaattgatcatgaaataattggagattgttgatgacagcaggaaattttgtggcttagttttctcttgttaatgtggaaaatcaacaagaaaccagagttttattgtttgattatcaatgtactgctacaagttttgtcagttacatgatatttcattaaatggtgcgtgaatctgagtcgtttgaattctttcttcggatttttgataattgtattgtcactgtgagaaaagagaaggtgatgtgggattacagaaataataaatttgatgcattgc

SEQ ID NO: 4017 - DNA, 1816 bp, Populus trichocarpa
aaaaaataaaaaagaaagaaaggaaaaggcaaagaaaaagagcaagtgaaagtggtggtggctgtttcgatcatcagatcccgctccaattgtgagaaaaaatttagtttgttaatttgttaatcgtcgccttaaacaaggtgttcttaggactgcattttttgaaagaaagaaagaaggaaagaagatgttggggattataaggcaaaaggcttttgggcagaggattcgccccgcggtatcggcatggagaggttattcatctgcagcaaaagagatgacagttagagaagcgctaaactctgcacttgatgaggaaatgtctgctgatcctaaggtttttttgatgggggaagaggttggtgaatatcagggtgcatataagatatccaaagggcttttggacaagtatggtcctgagagagttcttgatacaccaatcacagaggctggttttactggcattggagttggcgctgcttaccatggtcttaagcctgttattgagtttatgacattcaacttctctatgcaggcaattgaccacatcattaattcggctgcaaaatcaaactatatgtctgctgggcagatatctgtgcccatagttttcagagggcccaatggtgctgccgctggagttggtgcccaacactctcattgttatgctgcatggtatgcttcctgccctggtttgaaagtactggctccttactcatctgaagatgctcgtggtctgctaaaggctgccataagggaccctgatcctgttgttttccttgaaaatgagttattatatggtgagacattccctgtttctgctgaagtactcgactccagtttttgccttccaatagggaaagccaagattgagaaagaagggaaggatgtgaccattactgccttttcaaaaatggttggctatgctctcaaggctgctgagatacttgcaaaggaaggaatcagtgctgaggtgataaatttgcgatcaattaggccactagatagaaacacaatcaatgcttcagtcaggaaaactaacagactggtgacagttgaagaaggatttcctcagcatggtgttggtgctgaaatctgtgcatctgttgttgaagagagctttggttatcttgacgccccagttgagagaattgctggagctgatgttcccatgccttatgctgctaatctagagagattggctgtgccacaggttgaggatattgttcgtgcagcaaagagagcttgctacagatctgtgtaattggctgcagctgcttgatggtatactcattgaagtccagaaaccacatcctaaattcaggaatctcagagatgtgcatttccccccttgttactactggggaggaacagctcattgaataacatggagtgtgttgatgacagcgggaatttttgtcattgttttgttaaattggtacctgatacgaacccatttccacacataagccaagaattaaatttacttatggatttttatagagtgcattcttcttcgaaaggtctgttatgttttcaatttattttcatatgatcacttcgattccctttttcactaaaagctgaagaattacatgctgtttgtgacatcatcttgaagttttagaacccatcaatacatctgtataggaaatcaatgtgttctgggtgttactcgagtatattatgtgatatgcacgtatatgagaaaatcttgtgataaactgtgtactgtgtagtatcttttctagacaatcatttaatttagtcatttattgtaagctcgtaaataaaacatggatgaacttaattagtt

SEQ ID NO: 4018 - DNA, 1536 bp, Gossypium hirsutum
gagctgaactcccccttttcattttcagccatctccttgccgattcattcctaagaaaattttcaacgttattccaaaaagcagagaaaagaacgttaaggaggaaagatgttgggaatagtaaggcaaaaaatgttagggcagtcattgctgaagattcgtcctgcaatatcggtgttacgaagttactcatcagcagcaaaacagatgacagtgagagaggcattgaactctgctcttgatgaggaaatgtcagctgatccgaaagtctttttaatgggtgaagaggttggagaatatcagggtgcatacaagatatccaaggggcttttggagaagtatggacctgagagggttcttgatactccaattactgaggctggttttgctgggattggggttggtgcggcttactatggtctgaagcccgtagttgagtttatgacatttaacttctccatgcaggcgattgaccacattattaactctgctgcaaagtccaactacatgtctgctggccagatgtctgtacccattgtttttagaggacctaacggtgctgctgctggtgtaggtgcccaacactctcagtgctatgcatcatggtatgcttcttgtcctggattgaaagttctgtccccatacagttctgaagatgctcgtggactgctcaaagctgctattagagatcctgacccagttgttttccttgaaaatgagttgttatatggtgaatcattccctgtttctgatgaagttcttgactccagcttttgtcttccaattgggaaagctaagatagagagaaaagggaaggatgtgactattacagctttttcaaaaatggtgggctatgctcttaaggcagctgagatacttgaaaaggagggaattgatgctgaggttataaatttgcgttctattaggccactggatagatcaacaattaacgcttctgtcaggaaaaccaacagattaataacagttgaagaagggtttccacagcatggtgttggtgctgaaatctgtgcatcagttgtggaggagagttttgcttatcttgatgcaccagttgagagaattgctggagctgatgttcccatgccatatgcagcaaatcttgagaggatggctgtgccacaggttgaagatattgtccgtgctgcaaagcgagcatgctacagagttgtaccattggctgctgctgcataattgaaccaatataggaactagaagaatacacgattgtttgccctctcaattgttttggggaggagttggttcatttaataactgagacattgttggaaaggctggaaatttggtgacttcatttgtcatgtgaacataacctattcaaccctgccgaagcccaagggctctgctactgtttttgaactcttgtgtttcaatattatgtttgttcagtcgaatgatttttaaatgcattgatttgatgttttgtttgagaattactaccaaagtagtaataaaataattaccatacagccttggcctaacggtcgcctttacttc

SEQ ID NO: 4019 - DNA, 1538 bp, Gossypium hirsutum
atatttattttaacgtagtagatgtactagctgagctgaactcccccttttcattttcagccatctccctgccgattcattcctaagaaaattttcaacgttattccaaaaagcagagaaaagaacgttaaggaggaaagatgttgggaatagtaaggcaaaaaatgttagggcagtcattgctgaagattcgtcctgcaatatcggtgttacgaagttactcatcagcagcaaaacagatgacagtgagagaggcattgaactctgctcttgatgaggaaatgtcagctgatccgaaagtctttttaatgggtgaagaggttggagaatatcagggtgcatacaagatatccaaggggcttttggagaagtatggacctgagagggttcttgatactccaattactgaggctggttttgctgggattggggttggtgcggcttactatggtctgaagcccgtagttgagtttatgacatttaacttctccatgcaggcgattgaccacattattaactctgctgcaaagtccaactacatgtctgctggccagatgtctgtacccattgtttttagaggacctaacggtgctgctgctggtgtaggtgcccaacactctcagtgctatgcatcatggtatgcttcttgtcctggattgaaagttctgtccccatacagttctgaagatgctcgtggactgctcaaagctgctattagagatcctgacccagttgttttccttgaaaatgagttgttatatggtgaatcattccctgtttctgatgaagttcttgactccagcttttgtcttccaattgggaaagctaagatagagagaaaagggaaggatgtgactattacagctttttcaaaaatggtgggctatgctcttaaggcagctgagatacttgaaaaggagggaattgatgctgaggttataaatttgcgttctattaggccactggatagatcaacaattaacgcttctgtcaggaaaaccaacagattaataacagttgaagaagggtttccacagcatggtgttggtgctgaaatctgtgcatcagttgtggaggagagttttgcttatcttgatgcaccagttgagagaattgctggagctgatgttcccatgccatatgcagcaaatcttgagaggatggctgtgccacaggttgaagatattgtccgtgctgcaaagcgagcatgctacagagttgtaccattggctgctgctgcataattgaaccaatataggaactagaagaatacacgattgtttgccctctcaattgttttggggaggagttggttcatttaataactgagacattgttggaaaggctggaaatttggtgacttcatttgtcatgtgaacataacctattcaaccctgccgaagcccaagggctctgctactgtttttgaactcttgtgtttcaatattatgtttgttcagtcgaatgatttttaaatgcattgatttgatgttttgtttgagaattactaccaaagtagtaataaaataattaccata

SEQ ID NO: 4020 - DNA, 1753 bp, Phaseolus coccineus
  misc_feature (598)..(598): n is a, c, g, or t
ggggtttttggtttggttcatacttgtttgtgtgggtagcgttaggctagtgacgatcggatctagctacagctacagctacagataaaagaagcaagatgtggggtgtaataaggcaaaagactcagagcattcgcccagccttctccgctatcagacatttttcttctgccgccaaggagatcactgttcgagaggctctcaacaccgcactcgatgaggaaatgtcagctgatcctaaagtcttcttgatgggtgaagaggttggggaatatcagggtgcatacaagatatccaaggggctgctcgacaagtatggccctgatagggttctcgatactccaatcactgaggctggttttgctggtattggagttggtgctgcttactacggtctaagacctgttgtggagtttatgacttttaacttctccatgcaggcaatagaccatattattaattctgccgcaaaatccaattacatgtctgctgggcaaatatccgtacctattgtctttagaggacccaatggtgctgccgctggggttggtgcccagcattctcaatgttatgcatcttggtatgcttcatgccctgngttgaaagtcctgacaccatattcatctgaagatgcacgtggtttgcttaaagctgctataagggaccctgatcctgttgttttccttgaaaatgagttgctatatggtgagtcattccctgtttcggctgaagttcttgattccagtttttgccttcccataggaaaagcaaagattgagagggaaggaaaagatgtgactattacagcttattcaaaaatggttggctttgctctcaaggctgccgagatactggctaaagaaggaatcagtgctgaggttattaatttgcgttcaatccgaccgctggatcgctccacaatcaatacttctgtcaggaaaaccaacaggctggtgacagttgaagaagggtttcctcagcatggtgttggggctgaaatctgcacatctgtcattgaggagagttttggttatcttgacgcaccggttgagagaattgctggggctgatgttcctatgccatacgcagctaatctggagagaatggctgtcccacagattgaagatattgttcgagctgcgaagagagcatgccacagatcggtgccattggctgcagctgcttgaaagttgtggaaaacttcgtgtcctctattaatccttgatgtaccaaaaacaatttttcccccaatttccaccataaaacagcaggaagaaatttcaaccaaagaatgctggttttaactcgtgggttataccaggctttggtttaaaaattctgttgtatagtcctaattttcaggactcacagatgccatacatttttcccccttctcagccagcatatatatggaggatgttaatacttaataacttggaaaacaatgacacagggcgggaagtcttctgtgttttgggtttctgtttggcaataactaagtactcaattttttgaatacattatcgagtttctttttctttccagtggaccacttcttgtaagatctagcttactgttttgattcatttccgtttactgttttagttacattggcatgatagagatatttgatttgatgtgaggttcgtgtccttgaggagaacaaggctgtggttacctggttgtgttgtggatggtgtttggtctgtaagtctccgtgaacccccaaacttatatacataccttttttctc

SEQ ID NO: 4021 - DNA, 1502 bp, Chelidonium majus
tctctctctagctttttctctgcaaccaaatcccccaaattccatcgctttccactactaaaagaataccaggttgatcttgagaagaagaagaaggaaggatgttgggagttttaaggcaaaaagtcggttgcagatgcaatcctgcatcgattctagggcagtctatgccgaagacttggtctgcgacaagaagcttttcatcggcagcaaaacagatgactgtgcgagatgctctaaactctgcccttgatgaggaaatgtcggctgatccaaaagtatttttgatgggtgaagaggttggtgagtaccagggtgcatacaagattactaaaggtttattggacaagtatggtcctgagagggttcgcgatacaccaattacagaggctggttttactggaattggagtgggcgcagcttactatggtcttcgtcctgttgtagagtttatgacgttcaacttctccatgcaggcaattgatcacatcatcaattctgctgcaaaatcaaactacatgtctgctggtcagataaatgtacctattgttttcagagggccaaatggtgctgctgctggggttggcgctcaacactcccagtgttatgcagcatggtatggttcatgtcccggcttgaaagtgctggctccatactcagctgaggatgctcgtggcctgctaaaagctgctattagggacccagatcctgttgttttccttgaaaatgaattgctatatggagaatctttcccggtttcagaagaagttcttgattctagttactgtcttccaataggaaaagctaagattgagcgagaaggcaaggatatcactattacagccttctcaaaaatggttggtttcgctctgcaagctgcagagatcctctcaaaggaaggaataagtgctgaggttataaatctgcgttcgattcgaccactggatcgacagacaatcaatgcttctgtcaggaagaccaacagattagtgactgttgaggaaggctatcctcagcatggtgtcggagccgagatctgcgcatctgttgttgaggaaagctttgcgtatcttgatgcacctgtggagaggattgccggtgctgatgtccccatgccttatgctgcaaaccttgagagaatggctgttccacaggtcgaggatatcgttcgtgcagccaagaggatatgctacagatcagttccagtggccgctaatgcttaagcagtgggcgtactgagcatttttttgttctttgttttaagagtgtcttcatgaatttcttcctctctacctggaagagtagggaccctcttttgctcctcttaagagaaaggcagtttaacatgattttttcctcaataaatcatggttggagaacttctcattcgctgttatcatattcagagaaggcggaaataatcattctgacttgtagcttttacgtatcggcttactgtgtttttatttaatgtccatatattccattaaagttgtggatca

SEQ ID NO: 4022 - DNA, 1620 bp, Citrus sinensis
ttagaatattcgtgctcttcgtgtgggctgtgcgttgcaactttcaacctatttccctctccacggcgatcggatcgctgataactttcacttctggtaatctcgggcagggttttcattgaaacagttaaagatgtggggaattattaggcagaaagtggctgctggaggaggttctcctgttgcgagaattcgccctgtggtatccaatttgagaaactactcatctgcagttaaacagatgatggtgagagaggctttaaactctgctcttgatgaggagatgtctgctgatcctaaagttttcttgatgggcgaagaggttggggaatatcagggtgcttacaagatatccaaagggctattggagaaatatggccctgagagagttcttgataccccgatcactgaggctggttttactgggattggagttggtgctgcatactatggtttgaagcctgttgtggaattcatgacatttaacttctctatgcaggcaattgatcacatcattaattctgctgcaaaatcaaattacatgtcttctggccaaatatcggttcctatcgtcttcagagggcctaatggtgctgctgccggagtgggtgcccaacactctcactgttatgcagcatggtatgcctcagtccctgggttgaaagtactgagcccatacagttctgaagatgctcgtggactgctaaaagctgctataagggatccggatcctgttgtttttcttgaaaatgagttgttatatggtgagtcattcccggtatcagctgaagttcttgattccagtttttgccttccaattgggaaagctaaaattgagagagaaggaaaggatgtaactattacagctttctcaaaaattgtgggcctttcactcaaggcggctgagatacttgcaaaggaaggaataagtgctgaggttatcaatctgcggtcaattaggccactagatagatccacaatcaatgcttctgtcaggaaaactaacagactggtaacagtcgaagaagggttccctcagcatggagttggtgccgaaatctgtgcatccgttattgaggaaagcttcggttatcttgatgcaccagttgagagaattgctggagctgatgttccaatgccatatgcagccaatcttgagagaatggctgtcccacaggttgaagatattgtccgagctgccaagagagcatgctacagatctgtgccaatggctgctgcagcataaatgaactgattctgccctgaagctttgtcagatcctggaacaatagagggattgtacatttttcccattctcaacacttttttgggggaattgatcatgaaataattggagattgttgatgacagcaggaaattttgtggctcagttttctcttgttaatgtggaaaatcaacaagaaaccagagttttattgtttgattatcaatgtactgctacaagttttgtcagttccatgatatttcattaaatggtgcgtgaatctgagtcgtttgaattctttcttcggatttttgataattgtattgtcactgtgagaaaagagaaggtgatgtgggattacagaaataataaatttgatgcattgccaacaatcc

SEQ ID NO: 4023 - DNA, 1704 bp, Malus domestica
tcaatatttttccatttgagtggctggtttggtaaaaaaaataaaataaaaaaaaaataaattaagagggacaaccagccacaaaggaaataaaaagtcgaaaatattgaatagtattaagcgattgaaggaaagtgttggctgctgctgctccgctcccccgacgctcattttttacacatcgcatcgtcgatccgatccccgctccaatccgccaaacagtgtaattttgtgtgaaagaatcaaagatgttgggaattttaaggcaaaaagtgggagctggaagctcatcagctatgattttggggcagaggatccgccccgccacgtcggcaatgaggggtttagcatcttcggcgaaagagatgacagtgagggatgctctaaactctgcgctcgatgaggaaatgtccgcggacccaaaagtgtttttgatgggtgaagaggttggggaatatcaaggtgcttacaagataaccaaaggacttctggacaagtatggccctgacagggttcgtgataccccaatcaccgaggctgggtttacagggattggagttggtgctgcttactatggtttgaaacctgttatagagtttatgacctttaacttctcaatgcaggcaattgaccacatcatcaattctgctgcaaaatcaaactatatgtctgctggccaaataaatgtgcccattgttttcagaggaccaaacggtgctgctgctggtgttggtgcccagcattctcaatgttatgcagcatggtatgcaacctgccctgggttgaaagttttgactccttattcgtctgaagatgctcgtggactcttaaaagctgccatcagggaccctgatcctgttgttttccttgaaaatgagatattatatggtgagtcatttcccatttcagctgaagttcttgattccagtttttgcctcccaattggaaaagctaagattgagagagaaggaaaggatgtcactattacagctttctcaaaaatggttggctattctctacaggctgctgagatactcgctaaggaaggaatccgtgctgaggtcataaatttgcggtcaattcgtcctctcgacaggaaaactatcaatgattcagtcaggaaaaccaacagactggtgacagttgaagaagggtttcctcagcatggtgttggtgctgaaatctgcgcatctgttgttgaggatagctttggttatcttgatgcaccggttgagagaattgctggggctgatgttcccatgccttatgcagccaatttggagcgactggctgttcctcaggtcgaagatattgttcgtgcagcaaagagagcatgctacagagcttcctcattggctgcaagtgcttaattttaccacctcaacgcagaaatatctccggattgaggaagtatagagactgtacattatttctctcctcatcctctctggggaggaactgcttgtcaaataactggtagaagagcatcctgtgcggggaagaagtgcttgtcaaataacttgggagaacattgacaagggcgagagtatttttttgactgttttgtttatatgtgtggctatccacattaaaaccgattgtgttttggaagccattttgtgggtttcatgtacttgaatttctgaaccacaccattttgttccggcaaacatcaatgtccgctgcttcagtgtttcccttcca

SEQ ID NO: 4024 - DNA, 1715 bp, Malus domestica
tcaatatttttccatttgagtggctggtttggtaaaaaaaataaaataaaaaaaaaataaattaagagggacaaccagccacaaaggaaataaaaagtcgaaaatattgaatagtattaagcgattgaaggaaagtgttggctgctgctgctccgctcccccgacgctcattttttacacatcgcatcgtcgatccgatccccgctccaatccgccaaacagtgtaattttgtgtgaaagaatcaaagatgttgggaattttaaggcaaaaagtgggagctggaagctcatcagctatgattttggggcagaggatccgccccgccacgtcggcaatgaggggtttagcatcttcggcgaaagagatgacagtgagggatgctctaaactctgcgctcgatgaggaaatgtccgcggacccaaaagtgtttttgatgggtgaagaggttggggaatatcaaggtgcttacaagataaccaaaggacttctggacaagtatggccctgacagggttcgtgataccccaatcaccgaggctgggtttacagggattggagttggtgctgcttactatggtttgaaacctgttatagagtttatgacctttaacttctcaatgcaggcaattgaccacatcatcaattctgctgcaaaatcaaactatatgtctgctggccaaataaatgtgcccattgttttcagaggaccaaacggtgctgctgctggtgttggtgcccagcattctcaatgttatgcagcatggtatgcaacctgccctgggttgaaagttttgactccttattcgtctgaagatgctcgtggactcttaaaagctgccatcagggaccctgatcctgttgttttccttgaaaatgagatattatatggtgagtcatttcccatttcagctgaagttcttgattccagtttttgcctcccaattggaaaagctaagattgagagagaaggaaaggatgtcactattacagctttctcaaaaatggttggctattctctacaggctgctgagatactcgctaaggaaggaatccgtgctgaggtcataaatttgcggtcaattcgtcctctcgacaggaaaactatcaatgattcagtcaggaaaaccaacagactggtgacagttgaagaagggtttcctcagcatggtgttggtgctgaaatctgcgcatctgttgttgaggatagctttggttatcttgatgcaccggttgagagaattgctggggctgatgttcccatgccttatgcagccaatttggagcgactggctgttcctcaggtcgaagatattgttcgtgcagcaaagagagcatgctacagagcttcctcattggctgcaagtgcttaattttaccacctcaacgcagaaatatctccggattgaggaagtatagagactgtacattatttctctcctcatcctctctggggaggaactgcttgtcaaataactggtagaagagcatcctgtgcggggaagaagtgcttgtcaaataacttgggagaacattgacaagggcgagagtatttttttgactgttttgtttatatgtgtggctatccacattaaaaccgattgtgttttggaagccattttgtgggtttcatgtacttgaatttctgaaccacaccattttgttccggcaaacatcaatgtccgctgcttcagtgtttcccttccaaaaaaaaaaaa

SEQ ID NO: 4025 - DNA, 1368 bp, Primula obconica
ccaaaagggtttgtgctgagctatttaattaggacaaaaagatgttagggtttgtcaaacaaacaattgccaatggaggatttaattcttcgaagattcggtctcgatcgtttctcaacgctgttaggggttatgcttccgcaggaaaagagatgacagtgcgagatgctttgaattccgcccttgatgaggagatgtctgcggatcctaaagtatttgtaatgggtgaagaggttggtgaatatcaaggggcttacaagatcaccaaaggccttttggataagtacggacctgatagggtcatcgatacacctattacggaggctgggtttactggaatcggagttggtgctgcttaccatggtctgaggcctgtcatagaatttatgacattcaacttctctatgcaggctatcgaccacatcatcaactctgcggcaaaatcaaactacatgtctgctggtcagataaatgtacctattgtgttcaggggaccaaatggagctgctgctggagttggggcccaacactcacagtgttatgcagcatggtatggttcagttccaggattaaaggtcctggctccatactcagccgaagatgctcgaggcctgctaaaagctgccataagggaccctgatccagttgttttccttgaaaacgagttgttatacggagagtccttccctgtttcacaagaagttcttgattctagtttctgtcttcctattggaaaggctaagatagaaagagaaggaaaggatgttacaattactgcgttctcaaagatggttggttacgctctcaaggctgccgaaatccttgcaaaggaaggaattagcgctgaggttataaatttgcgctcaattcgcccgctggatagatcaactatcaatgcctcggtcaggaaaaccaatagacttgtaactttagaagaaggttacctcaacatggtgttggtgctgagatttgtgcatctgttgttgaggagagttttgagtatcttgatgctcctgtagagaggatttctggtgcagatgttcccatgccttacgctgcaaatcttgagaggatggctgtcccacagatagaagatgttgtacgggctgcgaagagagcatgctacagagccgtttaatggctgcgactgcttaagtttatctgaattaatttgtgaagttgttctcccatcaatttattccgaaattattggcaatctacgtttttgcgctctgacccccttctctttgttttctctcctttcatttcgtccctttttgcggagttgctgtgaccttgatttgaatgcctactctcatagagaaacatataaaatagcccttttgaatgtggaaaataaagggtttt

SEQ ID NO: 4026 - DNA, 1558 bp, Fragaria vesca
  misc_feature (881)..(881): n is a, c, g, or t
  misc_feature (892)..(892): n is a, c, g, or t
  misc_feature (994)..(994): n is a, c, g, or t
  misc_feature (1026)..(1026): n is a, c, g, or t
  misc_feature (1104)..(1104): n is a, c, g, or t
  misc_feature (1183)..(1183): n is a, c, g, or t
cgccgatccgatcccaactccaacccgccaccaagtgagtgttttctgtgactttgagccctagtagacgaagatgttggggattttaaggcaaaaactgggagctgcgagctcttccgctacgatgctggggcagttgcagaggatccgccccgccgtttcggcactgagaggcttctcttcttctgcgaaagagcaaatgacagtgagggatgctttgaactctgccctcgatgaggaaatgtctgccgatccgaaagtgtttattatgggtgaagaggtcggggagtatcaaggtgcttacaagataaccaaaggacttctggataagtatgggcctgacagggttctcgataccccaatcacagaggctgggtttactggaattggagttggtgctgcctactatggtctgaaacctgttatagagttcatgaccttcaacttctctatgcaggcaattgaccatatcatcaattctgctgcaaaatcaaattacatgtctgctggtcaaataaatgtgccaattgtgttcagaggtccaaatggtgctgctgctggtgttggtgcccagcactctcaatgttatgcagcatggtttggtgccgtccctgggttgaaagttttggccccttattcatctgaagatgctcgtggactgctaaaagctgccattagggaccctgatcccgttgtttttcttgaaaatgagttgctatatggtgaatcatttcctatttctgctgaagtacttgattccagtttttgccttccaataggaaaagctaagatcgagagagagggaaaggatatcaccattacagctttttcaaaaatggtcggctatgctctacaggctgctgagattcttgctaaagaangaattagtgcngaggtcataaacttgcggtcaattcgtcctctggacagggctaccatcaacgcttcagttaggaaaccaacagacttttaacagttgaagaaggatttcctnagcatggtgttggtgctgaaatctgtgcatcngttgttgaggagagctttggttatcttgatgcgcctgtcgagaggattgcaggggctgatgttcccatgccttatgcngccaatttggagagattggctgttcctcaggttgaagatattgttcgagctgcaaagagagcgtgctacagagctgtgncattggctgcaaatgcttagttttaccctttaaatgcagaaacttctctggaatgaggagttacagagattgtacattatttctcttctcatcctgtgtggggagaaactgcttgtcaaataactgggagatccatcctgcgcgaggaactgctcggtcaaataactcggaggacattgacagagagcgaggacattttttgactctattttgtttaatctttgtggctgtcaacattgaaacctgttgggtttatggaagccattttatgggttatctactggaaaccacaaattttattccacaaaggtttatggtggtgcttcattgtttatttcatgatgattttggtccaaaaacatataaaaaaaaaaa

SEQ ID NO: 4027 - DNA, 1450 bp, Tropaeolum majus
tagatcgaatcccaacaccgaactcggattcagaagaaagcaaacaagtttgtctttcagttaagaaaaggaggaaaagatgttgggaggaatcgcaaggcagaagatgttggggctgtcggtacagaagatacgtcctgcaggttatgctttcaggaatttttcatcggcagggaaagagatgacggtcagagaggcactgaactctgcgcttgatgaggaaatgtctgcggatcctaaagtctttttgatgggcgaagaggttggggaatatcaaggtgcctacaagataaccaaagggcttttggacaagtatggtcctgaaagggttctcgacacaccaattactgaggctggatttactggaattggagttggtgctgcttactatggtcttaaacctgttgtggagttcatgacattcaacttctctatgcaggcgatcgaccacattattaattctgctgcaaaatcaaactatatgtcagccggccagattaatgtgcccattgtatttcgaggacctaatggtgctgctgctggagttggtgcccaacactctcattgctatgctgcatggtacggctcttgcccaggcttgaaagtgctgacaccgtactcatctgaagatgctcgtggattgctaaaagctgctattagggaccctgatcctgtcgttttccttgaaaacgagttgttgtatggtgagtcgttccctgtttctgccgaagttcttgattctagttactccaccccgattgggaaagctaagattgagagagaaggaaaggacgtgacaatcactgctttctcgaaaatggtgggattttctttgaaggcagcagagatccttgcaaaggaaggaattagcgctgaggttataaatttgcgatcaattaggcctcttgatagagccacaatcaacgcctcagtcaggaaaaccaacagattagttacagtcgaagagggttttcctcagcatggtgttggtgctgaaatctgtacatctgtcatcgaagaaagttttggttatcttgatgcacctgttgagaggattgctggagcagatgttcccatgccttatgcagccaatcttgagagattggctgtcccacaggttgaagatatcgtccgtgctgctaaaagagcttgctacaggtcctctgtaccaatggcagcggctgcctaattgtactcatcccacaggcttggaaaggattgcaattttttttgtagcggaataatgtagaaatggttacagaaggatgtttttgggctctattttgttgcataattttgggtctatcttgatccaaactcgctctgcttttgggcgaaaagtttgtttctcataaaactaataagaaaactgttgtcacgacatcgttatagttcggaaagaaagagttttatcatggactcatgtttctctctaattcaatgatatttg

SEQ ID NO: 4028 - DNA, 1161 bp, Euphorbia esula
  misc_feature (533)..(533): n is a, c, g, or t
  misc_feature (584)..(584): n is a, c, g, or t
  misc_feature (672)..(672): n is a, c, g, or t
  misc_feature (698)..(698): n is a, c, g, or t
  misc_feature (732)..(732): n is a, c, g, or t
  misc_feature (1144)..(1144): n is a, c, g, or t
cttccctatccgatcaactgagacaagtatttcagtagaagagaagaagtagaagaacgatgctggggattataaggcaaaaagcttttgggcagtcgcttcagaagattcggcctgccgctgcagcatggagaagcttctcatcggcctctaaagagatgacagttagagaggcacttaactctgctcttgatgaggaaatgtctgctgatcctaaagtgtttttgatgggagaagaggttggggaatatcagggagcatataagataactaaagggcttttggataagtatggtcctgaaagagttcttgataccccaattactgaggctggatttaccggaattggagttggtgctgcttaccatggtctgaagccagttgttgagtttatgacatttaacttttctatgcaggctattgaccatatcataaattcagctgcaaaatcgtgctatatgtcttctggccagttatctgtacccatagttttcagaggacctaatggagctgccgcaggagtcggtgcccancactcccaatgttatgcggcatggtatgctgcctgccctggcttgaaagtnttggctccttactcagcagaggacgctcgtggacttttaaaagcagcaataagagaccctgatcccgttgttttccttgaaaacgagntactgtatggtgagtcatttcctatntcagatgaggtgctggactccagtttttgcgtcncaatcggaaaagccaagattgagagagaaggaaaggatgtgactatcacagctttctcaaaaatggtgggctatgctcttaaggcagctgagatacttgcaaaagaaggaatcagtgcagaggtgataaatttgaggtcaattaggccgctagatagacctgcaatcaatgcttcagtgcggaaaaccaacagactggtgactgttgaggaaggattccctcagcatggtgttggcgctgaaatttgtgcatctattgttgaggagagcttcgggtaccttgatgcacctgttgagagaattgctggagccgatgttcctatgccttatgcgccaatcttgagagattggcagtgccccaggttgaggatattgtgcgtgcagcaaagagggcttgctatagatctacacanatggctgcagctgctta

SEQ ID NO: 4029 - DNA, 1612 bp, Vigna unguiculata
ggggaagggcaagagaaaaagggtgtgggttgtttggtttggttcatacttgtttgtgtgggtatcatcaggctactggggatcggatccagctacagttacagatcaaagaagaaagatgtggggtgtaataaagcacaagactcagagcattcgccctgccttctccgctatcaggcatttttcttctgccgccaaagagatcactgttcgagaggctctcaacaccgcactcgatgaggaaatgtcagctgatcctaaagtcttcttgatgggtgaagaggttggggaatatcagggtgcatacaagatatccaaggggctgctcgagaagtatggccctgagagggttctcgataccccaatcactgaggctgggtttgctggtattggagttggtgctgcttactatggtctaaggcctgttgtggagtttatgacttttaacttctccatgcaggcaatagaccatattattaattctgctgcaaaatccaattacatgtctgctgggcaaatatctgtacctattgtttttagaggacccaatggtgctgctgctggggttggtgcccagcattctcaatgttatgcatcttggtatgctacatgccctgggttgaaagtcctaacaccgtattcatcagaagatgcacgtggtttgcttaaagctgctataagggacccagatcctgttgtttttcttgaaaatgagttgctgtatggtgagtcattccctgtttcagctgaagctcttgattccagtttttgccttcccataggaaaagcaaagattgagagggaaggaaaagatgtaactattacagcttattcaaaaatggttggctatgctctcaaggctgctgaggcactggctaaagaaggaatcagtgctgaggttattaatttgcgttcaatccgaccgctggatcgggccacgatcaatacttctgtcaggaaaaccaacaggctggtgacagttgaagaagggtttcctcagcatggtgttggggctgaaatctgcacatctgtcattgaggagagttttggttatcttgacgcaccggttgagagaattgccggggctgatgtccctatgccatacgcagctaacctggagagaatggctgtcccacagattgaagatattgttcgagctgcgaagagagcatgccacagatcggtgcctttggctgcagctgcttgaaagttctgaaaaaatttcacgtcctgattagttctttggtaatccttgatgtaccaaaaacaatttttccccaaatttccaccataaaacagcaggaagaaattacaaccaaagaatgctggttttaactcgtgggttatgctaggctttggttcaaaaattctgttgtatattcctaattttcaggactcacagatgccatacattttttccccattctcagccagcatatatatatatgggaggaagttaagtttaataacttggaaaacaataacacagggcgggaagtcttctgtgttttggtttctgattggcaataactaagtagtcaattttttgaatacattgtcgagtttctttccagtggaccagttctatgcaagatctagcttacttttttta

SEQ ID NO: 4030 - DNA, 1931 bp, Arachis hypogaea
gggatttggtgtggcttcattccatttggcgagcggagatcggaatcggattctatcagacacagagagatcgacgcgggcttgcttcgtttcaacatagcaagatgttgcgtgctataaggcataagaatattctacctgccttctctgcatttagagctttctcttcttctgctaaagagatgacagttagagaggctctgaactctgctcttgatgaggaaatgtctgctgatcctaaagtcttcttgatgggtgaagaggttggggaataccagggtgcatataagattactaagggacttctggacaagtatggtcctgaaagggttcttgatactccaattaccgaggctggatttactggcattggagttggtgctgcttactatggtctaaggccggttgtcgagtttatgacttttaacttctccatgcaggcaatagatcacattattaattctgctgcaaaatcaaactacatgtctgctgggcaaatatctgtacctattgtcttcagaggacccaatggagctgctgctggagttggtgctcagcactctcaatgttatgcagcttggtatgcttcatgcccgggattgaaggtattgtcaccatattcatctgaagatgctcgtggtttgctaaaagcggctataagggaccctgaccctgttgtttttcttgaaaatgagttattatatggtgaatcattccctgtttcagccgaagttcttgattccagtttttgccttcccataggaaaagcaaagattgagagagaaggaaaagatgttactattacagccttttcaaaaatggttggctatgctctcaaggctgcagagatactggcaaaggaaggaatcagtgctgaggttataaatctgcgttccattcggccgcttgatagatccacaattaatgcttcagtcaggaaaaccaatagattggtgacagttgaagaaggatttcctcagcatggtgttggcgccgaaatttgcacctctgtaatcgaggagagttttggttatcttgatgcaccggtagagagaattgctggggccgatgttcccatgccttatgcagccaatttggagagaatggctgtcccacaggttgaagatattgttcgtgccgcaaagagagcatgttacagatctgtgcccttggctgcaacagcttgagttttattgaggactggaaatttctctcatgtcttggttatgctaagttcttcggtaatcctagatgttaccaaaaaaattttttcccctccatatttcaccataaaacagcagaaagaaatagcaagtggagagtgctggtttcacttatggactacataggcgttggtttaaaatattctgattcatgatgtatacttaatagtgcagccttaattttcacgagttacagatggtatataataatggcaagttaaacatccatacgcatggatcctacgtgtcctagtctcctagatgttctcttcgacgcctctggtatctctgcttttgcagggtttcgtgaagcccgaacgaggcagtaatagactaatagtaggtgcctaggtggtgttttttttttttggtcatggtgcctaggtggtgtttggttggttcagcatttgtttgggattactgcggctaagaaaagttgattagcaagctttttggttgatgggccgaaaagtgtctaatgggttactttcaattttttattgtgtggataaccggtgggaatgagtattgtttggataaccggtgggaatgagtaattgttgccaaaatcatgtgtgaagaggctttggagggcctttatgtttgagttgccggaaaaaggatgagtgatgtgaccaagaaaatataataagtgtcacaaggaactcgtaaaatattaaattcaatgggtttcttgcttgtataaaa

SEQ ID NO: 4031 - DNA, 1833 bp, Vitis vinifera
aacggacggcgcagaggacaaagaaaaagggatcaagccaccctccaaaacggtgtcgtttggaccatcactgcaccgttcgccctatacctagcggaccaaactctccggcgaagctcagcgcgggttcgatcggaggaagcgaagatgttggggattgtgagtcggaaggttttggggcagtcgttggggaggattaggcctgcggtgtcggcattgaggaactactcgtctgcggaaaaacagatgacagtgagggatgctctaaactctgcacttgatgaggaaatgtccgcagatcctaaagtctttttgatgggtgaagaggtcggggaataccaaggtgcatacaagatttctaaagggcttttggagaaatatggccctgagagggttctggataccccaatcacagaggctgggtttactgggattggagttggtgctgcttactatggtcttaagcctgttgtagagttcatgacatttaatttctctatgcaggcaattgaccacatcattaattctgccgcaaaatcaaactacatgtccgctggtcagatatccgtacctattgtttttagaggaccaaatggtgctgcggctggagttggtgcccagcactcccagtgttatgcagcctggtatggctcctgccctgggttgaaagtgctgtccccatattcatctgaggatgcccgtggattgctaaaagctgctataagagaccctgatcctgttattttccttgaaaatgagttgctgtatggtgaatctttccctatctcagcagaagttcttgattccagtttttgcctcccaatagggaaagccaagattgagagagaaggaagggatgtgactatcacagctttctcaaaaatggtgggctttgcactcaaggctgctgatattcttgcaaaggatggaatcagtgctgagattataaatctgcgttcaattaggcccctggacacacccacgatcaatgcctcagtcaggaaaactaacagacttgtaaccgttgaagaagggttccctcagcatggtgttggggctgagatctgcatggctgttgttgaggagagctttggttatcttgatgcaccagtggaaaggatcgccggggctgatgttcccatgccttatgctgctaatctcgagagaatggctgtcccacagattgaagatatcgtccgagctgcaaagagagcatgctacagatccactgcaatggctgcaactgcttgacatcttccaagattagttcagatacatatccaactctaggtaggaaggaaatggttgttaaataactcgagaaacactggacagaggcgggaattttaggactcttgttttggtttttgttaatacagcaaccaacatgaatcctctttgggcagctgcatatctcaacttcctctttcgggtcttctggaaaggccccccaccccaccttgctactgttgatttgtttgtcttacaataaagttttgttcaatttgatgaacagctcattcaaatgatgaaatggttcttttttctccctttatttcgcgaaaaatgctctttgaatttggctttttggaagccgaaaaggtggtttttaaaagaccatagcagcttttgtatgtgggtaatttgaagaagtttgtggttaatttgaagggtcattctatggcaccgatgtttctcggtgttatacaaaaaagtggcggccaatcatgaaaggtcaaaattacagaaatgattttatttgttggtagaaatcttattcatttatttgtatttatatctcatttttttaatttttatttctagttcatatca

SEQ ID NO: 4032 - DNA, 1628 bp, Theobroma cacao
agctagtgtattattagcttagctgagcttccccctctttgcttctctccattctttttggccatctccttgccggttaatttccttataaataaaaacctatttccaaactccattttttttttacatcatttgagaaacaggaaaagccaagtgaaggaggaaagatgttgggaatcgtaaggcaaaaggttttggggcagtcactgcagaaggttcgaccgggagtgtcgctattgagaagttactcatctgcagcaaaacagatgacagtgagagaagctttaaactctgctcttgatgaggagatgtcggctgatccgaaagtctttttgatgggtgaagaggttggagaatatcaaggtgcttacaagatatccaaggggcttttggagaagtatggacctgagagggttcttgatactccaattactgaggctggttttactgggattggggtcggcgctgcttactatggtctgaagcctgtggtggagtttatgacatttaacttctccatgcaggcaattgatcacattattaactctgctgcgaagtccaactacatgtctgctggccagatatctgtacccattgtttttagaggacctaatggtgctgctgctggtgttggcgcccaacactctcagtgttacgcagcatggtatgcttcttgtcctggattgaaagtgctgacaccatacaattctgaagatgctcgtggactgctcaaggctgctattagagatcctgacccagttattttccttgaaaatgagttgttatatggtgagtcattccctgtttctgatgaagttcttgattccagtttttgccttccaattgggaaagctaagatagagagagaaggaaaggatgtgactatttcagctttttcaaaaatggtgggccatgcacttaaggcagctgagatacttgaaaaggatggaattgatgctgaggttatcaatctgcgttctatcaggccgctagatagatccacaatcaacacctcagtcaggaaaaccaacagattaataacagttgaagaagggtttcctcaacatggtgttggtgctgaaatttgtgcatctgtagttgaggagagttttggttatcttgatgcacctgttgagagagttgctggagctgatgttcctatgccatatgcagcaaatcttgagagaatggctgtgccacaggttgaagacattgtccgtgctgccaagagagcatgctacaggtctgtaccattggctgctgctgcataattgaaccgatccaggaattagagggatatgatattttttgccttctcaacacttctggggaggagctgcttcatttaataactgggagatcgttagaaatggcgggaaattttgtgacattatttgtcatgtgaacataacctgttcaatccttggaagtcgattttatgtttttcctctttatctggtgcacgccctctggaaagggctctgctactgtttctgaccatgtgtttcaatcttatttttgttcagtttgataatttttgaaagcattgatttgatttggtattacaagattaccaaataatgataaaggataactacaggttaagttaataatgtagatcttgtagt

SEQ ID NO: 4033 - DNA, 1712 bp, Lippia dulcis
ctggttgattccctctcttgttgctttttctgtgctcgttgtcctcttgggagttgcagagagagggaaaacatgttcggactactaaggcggaaggtgacctgcaaaggcaatcctgcttcgggtttggagcaaggaattcgagtacttgctgcgcgggcattttcttcctcggcaaaggagatgactgtccgggatgcgttaaactcagctcttgatgaggaaatgtctgctgatcccaaagtatttttaatgggtgaagaggttggtgagtatcagggggcatataagatctccaaagggcttttggataaatatggtcctgagagggtgctggacacaccaatcactgaggctggatttgctggaattggagttggtgctgcatattatggtctaaaacctgtaattgagttcatgacctttaacttttcgatgcaggccattgatcacatcattaattctgctgcgaaatcaaattacatgtctgctggtcagatgtcagttcccattgtttttagagggccaaatggtgctgcagcaggtgttggtgctcaacattctcagtgctatgcagcatggtatggttcatgtccgggattaaaagtactaactccatactcttcggaggatgctcgtggcctccttaaagctgcaataagggatccagatcctgttgtcttccttgaaaatgaattgttatatggtgaatcatttcccgtttcagacgaagttcttgattcaagtttttgtcttcctattgggaaagctaagatagaacgtgaaggaagggatgttacgatcactgctttttcaaagatggttgggtatgcacttcaggcagctgagattcttgcaaaggacggaatcagtgctgaggtgatcaatcttcgctccatccgccctctcgatggagccacaataaacgcttctgtcaggaaaaccaataggcttgtgacgctggaggaaggtttccctcaacatggtgttggtgctgaaatctgtgcatctgttcttgaagaaagcttcgagtatcttgatgcagcggttgagagaattgctggggctgatgttcccatgccctatgctgcaaacctcgagagaatggctgttccacaggttgacgacattgtccgtgctgcaaagaggacatgttacagatcaagttcagtggctgcaactgcttgagagttgcctagaacaaagattcttctgtgaaattgtattctttgaacaactgtagttgccaatgttcctttcctggaataagttgagaggacacccccagttatgacaaaaattaacaagaaataacatccagagacgaactcgtttggtgctaattctttggggatatatgtaaacatgaacttgatttgatgaaagctcggggaagggagaagcaaaagcatcgacgccaaaattgttctttattgttgtttgtgactcgatctccttctaccataaaagatttaaccatatttggatttgtttgtttttcagtagatcaacactgcattgtcaaaatcatcaacttcgaaaaagaggatgtaagaaagattggattttcctcttagtttcgttaaggaaataaataatctgggtgtatggttttccaactaatagggtgtttggttgtgctttacttatatcgttcccagaagttgtcctttaagagcttctaaatttttttaagtgtaggtgcaaaatat

SEQ ID NO: 4034 - DNA, 1544 bp, Tabernaemontana elegans
cggcccctcgaccttctaaagatatcaaggcctgtgttttacctaccaccagaattccaacccaaaacctctctaagcaacaagtcccgcaaccatcacccgcaccggagatccgtctacgcctccgaagtagcctgcaaagtaagcagtccagaatttttgtaagtaattcaacaagaagacatggcaggcgcactaaggaagatgctgggctgccgaggaattccggttttgggaattcgagtaattgcgtctaggacttactcttcttctgtgaaagagatgacagtgcgtgatgctttaaattctgcacttgatgaagaaatgtctgccgattctagcgtctttctgatgggtgaagaggttggtgagtatcaaggtgcatacaagatttctaaagggcttttggagaaatatggtcctgacagggttattgacactcccattactgaggctggttttgctggaattggagtgggtgcagcttacaagggtctgaagcctgttatagagttcatgacaattaacttctcactgcaggcaattgaccatatcatcaattcagctgcaaaatcaaattacatgtctgctggtcaaatttcagtgcctattgtttttagaggtcccaatggagctgctgctggagttggtgctcagcattcccagtgctatgctgcatggtatagttcggttccagggttgaaggtactggcaccatactcagcggaagatgctcgcggcctgctaaaggctgctataagggacccagatcctgttgttttccttgaaaatgaattgatgtatggtgagtctttccctatttcagctgaggcccttgattcaagcttttgtcttccaattgggaaggctaaggtagaacgtgaaggaaaggacgtcacaattactgctttctcaaaaatggttggctatgctcttaaggctgctgagattctggcgaaggatgggatcagtgcagaggttataaatttgcgctccataaggccacttgatagagctacaataaatggctcggtcaggaaaaccaacagactcgtgactgttgaagaagggtttcctcaacatggtgttggagctgagatatgtgcatcaattgttgaagagagttttgagtatcttgatgcacctgttgaaagaatcgcgggagctgatgttcccatgccttatgctgcaaatcttgagaggatggcagttccacaggttgaagatatcgtccgcgcagcaaagaggacatgctacagatcagttcccgttgctgctgccgcctaaagttaacaggaatacactttgcttttgacagtttctctcggcattaaaacaaaacttttgaggctattctttatcttcacgatggccatttggctttgtgcttttataatgttgttaagttcacaataaactcaattagctaagtccatatacttggcaacatgttaataagtatgcaggggatgaattcttttctttttctcctctttaggttactgcttcacgatacgctattttacttgaattttcttggtatg

SEQ ID NO: 4035 - DNA, 1493 bp, Tropaeolum majus
tagatcgaatcccaacaccgaactcgggttcagaagaaagacaaatttgtctttcagttaagaaaaggaggaaaagatgttgggaggaatcgcaaggcaaaagatgttggggctgtcggtacggaagatacggccagcagtttatgctttcaggaatttttcatcggcagggaaagagatgacggtcagagaagcactgaactctgcgctcgatgaggaaatgtctgcggatcctaaagtctttttgatgggtgaagaggttggggaatatcaaggtgcctacaagataaccaaagggcttttggacaagtatggtcctgaaagggttctcgacacaccaattactgaggctggatttactgggattggagttggtgctgcttactatggtcttaaacctgttgtggagttcatgacattcaacttctctatgcaggcgatcgaccacattattaattctgctgcaaaatcaaactatatgtcagccggccagattaatgtgcccattgtctttcgaggacctaatggtgctgctgctggagttggtgcccagcactctcattgttatgctgcatggtacggctcttgcccaggcttgaaagtgctgaccccgtactcatctgaagatgctcgtgggttgctaaaagctgctattagggacccagatcctgtcgttttccttgagaacgagttgttgtatggtgagtcgttccctgtttctgccgaagttcttgattctagttactccactccgattgggaaagctaagattgagagagaaggaaaggatgtgacaatcactgctttctcgaaaatggtgggattttctttgaaggcagcagagatccttgcaaaggaaggaattagcgctgaggttataaatttgcgatcaattaggcctcttgatagagccacaatcaacgcctcagtcaggaaaaccaacagattagttacagtcgaagagggttttcctcagcatggtgttggtgctgaaatctgtacatctgtcatcgaagaaagttttggttatcttgatgcacctgttgagaggattgcgggagcagatgttcccatgccttatgcagccaatcttgagagattggctgtcccacaggttgaagatatcgtccgtgctgctaaaagagcttgctacagatcctctgtaccaatggcagcggctgcctaattgtactcatcgcacaggcttggaaaggattgcaaaattatttttgtaccctcgcgcacgttcaagtaggaaatttttagcggaataatgtagaaatggttatagaaggatgtttttgggctctattttgttgcataattttggctctatcttgatccaaagtcgctctgcgggtttctgctttttggcgaaaagtttgtttctcataaaactaataagaaaactgttgtcacgatatctttataatttggaaagaaagaattttatcatggacttatgtttctctctaattcaatgatatttgcac

SEQ ID NO: 4036 - DNA, 1527 bp, Glycine max
attgtcaacaatttctgtctttagatataaataataaaaagagaaaaagaataaataaaagtggaggaggagggtgtaggtttggttgatttgattgttgtgcatccatcgttaagctagtggcgatcggatccagctacagcatagagatcaaggaaggaaggaaggaagatgttgggtgttataaggcacaagagtattcgccctgccttctccgcaatcagacacttgtcttctgcagctaaagagattactgtcagggaggctctgaactccgcactcgatgaggaaatgtcagctgatcctaaagtgttcttgatgggtgaagaggttggggaatatcagggtgcatacaagatatccaaggggctgctcgacaagtatggccccgagagggttctcgatactccaatcactgaggctgggtttactgggattggagttggcgctgcttactatggtctaaggcctgttgtggagttcatgacttttaacttctccatgcaggcaatagatcatattattaactctgccgcaaaatcaaactacatgtctgctgggcaaatatctgtgcctattgtctttagaggacccaatggtgccgctgctggagttggtgctcagcattctcaatgttatgcatcttggtatggttcatgccctgggttgaaagtcttgtcaccatattcatctgaagatgctcgtggtttgcttaaagctgctataagggaccctgatcctgttgttttccttgaaaatgaattgttatatggtgagtcattccctgtttcggccgaagttcttgattccagtttttgccttcccataggaaaagcaaagattgagagggaaggaaaagatgtgactattacagcctattcgaaaatggttggctttgctctcaaggctgctgagacactggcaaaggaaggaatcagtgctgaggtcattaatttgcgttcaatccggccacttgatcgatccacaatcaatacttctgtcaggaaaaccaacaggctggtgacagttgaagaagggtttcctcagcatggcgttggcgctgaaatctgcacatctgtcattgaggagagttttggttatcttgatgcaccggttgagagaattgccggggctgatgttcccatgccatatgcagcaaatctggaaagaatggctgtcccacaggttgaagatattgttcgtgctgcaaagagagcatgctacagatctgtgcctttggccgcatctgcttgaatgctctggaaatttttcttgtcctggttagttctttgcagaaacaaattttccctaatttccgccataaaacagcaggaagaaattgcaaccaaagaatgttgattttaactcatttgttatgttaggctttggtttaaaagattctgttgtatgcataatactgtcctaattttcaggactcagatgctatacattttttccccttctcagcatatctgggaggaagttaatgtttaataataaataaattgcacaacaatgacacaaagc

SEQ ID NO: 4037 - DNA, 1563 bp, Glycine max
ggaggaggagggtgtaggtttggttgatttgattgttgtgcatccatcgttaagctagtggcgatcggatccagctacagcatagagatcaaggaaggaaggaaggaagatgttgggtgttataaggcacaagagtattcgccctgccttctccgcaatcagacacttgtcttctgcagctaaagagattactgtcagggaggctctgaactccgcactcgatgaggaaatgtcagctgatcctaaagtgttcttgatgggtgaagaggttggggaatatcagggtgcatacaagatatccaaggggctgctcgacaagtatggccccgagagggttctcgatactccaatcactgaggctgggtttactgggattggagttggcgctgcttactatggtctaaggcctgttgtggagttcatgacttttaacttctccatgcaggcaatagatcatattattaactctgccgcaaaatcaaactacatgtctgctgggcaaatatctgtgcctattgtctttagaggacccaatggtgccgctgctggagttggtgctcagcattctcaatgttatgcatcttggtatggttcatgccctgggttgaaagtcttgtcaccatattcatctgaagatgctcgtggtttgcttaaagctgctataagggaccctgatcctgttgttttccttgaaaatgaattgttatatggtgagtcattccctgtttcggccgaagttcttgattccagtttttgccttcccataggaaaagcaaagattgagagggaaggaaaagatgtgactattacagcctattcgaaaatggttggctttgctctcaaggctgctgagacactggcaaaggaaggaatcagtgctgaggtcattaatttgcgttcaatccggccacttgatcgatccacaatcaatacttctgtcaggaaaaccaacaggctggtgacagttgaagaagggtttcctcagcatggcgttggcgctgaaatctgcacatctgtcattgaggagagttttggttatcttgatgcaccggttgagagaattgccggggctgatgttcccatgccatatgcagcaaatctggaaagaatggctgtcccacaggttgaagatattgttcgtgctgcaaagagagcatgctacagatctgtgcctttggccgcatctgcttgaatgctctggaaatttttcttgtcctggttagttctttgcagaaacaaattttccctaatttccgccataaaacagcaggaagaaattgcaaccaaagaatgttgattttaactcatttgttatgttaggctttggtttaaaagattctgttgtatgcataatactgtcctaattttcaggactcagatgctatacattttttccccttctcagcatatctgggaggaagttaatgtttaataataaataaattgcacaacaatgacacaaagcagtaggaaggtttctgtgtttctggagtcaactttttgaatacattatttccaacggaccactttactgaaagatctaacttgctgttagttcatctt

SEQ ID NO: 4038 - DNA, 1397 bp, Lippia dulcis
tctgacacaaagaaggcttacataaatctcccccacctgaacggcagcacaccaaacggggagttgtagagagaagccaatatgttgggagttttgaggaggaaagttgcctgccaaggcgctcatgcttggggtttggagcaaggacttcgagtgattgcatctagagctctttcttcttcagcaaaagagacaatgacagttcgtgatgctttgaattcagcacttgatgaagagatgtcagctgatcccaaagtctttgtaatgggtgaagaggttggcgagtatcagggtgcatataagattacaaaagggcttcttaacaagtatggcccagagagggtgctggatacacccatcactgaggccggatttgctggaattggagttggtgcagcatattacggtctaaagcctgtaattgagttcatgacattcaacttctcaatgcaggccattgatcacattatcaattctgctgcaaaatcaaattacatgtcttctggtcaaatatcagtgcccatagttttcagaggcccgaatggtgctgctgctggtgtaggtgctcaacattctcagtgctatgcagcgtggtttggtgcgtgcccaggtttaaaggtactgactccttattcatcagaagacgctcgtggcctgcttaaggctgcaataagggatccagatcctgttgtcttcctggagaatgagttgctgtatggtgaatcatttcctgtatcagctgaagtcctcgactccagtttctgtcttcctattgggaaagccaagatagaacgagaaggaaaggatgtaactatcactgctttctctaagatggttggctatgctcttcaggctgctgacattctcgcaaaagaaggattcagtgctgaggtgataaatcttcgctcaatctgccctcttgatagagccgcaataaatgcttcggttaggaaaacaaacaggctggtgactgttgaggaaggattccctcaacatggtgtcggtgctgagatctgcgcatctgttcttgaagatagttttgagtatctcgatgcagctgttgagaggatttcaggggctgatgttcccatgccctatgctgcaaatctcgagagaatggctgtcccgcaggttgaggacattgtccgcgcagcaaagagaacttgttacagatcaactgctttggctgcaactgcttagagctagcgaggatggaatgaatgattcccctttctttacatattcttctaccaacattacattttttaaacccttgttccccctatctgaaataagttcatgtaattcacattaccatagatgagctacatatgcttttttgtgactttcataatactcgccaaatggggaagtaaatgagcaaattcagtcttctg

SEQ ID NO: 4039 - DNA, 1416 bp, Centaurea maculosa
  misc_feature (54)..(54): n is a, c, g, or t
  misc_feature (634)..(634): n is a, c, g, or t
  misc_feature (746)..(746): n is a, c, g, or t
  misc_feature (1192)..(1192): n is a, c, g, or t
  misc_feature (1259)..(1259): n is a, c, g, or t
  misc_feature (1326)..(1326): n is a, c, g, or t
  misc_feature (1353)..(1353): n is a, c, g, or t
  misc_feature (1364)..(1364): n is a, c, g, or t
  misc_feature (1369)..(1369): n is a, c, g, or t
  misc_feature (1378)..(1378): n is a, c, g, or t
  misc_feature (1383)..(1383): n is a, c, g, or t
tatatcaaatctctctctctctcttcttcttcttcctccagcagcagcagccgntcatcatcggaaactttttttttttcaaggagaaaagatgcggggaattataagccaaaaacttggaggattatcctctcaggttgtggggaattatatgctgaggttaaggcctgcagcatcagctaggcattactcatctgcaaccaaagagatgacagtacgggatgctttgaactctgctcttgatgaggaaatggctgctgatcctaatgtctttgttatgggcgaagaggtaggagagtaccagggtgcatacaagataaccaagggattattggacaaatatggtcctgaaagggttgttgatacccctatcacagaggctgggtttgccgggattggagttggctctgcatatcatggtctgaggcctgtaatagagtttatgactttcaacttctctatgcaggcaattgatcatatcatcaattctgcagcaaagtcaaactacatgtctgctgggcagattaacgtacccattgtttttaggggaccaaatgggcctgctgctggtgttggtgctcaacattcccagtgttatggtgcatggtatggctcagtccctggtttaaaggtncttgtaccttactcctctgaagatgctcgtgggcttttaaaagctgcaattagagaccctgatcctgttgttttccttgaaaatgagttgctgtatggtgaatccttcccgntttcagcagaagcccttgattcaagcttttgcctcccaataggaaaagcaaagatagaaagagaagggaaagatatcacgatcacagctttttctaagatggttggctacgctcttaaggcggctgaaatacttgaaaaggaagggataaatgcagaggttataaacctgcggtctattcgaccactagatagagctaccatcaatgcttcagtgaggaaaactaaccggctggtgactgtggaggaaggatttcctcaacatggtgttggtgcagaaatctgtgcaagtgttgttgaagatagctttggttatcttgatgctcctgtggagaggattgctggagctgatgttccgacgccttatgctgctaatcttgagagaatggcttttcctcagattgaggatattgtacgtgctgctaagagagcatgctacaggtcggtncctatggctgcaactgcttgaaaatgaaaatgctgactttttctttttcttttgttttgaggaaaanagagagaaaaaaaaacatcatcatcacctgattcgtggaggggtgtaaatttctattttttacttgngtattgtgtgaggtaggcaagagaaangcccacagaantcccncttttcttnttttnatcaacaaaaataagaattgcaatagttttgcg

SEQ ID NO: 4040 - DNA, 1709 bp, Catharanthus roseus
gcgacttggcatccccgcatctgtcaacaccaactaaggattctcatcaaacaaaacctcacaaccggtctcgccacggctatcgtcggcatcctccctaaatagccttcaccggcggcttttgcctcaggaagcagcgcctcttccaccggtagaggaataaaatctattgagagctgagctgcaggaaaagattgaacaactgcaaaggcttttttaaacaagtcaacaagaagctatggcaggcgctttaaggaagatagtaggcttccgaggaactccgatttcgggaattcgagtaattgcgtctagggcatactcttcttcagtgaaagagatgactgtccgagatgcactaaattctgcacttgatgaagaaatgtcagctgattccagagtctttctgatgggtgaagaggttggtgagtatcaaggtgcatacaagatttcgaaagggcttttggagaaatatggtcctgagagggttatcgatacccccattactgaggctggttttaccggaattggtgttggtgcagcttacaagggtctgaagcctgttatagaattcatgacatttaacttctcaatgcaggcaattgatcacatcataaattcagctgcaaaatcaaactacatgtctgccggtcaaatttccgtgcctattgtttttagaggtcccaacggagctgctgctggagttggtgcacagcattcccagtgctatgcagcatggtatgctgctgttccagggctgaaggtactgacaccgtacacagctgaagatgctcgtggccttctaaaggctgctataagggacccggatcctgttgttttccttgaaaatgaattgctgtatggtgaatctttccctgtttcagctgaggcccttgattcaagcttttgtcttccaattggcaaagctaaggtagaacgcgaaggaaaggatgtcacaattactgcattttcgaaaatggttggctattctcttaaggctgctgagattcttgcaaaggaagggattagtgcagaggttataaatttgcgttccataaggccacttgatagagctacaataaatacctcggtcaggaaaaccaacagacttgtgactgttgaagaagggtttcctcaacatggcgtaggagctgagatctgtgcggctgttgttgaagagagttttgagtatcttgatgcacctgttgaaagaatttcgggtgctgatgttcccatgccttatgcagcaaatctcgagaggatggctgttccacaggttgaggatattgtccgtgcagcaaagagggcatgctatagatccgttcctcttgctgctgctgcctaaagtttaactgcaatacactgcctaaagctcaaatggcatccactttgctcttaacgtttcttgtcatcaacaaaacaaaaggttttttaagctattctttttattttatcattggagttctgatttttgttttacggtgttgtcaatttcacaataaattgtattaacaaatcccttgcacttgacaaggtgttgataaacataaagatgaatttttgtctctcctatttctgttatcacacagagggcggttgggatgtctagtacatcttcattaataaaactactataaatagtagtattaaagtgtgtattagaggatgtattagacgatctaagtgcactgagggatatgcaattttattat

SEQ ID NO: 4041 - DNA, 1580 bp, Orobanche aegyptiaca
acggagtaaatcgaccaggttcatcatcaccatcgtcgctcttgtaatatttccgttactcattttcagtttggtacacagtttcgttcatcatcttcttggtattccatttactattaatattctcgttcgttgggtggtcaaatacgtgtttcgatagggagttgtagagagaggaaaaatatgttgggaattataaggcagaaagtagccgctagagccaatcctgctaagggtttggagcaaggggttcgagtaattgcatcccggatgttttcttcctcagcaaaggagatgactgtgcgtgatgctttgaattcagcacttgatgaagagatgtctgctgatcctaaagtttttttaatgggtgaagaggttggtgaatatcagggagcatataagatctccaaagggcttctggagaagtatggtcctgagagggtggttgatacacctatcaccgaggccgggtttactggaattggagttggtgcagcatattatggtctaaggcctgtaattgaatttatgactttcaacttctcaatgcaggccattgatcacatcattaattccgctgcaaaatcaaattacatgtctgctggtcagatatcagtgccaattgttttcagaggcccaaatggtgctgctgctggtgttggtgctcaacactctcagtgctatgcagcttggtatggttcatgtccaggtctgaaggtgctggctccatattcttccgaagatgctcgtggtctgcttaaagctgccataagggatccagatcctgtcgtctttcttgaaaatgaattgctatatggtgaatcatttccaatttcagccgaagctctcgattccagtttctgtcttcctattggcaaagcaaagatagaacgtgaaggaaaagatgtaactatcactgctttctcaaagatggttggctacgctcttcaggcagctgagattctcgcaaaagatggaatcagggctgaggtgataaatcttcggtcaatccgccctcttgatagagccactataaatgcttctgttcggaaaaccaataaacttgtgactgtagaggaaggtttccctcaacatggtgttggtgctgagatctgtgcatctgttcttgaagatagctttgagtatcttgatgccgctgttgaaagaatttctggggctgatgttcctatgccctatgctgcaaatcttgagaggatggctgttccacaggttgaagacattgttcgtgctgcaaagagaacctgttatagatcaagttcattggatgcgacggcttaaaagttgtgcatatcagaagggttctgttcatcattagccgcaactgcttaaagttacctaagagttctgttgttactatatatattcttcttttgaagacattctttgaacacctatgcggcttgcacttcttcgaacattcttggaaatgttagatgatcccgcaatggttgacgaattatttttgctagttgacaataagtttgagttcactaaaactgaagccaaaaggcgttcttctgacaaattttattttcaattcatatgttctttttacagca

SEQ ID NO: 4042 - DNA, 1638 bp, Triphysaria pusilla
aaattaaatacatccagcattcgagtgggatgaagaaatagttcaaagcaatccctagctgactcgacacacaattttgttctcatagttttctccatcactaccggaaaaggagacaggagagagagaaaaagactaaaataatactccatccagcatcaggttcgcccactgttcgaatacacagaaaacaaaccaaccagggattttctgaaaagagagggaaaaaatgttggggctaataaggcaaagggcggccttcaaagccaatccagcttcaaatttggagcaagggattcgagctatggctatgagggccttttcttcatctgccaaggagatgacagtccgtgatgctttgaattcagcactcgatgaagaaatgtctgctgatcctaaagtttttctaatgggtgaagaggttggtgagtatcagggtgcgtataagatctccaaagggttgctggacaaatatggtcctgagagggtttgtgatacacccatcactgaggctggatttactggaataggagttggtgcagcatattatggattaaggccagtgatagagtttatgacctttaacttctcgatgcaggccattgatcacatcataaattctgctgcaaaatcaaattacatgtctgctggtcagatatcagtgcctattgtttttagaggcccaaatggtgctgctgctggtgtgggtgctcaacattcccagtgctatgcggcatggtttggcgcatgtccaggattaaaagtacttgctccatattcctcggaagatgctcgcggcctgctaaaagctgctataagggatccagatcctgttgtgttccttgaaaatgaattgctgtacggtgaatcatttcctgtctcggctgaagttcttgattctagtttctgtttacctattgggaaagctaagatagaacgtgaaggaaatgatgtaacaatcactgctttctcaaagatggttggctattctcttcaggctgctgagattctcgctaaagaagggattagcgctgaggtggtaaatctacgttccattcgccctcttgacagagctacaataaatgcttctgttaggaaaacaaataggcttgtgacagttgaagaaggatttcctcaacatggtgttggtgctgagatctgtgctacggttgttgaggatagctttggatatcttgatgcacctgtcgagaggattgctggtgctgatgttcccatgccttatgctgcgaatcttgaaagactggctgttccacaggttgaagacatcgttcgtgcagcaaagagggcctgttacaggtcacgttagtcggctaaaaccgagttaccaggaacaacgaaggttgctgttgttcctatagactattctgttcaaattaatatttttatgtgttttgtgttgttcgcctttttcccagagaaatgtttgagttttggcaggaaatctgggttcacataacataaatgacaaattgtcagaaagaaataagcatgtgataactaggcttcagttgccgtgatttcgaagaatgttaatatgtaaaaaacaaattgatcacagaaactgaaatcatgggatttgaaaaatttgagtgcctttgatttgtcatttgacaattc

SEQ ID NO: 4043 - DNA, 1601 bp, Nicotiana tabacum
  misc_feature (413)..(413): n is a, c, g, or t
  misc_feature (437)..(437): n is a, c, g, or t
  misc_feature (564)..(564): n is a, c, g, or t
  misc_feature (570)..(570): n is a, c, g, or t
  misc_feature (588)..(588): n is a, c, g, or t
  misc_feature (604)..(604): n is a, c, g, or t
  misc_feature (630)..(630): n is a, c, g, or t
  misc_feature (924)..(924): n is a, c, g, or t
  misc_feature (1095)..(1095): n is a, c, g, or t
  misc_feature (1114)..(1114): n is a, c, g, or t
  misc_feature (1125)..(1125): n is a, c, g, or t
  misc_feature (1289)..(1289): n is a, c, g, or t
  misc_feature (1396)..(1396): n is a, c, g, or t
  misc_feature (1501)..(1501): n is a, c, g, or t
  misc_feature (1536)..(1536): n is a, c, g, or t
aggattttgataagctaagaaggggctgatatgtctggaatcataggtcgaacaatggccagcagaaagatttctgctttgaatcagttcttgatgggaagcagggtatttgcatctagaacttactcttcgtcagctaaagagatgacagtgcgcgacgcgctaaattcagctctagatgaagaaatgtctgcggatcctaaggtctttgttatgggggaagaggttggtgagtaccaaggagcctataagattacgaaggggcttctggataaatatggtccggaaagggttcttgatacaccaattactgaggctggatttgctggaattggagttggtgcagcttaccatggtctaaagcccataatcgaattcatgacatttaacttttccatgcaggcaattgaccntatcatcaattctgctgcaaaatnaaattatatgtctgctggccagatatctgtgcccattgttttcaggggtcctaatggtgctgcagctggtgtcggtgcccaacactctcagtgctatgcagcatggtttggttcctgtccaggattnaaggtnctagctccatactcttcngaagatgctcgtggcntgctcaaagctgctatcagggatccngatccggttgtgtttctagaaaatgaattgctatatggtgagtctttccctgtttcagcagaagctcttgattctagtttctgtcttcccatcggaaaagctaagatagaacgcgaaggaaaggatgtgacaatcactgccttctcaaagatggttggctatgctcttcaggctgctgaaattcttgctaaggaaggaattagtgctgaggttataaatctgcgctcgatccgaccacttgatagacccgccattaatgcatctgtgaggaaaaccaacagacttgtaactgtngaagaagggttcccacaacatggtgttggcgctgagatctgtgcatctgtggttgaggaaagctttgagtatcttgatgcaccagttgagaggatatcaggggctgatgttcctatgccatatgcagcaaatctggaaaggatggctgttccacaggttgaagatattgtncgtgcagcaaagagggcangttacagagcngcaaaatgagttccaatggctgcaactgcttaagcttggtagaaaccaagcctaccaagccagtcttaagcattttatttcctctatgtggatattgattctttatctttctgagagtggatgcttctggctttaccatcccctgagaagtttagtttaaccangaaaaaggaagaagaagaagaagctaaagtgaaactaaaatagtgagtgatatctgaaataaaacttgtagaaaataaattttgccggttatttgctacttttcacnggtgttgccaaatgttctgtaagataaatacatacttctactagtagaagagcaagtagtagacctcgttgcaacttcgttgctgagtttcaactcacgagaacnaactctatgctgatatgtataattttatctattcntgttgtattagtatttgctagcggcaaatccgggatcaataacacccatccagttttcgagcggc

SEQ ID NO: 4044 - DNA, 1653 bp, Lotus japonicus
agaagagaagaagagcatggttctaatttaatctggagaagggtaggttgttggattgggtctttgtgagtagcgattggaatcggatccatccaggtctatatttcttgctttcaattggtgatcggaatcggatccatcttgtagtgtagagttttttcgggagtagatttgcttcgttcaaaaaagttgaagatgtggggtgttacaaggctcaagactatccgccctgctttctcttcactcagacaattctcttccgtcgccaaagagatgacagtgagagaggctctcaactccgcacttgatgaggaaatgtcagcagatcctaaagtcttcttgatgggtgaagaggttggagaatatcagggtgcatacaagataaccaagggtctgttggagaagtatggccctgagagggttcttgatactccaatcactgaggctgggtttactgggattggagttggcgctgcttactatggtctaagacctgtcgtggagtttatgacatttaacttctccatgcaggcaatagatcacattattaattctgctgcaaaatcaaactacatgtctgctgggcaaataaatgtacctattgtctttagaggacccaatggtgctgctgctggggttggtgctcaacactctcagtgttatgcatcttggtatggctcttgccctgggttgaaagtgctatcaccatactcatctgaagatgctcgtggtttgcttaaagcagctataagggaccctgatcctgtagttttccttgaaaatgagttgttatacggtgagtctttcccagtttcggccgaagttcttgattccagtttttgccttcccataggaaaagcaaagattgagagagaaggaaaagatgttactattacagccttttcaaaaatggttggttatgctctcaaggctgctgagatactagccaaggaaggaatcagtgccgaggttatcaatttgcgttcgatccggccgcttgatcgatccacaatcaatacttctgtcaggaaaaccaacagactggtgacagttgaggaggggtttcctcagcatggtgttggtgctgaaatctgcacatctgtcattgaagagagttttggttatcttgatgcaccggttgagagaattgctggggctgatgttcccatgccttatgcagcaaatctggagaggatggctgttccacaggttgaagatattgttcgtgctgcaaaaagagcatgctacagatctgtgcctttggccgcagctgcttgaatatcaatctagtccttaattttaatgtcaggggcaagagaggcgataaatttttccccattctcagcatatctgggagattcatgttcaataacttggataacaatagcacaagacgggaagttgtgtgttcttttggattgtgctcggcatttgacaatgttatttaataacttggataacaataactcggtattcaactttttgaatacattatcgagttcctttttctttccagcggactacatattgcaacgcctgatttgctgttgtgtttgcacttcaaaaaacagttggtacttgtttagtttcattgacaaagtaaatataactttattaggtaaattacactccactaccttgaggttttcttat

SEQ ID NO: 4045 - DNA, 1492 bp, Medicago truncatula
attcggttcaaatttttttattaagcagaaaagaataatgaattctggaaattcaatcgcgacctaaagtattggtattcatcttctactctctctctctctctctctctctctctctctctctctctaaccactgatactcaccaactctgaaacagttcgttccgcagcaatcaaggaatcaagatgttaggcgttataagaaacaagaatcttcttcggccttccttttccgcattcagacatctctcttcttctgctaaacagatgacagtgagagatgctcttaattcagctcttgatgaagaaatgtccgctgatcctaaagtcttcttgatgggtgaagaggttggagaatatcaaggtgcatacaagatttccaagggactattggagaagtatggtcctgagagggttcttgacactcccatcactgaggctgggtttactgggattggagttggtgctgcttactatggtctaaagcctgttgtggagtttatgacatttaacttctccatgcaggcaatagatcacatcattaattctgctgcaaaatcaaattacatgtctgctgggcaaataaatgtacctattgtatttagaggacccaatggtgctgctgctggtgttggtgctcagcactctcattgttatgcatcttggtatggctcatgtcctgggttgaaagttttggcaccatattcatctgaagatgctcgtggtttacttaaagctgctataagggaccctgatcctgtagttttccttgaaaatgagttgctatatggtgagtcattccctgtttctgccgaagttcttgattccagtttctgccttcccattggaaaagcaaagattgagagagaagggaaagatgtgactattacagccttctcaaaaatggttggctttgccctaaaggctgccgagacattagaaaaggaaggaatcagtgctgaggttattaatttaaggtcaatccggccgcttgatcgagccaccatcaatgcttctgtcaggaaaaccaacagactggtgacagttgaagaagggtttcctcagcatggtgttggcgctgaaatctgtgcatctgtcatcgaggagagttttggctatcttgatgcaccggtggagagaattgccggggctgatgttcccatgccttatgcagcaaatctggaaagattggctgtcccacagattgaagatatcgttcgtgctgcaaagagagcatgccacagatctgtgcctatggccgcaactgcctaaattaatcgatatagttctgaaatttttcatgtcttggttagttctttggtaaccctttatgttaccaaaaataattcccccccaaatttccaccacaacctcgtacaaaaagaggctctgctcattgattctgtcagaggctttggtttgaaaattgtgatgtaagcatataatattgtccaaattttcaggagtaacaaattctatacatttttttttt

SEQ ID NO: 4046 - DNA, 1538 bp, Glycine max
gcggaagagagggtaggctgttacggtttggtttggtggttatttgattggtgtgcatccatgttaagctagtggcgatcggatccagctacagcctacaacctacagatcaaggaaggaagatgttgggtgttataaggcacaagagtattcgccccgccttctccgcaatcagacacttctcttctgcagctaaagagattactgtcagggatgctctcaactccgcactcgatgaggaaatgtcagctgatcctaaagtcttcttgatgggtgaagaggttggggaatatcagggtgcatacaagatatccaaggggctgctcgacaagtatggccccgagagggttctcgatactccaatcactgaggctgggtttgctgggattggagttggcgctgcttactatggtctaaggcctgttgtggagtttatgacttttaacttctccatgcaggcaatagatcatattattaactctgccgcaaaatcaaactacatgtctgctgggcaaatatctgtacctattgtctttagaggacccaatggtgctgctgctggggttggtgctcagcattctcaatgttatgcatctttgtatggttcatgccctgggttgaaagtcttgtcaccatattcatctgaagatgcccgtggtttgcttaaagctgctattagggaccctgatcctgttgttttccttgaaaatgaattgttatatggtgagtcattccctgtttcggccgaagttcttgattccagtttttgccttcccataggaaaagcaaagattgagagggaaggaaaagatgtgactattacagcctattcaaaaatggttggctatgctctcaaggctgctgagacactggcaaaggaaggaatcagtgctgaggtcattaatttgcgttcaatccggccgcttgatcgatccacaatcaatgcttctgtcaggaaaaccaacaggctggtgacagttgaagaagggtttcctcagcatggcgttggcgctgaaatctgcacatctgtcattgaagaaagttttggttatcttgatgcacccgttgagagaattgctggggctgatgttcccatgccttatgcagcaaatctggaaagaatggctgtcccacaggttgaagatattgttcgtgctgcaaagagagcatgctacagatctgtgcctttggctgcatctgcttgaatgttctggaaaattttcatgtcctggttagttctttgcagaaacaaaattttccctattttccgccacaaaacagcaggaagaaattgcaaccaaagaatgctgattttaactcatttattatgttaggctttggtttaaaagattctgttgtatgcataatactgtcctaattttcaggactcacagatgctatacattttttccccttctcagcatatctgggaggaagttaatgttaaataacttgtacaacaatgacacaaaggcagcaggaagttttctgcgtttttggtttctgcttggcaataactaaaaatcaactttttgaat

SEQ ID NO: 4047 - DNA, 1661 bp, Glycine max
ggaagagagggtaggctgttacggtttggtttggtggttatttgattggtgtgcatccatgttaagctagtggcgatcggatccagctacagcctacaacctacagatcaaggaaggaagatgttgggtgttataaggcacaagagtattcgccccgccttctccgcaatcagacacttctcttctgcagctaaagagatgactgtgagagaggctctcaactccgcactcgatgaggaaatgtcagctgatcctaaagtcttcttgatgggtgaagaggttggggaatatcagggtgcatacaagatatccaaggggctgctcgacaagtatggccccgagagggttctcgatactccaatcactgaggctgggtttgctgggattggagttggcgctgcttactatggtctaaggcctgttgtggagtttatgacttttaacttctccatgcaggcaatagatcatattattaactctgccgcaaaatcaaactacatgtctgctgggcaaatatctgtacctattgtctttagaggacccaatggtgctgctgctggggttggtgctcagcattctcaatgttatgcatctttgtatggttcatgccctgggttgaaagtcttgtcaccatattcatctgaagatgcccgtggtttgcttaaagctgctattagggaccctgatcctgttgttttccttgaaaatgaattgttatatggtgagtcattccctgtttcggccgaagttcttgattccagtttttgccttcccataggaaaagcaaagattgagagggaaggaaaagatgtgactattacagcctattcaaaaatggttggctatgctctcaaggctgctgagacactggcaaaggaaggaatcagtgctgaggtcattaatttgcgttcaatccggccgcttgatcgatccacaatcaatgcttctgtcaggaaaaccaacaggctggtgacagttgaagaagggtttcctcagcatggcgttggcgctgaaatctgcacatctgtcattgaagaaagttttggttatcttgatgcacccgttgagagaattgctggggctgatgttcccatgccttatgcagcaaatctggaaagaatggctgtcccacaggttgaagatattgttcgtgctgcaaagagagcatgctacagatctgtgcctttggctgcatctgcttgaatgttctggaaaattttcatgtcctggttagttctttgcagaaacaaaattttccctattttccgccacaaaacagcaggaagaaattgcaaccaaagaatgctgattttaactcatttattatgttaggctttggtttaaaagattctgttgtatgcataatactgtcctaattttcaggactcacagatgctatacattttttccccttctcagcatatctgggaggaagttaatgttaaataacttgtacaacaatgacacaaaggcagcaggaagttttctgcgtttttggtttctgcttggcaataactaaaaatcaactttttgaatacattatttccagcggacgatcactttactgcaagatctaacttgctgttagttcatattcgtttactgttttagttacattgacaaactagagatatctgatttgatgtgaggtccgtattctt

SEQ ID NO: 4048 - DNA, 1626 bp, Triphysaria pusilla
tcatgactagttcaaagcaatttcttcgctgacccgctgtacaagtttgtcctcacagtctccatcaccaccaagattagaaaggaaaccaggggagattgagataggttaaaataatattttataccaagcatcagattcgatagactgttgatacacagaaaacgaaccaaccagggatttgctgaaaagagggacaaaatgttggggctaataagacaaagggcggcctgcaaaggcaatcaagcttcgagtttggagcaagggatacgagcgatggctttgagggccttttcttcatcagctaaggagatgacagtccgtgatgctttaaattcagcactcgacgaagaaatgtctgctgatcctaaagtttttataatgggtgaagaggttggtgagtatcagggtgcgtataagatctccaaagggttgctggacaaatttggtcctgagagggttcgtgatacacccatcaccgaggctggatttgctggaattggagttggtgcagcatattatggactgaggcctgtggtagagtttatgacctttaacttctcgatgcaggccatcgatcacatcataaattctgctgcaaaatcgaattacatgtctgccggtcagatctcagtgcccattgttttcagaggcccaaatggtgctgctgctggtgtgggtgctcaacattcccagtgctacgcggcatggtttggcgcatgtccaggattaaaagtactgactccatattcttcagaagatgctcgcggcctgctaaaagctgctataagggatccagatcctgtcgtgttccttgaaaatgaattgctatatggtgaatcatttcctgtctcagctgaagttcttgattctagtttctgtttacctattgggaaagctaagatagaacgtgaaggaaaggatgtcacaattactgcttactcgaagatggttggctattctcttcaggctgctgagattctcgctaaagaagggattagcgctgaggtgataaatcttcgctctattcgccctctcgatagagctacaataaatgcttctgttaggaaaacgagtaggcttgtgactgttgaagaagggtttcctcaacatggtgttggtgctgagatttgtgctactgttgttgaggatagctttgaatatcttgacgcacctgtagagaggatcgctggggctgatgttcccatgccctatgctgcaaatcttgagaggctggctgttccacaggtcgaagacattgttcgtgcagcaaagagggcctgttacagatcacgttaattcggttaaaatcgtatcactaggaacagagaaggttgctgttgctcctatagacaattctgttcgaatatttctttttacgcgttttgtggtgttcgactttttcccagagagaagtttgatttttttgcagaaaaccagtgttgacatgacataaacggcaaattgccgaaagaaataaagcctgtgataactaggctccaattgtggccattttggagaatgttaatctgtacaaacaaattgatcatagaaaatgtggtcatgtttggatagaggggcttgaaattttttaagtaccttagatttatgaaaatttcagattca

SEQ ID NO: 4049 - DNA, 1474 bp, Antirrhinum majus
  misc_feature (219)..(219): n is a, c, g, or t
  misc_feature (1258)..(1258): n is a, c, g, or t
  misc_feature (1265)..(1265): n is a, c, g, or t
  misc_feature (1284)..(1284): n is a, c, g, or t
  misc_feature (1286)..(1286): n is a, c, g, or t
  misc_feature (1304)..(1305): n is a, c, g, or t
  misc_feature (1308)..(1308): n is a, c, g, or t
aaagacaaaacgaatttgtactcttatttagtaaataattcatattcactccacctcattagaaaacagggaaaataatatctgcgtccgaatctctgcttcaatcaacgcgaaaattcaaccagccactagggaattgtttggaagagaggatgttgggggttataaggcaaagagtagcctgcaaaggcaatcctgcttcgagtttggagcagaganttcgagtggttgcttctagggccttttcttcgtctgcgaaggagatgacagtgcgagatgctttaaattcagcacttgatgaagagatggctgctgatcctaaagtctttataatgggtgaagaggtcggtgagtaccagggtgcatataagatatccaaagggcttctggataaatacggtcctgacagagttgtcgacacaccaatcactgaggctggatttactggaattggagtgggagcagcatattatggtctaaggcctgtaattgagtttatgacctttaacttctcaatgcaggctattgatcacatcatcaattctgctgcaaagtcaaattacatgtctgctggtcagatatcagtgcctatagttttcagaggccccaatggtgctgctgctggtgttggtgctcaacactcacagtgttatgcatcatggtatggctcatgcccaggattaaaggtactgactccatattcctcagaagatgcccgtggcctgcttaaagctgcaattagagatccagatcctgttgtgttcctcgaaaatgaattgctatatggtgaatcatttcctttgtcagctgaagcccttgactccagtttttctcttccgattggaaaagctaagatagaacgtgaagggaaggatgtaacaatcactgctttctcgaagatggttggttattctcttcaggctgctgagattctcgcaaaggaaggaatcagtgccgaggtgataaatcttcgctcaatccgcccacttgatagatccactataaatgcttctgttaggaaaaccaataggctggttacagtcgaagaaggattccctcaacatggcgttggcgctgagatctgcgcatctgttgttgaagaaagcttcgagtaccttgatgcacctgtagagaggattgctggggctgatgtccccacgccctatgctgcaaatcttgagcggttggctttcccacaggttgaagacatagttcgggctgcaaagagagcgtgttacagatcaagttcagcttcatnggctgcnaatgcataaagttgctagncntgcttttgttcccatatnntcntgtcagaaatatatttgtgagccacctgtatggtgcgtactttttgctcacgtttgagtggataaaatgtatggatgatttccacatcatcaggtaaaggttgacaggtctgttctagctacccacaataaaaaaaagttagtctcacggacaaaaagtattgact

SEQ ID NO: 4050 - DNA, 1287 bp, Scabiosa columbaria
tttagccaccactcttacctgattcggcggcttcacctactcgcaaacaccttagacctaagtcattaggcatattttcagtgtacggctgttattaatcagataaacatcagcaaggaagaagagtaccgatctgttcaacaaaatttcaacttctccgactcgataagtggtatcaggatgtggggaattatgaggcagaaagctgttcctaatgttcagaatataagacctatgttttctgcacttcgaacttactcatctgcagccaaagagatgacggtgagagatgctctaaactctgctcttgatgaggaaatgtctgctgatcctaaagtctttgtaatgggtgaagaggttggagaatatcaaggtgcatacaagataactaaaggattgttggataagtatgggccggacagggttgttgacaccccaatcacagaggctggcttcacagggattggagttggtgctgcttattatggtctcaggcccgttatagagtttatgacatttaatttttctatgcaggcaattgatcatataataaattctgccgccaaatcaaactacatgtctgctggacagatcaatgtgcctattgtttttagaggaccaaatggtgctgctgctggtgttggcgcgcaacattcccagtgttatgctgcatggtttggggcatgcccggggttgaaagttttggcaccatattcatctgaagatgctcgtggacttcttaaagctgccatcagagaccctgatcctgttgtatttcttgaaaatgagttgttatatggcgagtcctttcctgtttcagaagaagttcttgattcaagcttttgcgtccccatagggaaagctaagattgagaaagaagggaaggacgtgacaattgcaactttctcaaaatggtggggtatgctctcaaggctgctgagatacttgccaaagagggaataagtgccgaggttataaatttgcgctcaattaggccattggatagagacaccatcaatgcatcagtaaggaaaaccaacagactggttactgttgaagaggggttccctcaacatggtgttggggctgaaatctgtgcatctgtggtagaggaaagcttcaattttcttgatgctccagtggagaggattgctggtgctgatgtttgcatgccttatgcagctaatctcgagagaatggctgttcctcaggttgatgatattgttcgtgcagctaagagagcatgcttcaaggctgcagcacctatggctgctacagacttaaact

SEQ ID NO: 4051 - DNA, 1653 bp, Mimulus guttatus
tgctaccaacattttacaaatcaaacaaacgctcaaggaattctcagctgacccggccgccaatcgggacaacccatatatatatacactcaatttttctctgtttatcatcagtattcactaaatcaaagaaacagacaatatatatatagagagagagagagaaaatactatagaataatatctctcttcgcatcgcaatctctccagcaatttcaccagaggaaaacgagccagcccaccgggatttttgttttagagagagaaaggaaataaaatgttggggattataaggcaaagggctgcctccaaagtcagtcatgcttcgagtttggagcaaggaattcgaacgttgagggcgttttcttcctctgccaagcagatgactgtgcgcgatgctttaaattcggctctcgatgaagaaatgtctgctgatcctaaagtttttgtaatgggtgaagaggtcggtgagtatcaaggtgcatataagattaccaaaggtcttctggataaatatggtcctgagagggttatcgatacacctattaccgaggctggatttgctggaattggagttggtgcagcgtattacggtctaaggcctgtaatagagtttatgacttttaacttctcgatgcaggccatcgatcacataattaactctgctgcgaaatcgaattacatgtctgctggtcagatatcggtgccgattgttttccgaggtccaaatggtgctgctgctggtgtcggtgctcaacactctcagtgctatgcagcatggtatgcatcgtgtccaggactaaaggtactggctccatattcttcggaagatgctcgtggcctgcttaaagctgctattagggaccccgatcctgttgttttcctcgaaaacgaattgctatacggtgaatcatttcctgtctctgctgaagttctcgattccagcttctgtcttcctattgggaaagctaagattgaacgtgaaggaaaagatgtcacaatcactgctttctcgaagatggttggctatgctcttcaggctgccgagattctagcaaaagaaggaattagtgctgaggtcataaatcttcgctcgattcgccctctcgacagatctacaataaacacatctgttagaaaaacgaacaggctcgttactctagaagaaggattccctcaacatggtgttggtgccgagatttgcgctactgtggtcgaagatagctttgaatatcttgatgcacccgtcgagaggatttccggtgccgatgttcctatgccttatgctgcaaatctcgagagaatggctgttcctcaggtggaagacattgttcgtgcagcgaaaagggcatgttacaggtcaagttagagacgacggcaaatcgatcgttttgattatgatatttttacgataaaaaaaaagttattattctttttacaccttgtatggtgtttcgttcatgttacgaggatatagacaagtctactgctgctagcaattctagcaaaaaaaacttttgcaggaaataaggttctcatgcatactttctattcgttctcgatttttggtctgtaaaacgaatggatcaaagagattattcgaagggaggaagtatattttacgtgctttattaaggatgaattatttctttt

SEQ ID NO: 4052 - DNA, 1513 bp, Vinca minor
gactaaaccaccgccacttccatcgggatccaccgcaagctcccatcaccgccgaagattacctcaggaaagctgtggttccgaccgaacttttgtaaataaatcaacaggagatatggcaggtgcattaaggaagatagtaagctgccgagggattcctgtttcggggattcgagtaattgcgtctagggcttactcttcttcgatgaaagagatgacagtccgagatgcgttgaattctgcacttgacgaagaaatgtcagctgattctagcgtctttgtgatgggagaagaggttggtgagtatcaaggtgcatacaagatttccaaagggcttttggagaaatatggtcctgacagggttatcgacactcccattactgaggccggttttgctggaattggagtgggtgcagcttacaagggtctgaggcctgttatagagttcatgacatttaacttctcaatgcaggcaattgaccacatcatcaattcggctgcaaaatcaaactacatgtctgctggtcaaatttcggtgcctattgtttttagaggtcccaatggtgctgctgctggagttggtgctcagcattcccagtgctatgcttcgtggttcggttcggttccggggttgaaagtacttgcaccatactcatccgaagatgctcgtggccttctaaaggctgctataagggacccagatcctgttgttttcctcgaaaatgaattgctgtatggtgagtctttccctgtttcatctgaggtcattgattcaagcttttgtcttccaattggcaaagctaaggttgaacgggaaggaacggatgtcacaattactgcattctcaaaaatggtgggctattctcttaaggctgctgagattctggccaaggaagggatcagtgcagaggttataaatttgcgctctataaggccacttgatagagctacaattaatgcctcagtcaggaaaaccaacagacttgtgactgttgaagaagggttttctcaacatggcgttggagctgagatctgtgcatccgtcgttgaagatagtttcgagcatcttgatgcacctgttgaaagaattactggagctgatgttcccatgccttatgcagcaaatcttgagaggatggctgttccacagattgaggatattgtacgtgcagcaaagagggcatgctatagatctgttccacttgctgctgctgcctaaagttaactgttatgcctttcacttttaaaagttcttcctatcacaaaacaaaagcttttggaagctattattttccttgatcaagggaattttggcatgctgcttttcgaggctgttggtttcacaataaacgcaattatacttgacaacatgttaaaatttaaattgttaagtagtaataaacataaagtgcatttgcccctgggaacacgagcaaaggcttagccaccaatggatgctgatgaatattactccctccattctcatttaattgtcatttaggagatttatagg

SEQ ID NO: 4053 - DNA, 1541 bp, Amsonia hubrichtii
gcccttccttcgtctctccccttcaactcccacgctacaaccacaacccggcgaccggaaaccgggtgtgaactctgcaagattggccacagaatcgccaatagattttttttaaaaataaatcaaccagaagatatggcaggcgcattaaggaagatagtggactgccgaggaattccagtttcgggagttagagtaattgcgtctagggcatactcatctttggtgaaagagatgacggtccgtgatgctttaaattctgcacttgatgaagaaatgtctgctgattctagggtctttctgatgggtgaagaggttggggagtatcaaggtgcatataagatttcgaaagggcttttggagaaatatggtcctgacagggttattgacactcccattactgaggctgggtttgctggaattggagtgggtgcagcttacaagggtctgaagcctgttatagagttcatgacatataacttctcactgcaggcaattgatcatatcatcaattcagctgcaaaatcaaactacatgtctgctggtcaaatttcagtgcctattgttttcagaggtcccaatggagctgctgctggagtaggtgctcagcattcccagtgctatgctgcatggtatggttcagttccaggattgaaggtactggcgccgtactcagcggaagatgcccgtggcctgctaaaggctgctataagagacccagatcctgttgttttccttgaaaatgaattgatgtatggtgagtcgttccctgtttcagctgaggcccttgattcaagctttgttgttccaattgggaaagctaaggtagaacgtgaaggaaaagatgtcacaattactgcattctcaaaaatggttggctatgctctgcaggctgctgagattctggcaaaggaagggatcagtgcagaggttataaatttgcgctccataaggccacttgatagagctacaatcaatgcctccatcaggaaaaccaaccgacttgttactgttgaagaagggtttcctcaacatggtgttggagctgagatctgtgcatctgttgttgaagagagttttgagtatcttgatgcacccgttgaaagaattgctggagctgatgttcccatgccttacgcagcaaatctggagaggatggcagttccacaggttgaggatattgtacgcgcagtgaagaggacatgctacagatcagttccacttgctgctgcggcctaaatttaacaggaatacactttgcttttgatagtctctctcttcaccaaacaaaagcttttggaagctattctttatcttcatcatgtgagttttggctgtgtgtttctattgttgttaagttcacaataaacataattaattcattccttatgcttggcaacaagttaataattatgcagaggatgaatctttgtcttgttctcctcttagggcacctctccaggaatattctatttttacttcaatcttttgaggtaacagtaaggcatttctcctattgtgcgcattgttgaggctatttt

SEQ ID NO: 4054 - DNA, 1700 bp, Solanum tuberosum
agattattctgataataaaataacaagaaagaggaaaaagccgcagttagcgtgcctctctcacattcccaattttgtcactctcgactaattgttcgcgcccgcctccaccaaacacctaatctacagggaatttgatagctagaaggaagcggatatgtctgggattataaatcgaaaaatggccaccagaggcatttctgctttgaatatgaatcagttcctgttgggaagcagggtatttgcatctagaaatttttcttcagcaactaaagagatgactgtccgtgatgctctaaattctgctctggatgaagaaatgtctgcggatccaaaggtctttataatgggggaggaggttggtgaataccaaggagcctataagattaccaaagggctattgaataaatatggtccacaaagagttcttgatacacctattactgaggctggatttactggaatgggagttggtgctgcttaccatggtttgaagcccgttatagaattcatgactttcaacttttcaatgcaggcaattgaccatattatcaattctgctgcaaaatcaaattacatgtctgccggtcagatctcagtccccatcgtcttcaggggtcctaatggtgctgcagctggagttggtgctcaacattctcagtgctatgcggcgtggtttggtgcatgtcctggattgaaggtgctagctccatactcttctgaggatgctcgcggcctgctaaaagctgctatcagggacccagatcctgttgtttttctggaaaatgaattgctatatggtgagtctttccctgtttctgctgaagttcttgattctagtttctctcttcccattggaaaagctaagattgaacgtgaaggaaaggatatcacaattactgctttctcaaagatggttggttatgctcttaaggctgctgaaattcttgcaaaagagggaattagtgctgaggtcataaatttgcgctctatccgaccacttgatagatccaccattaatgcttctgtgaggaaaaccaacagacttttaactgttgaagaagggttcccacaacacggcgttggagctgagatctgtgcatctgtggttgaggaaagttttgagtatcttgatgcaccagttgagaggatatctggggctgatgttcctatgccatatgcagcaaatctagaaagaatggctgttccacagattgaagatattgttcgaggagcaaagagggcatgttacagagcagcaaaatcagttccaatggctgcaactgcttaagctttggtaggaacaaaggctgccaagccggctctatgtggatattgattctttatccgcctgcgagtggatgcttctaaatttaccatcctgagaagtttagtttgtccatgaaaaaagaaaaaaactaaatgttagaaataaatctcgtagaaaataaattttgccgttttctttgctctcttttcactggttttaccaaatgttatgtaagacaaacacatgctactactgatggaagagaaagtagtagacaccattgcaacttctttgtcaagttttgactgctgatagttcacgagaacaaactctgcagtgatatgtaatatgatgtatgcttgcattatttgcaagctacaaaacaacgaattgatctcaaataacgccaatccagtttttgaagaggctc

SEQ ID NO: 4055 - DNA, 1731 bp, Solanum phureja
aataaaataacaagaaagaggaaaaagccgcagttagcgtgcctctctcacattcccaattttgtcactctcgactaattgttcgcgcccgcctccaccaaacacctaatctacagggaatttgatagctagaaggaagcggatatgtctgggattataaatcgaaaaatggccaccagaggcatttctgctttgaatatgaatcagttcctgttgggaagcagggtatttgcatctagaaatttttcttcagcaactaaagagatgactgtccgtgatgctctaaattctgctctggatgaagaaatgtctgcggatccaaaggtctttataatgggggaggaggttggtgaataccaaggagcctataagattaccaaagggctattgaataaatatggtccacaaagagttcttgatacacctattactgaggctggatttactggaatgggagttggtgctgcttaccatggcttgaagcccgttatagaattcatgactttcaacttttcaatgcaggcaattgaccatattatcaattctgctgcaaaatcaaattacatgtctgccggtcagatctcagtccccatcgtcttcaggggtcctaatggtgctgcagctggagttggtgctcaacattctcagtgctatgcagcgtggtttggtgcatgtcctggattgaaggtgctagctccatactcttctgaggatgctcgcggcctgctaaaagctgctatcagggacccagatcctgttgtttttctggaaaatgaattgctatatggtgagtctttccctgtttctgctgaagttcttgattctagtttctctcttcccattggaaaagctaagattgaacgtgaaggaaaggatatcacaattactgctttctcaaagatggttggttatgctcttaaggctgctgaaattcttgcaaaagagggaattagtgctgaggtcataaatttgcgctctatccgaccacttgatagatccaccattaatgcttctgtgaggaaaaccaacagacttttaactgttgaagaagggttcccacaacacggcgttggagctgagatctgtgcatctgtggttgaggaaagttttgagtatcttgatgcacctgttgagaggatatctggggctgatgttcctatgccatatgcagcaaatctagaaagaatggctgttccacagattgaagatattgttcgtggagcaaagagggcatgttacagagcagcaaaatcagttccaatggctgcaactgcttaagctttggtaggaacaaagactgccaagccggttctaagcattttatttcctctatgtggatattgattctttatccacctgcgagtggatgcttctaaatttaccatcctgagaagtttagtttgtccatgaaaaagaaaaaagctaaatgttagaaataaatcccgtagaaaataaattttgccgttttctttgctctcttttcactggttttaccaaatgttatgtaagacaaacacatgctactactgatggaagagaaagtagtagacaccattgcaacttctttgtcaagttttgactgctgatggttcacgagaacaaactctgcagtgatatgtaatatgatgtatgcttgcattatttgcaagctacaaaacagcgaattgatctcaaataacgccaatccagtttttgaagaggctcaaataacattacttggtgtaacttgtt

SEQ ID NO: 4056 - DNA, 1399 bp, Tragopogon dubius
agactcacatcaagtggtggttgttagattcgtcgcgtggcgtcaacttcggcaagcttttcatctctcgccgctgatcggaaagttcgtttttgagctaaaggagagacgatgtgggggattgtaaggcgagaaattggagccaagggcttatctgctttggtctcgaggaattatgtgcagagtttaaggcctgcagcagcaagtatgagacattactcatctgcatccaaagagatgacggttagagatgctctgaactctgctcttgatgaggaaatggctgctgatcctaatgtctttattatgggtgaagaggttggagaataccaaggtgcatacaagatatccaagggattgttggacaaatatggtcctgagagggttgttgacacacctatcacagaggctggatttgccgggattggtgttggttcggcttatcatggtttgaagcctgttatagagtttatgaccttcaacttctctatgcaggcaattgaccacatcatcaactctgcagcaaagtcaaactacatgtccgccggtcaaatcaatgtacccattgttttccgaggaccaaatggtccagctgctggtgtcggtgcccaacattcacagtgttatggtgcatggtacggttcagtccctggcttaaaagtccttgtaccttactcctcagaagacgcccgtggacttctaaaagctgcaatccgtgaccctgatcccgttgttttcctcgaaaacgagttgctatatggtgagtcattccccatttccgatgaagccctagattcaagtttttgcctcccgatcggaaaagccaagattgaaagagaaggaaaagatatcacaatcacagctttctccaagatggttgggtatgctctcaaggctgctgaaatacttgaaaaggatggaattagtgccgaggtaataaacctacggtccattcgaccactagaccgagccacaattaacgcatcagtcaggaaaacaaacaggctggttacagtggaagaaggcttccctcagcatggcattggtgctgaaatctgtgcatcggtggtagaggatagctttgcttatcttgatgccccagttgaaaggattgccggggctgatgttcccacgccttacgctgctaatcttgaacgacacgcttttcctcagattgaggatatagttcgtgcagttaaaagagtatgttacagatctgtaccgatggctgcaaccgcttaaatttatctttacttttggaattccaatgcatcggctttttatttttgacatttgtacatgtctatcggcacgaatttgacttgcataaatttttttatgggagtcttttaacacaactggtatttgtaataagtttggaagcaattcgggagtatac

SEQ ID NO: 4057 - DNA, 1583 bp, Glycine max
agcaaaacattgtgcaccttgttgcatcgatcttaaacacttttggaacagtctaaacgtcgtcgtatgtgtttgcggggatgttgcagcagctcgaggctgtggttgtggggaagggttgcaacaaccctagtaactctctaaaagatcaaggaaggaaggaagcaagatgttgggtgttataaggcacaagagtattcgccatgccttctccgcaataagacacttgtcttctgcagctaaagagattactgtcagggaggctctgaactccgcactcgatgaggaaatgtcagctgatcctaaagtgttcttgatgggtgaagaggttggggaatatcagggtgcatacaagatatccaaggggctgctcgaaaagtttggccccgagagggttcttgatactccaatcactgaggctgggtttgctgggattggagttggtgctgcttactatggtctaaggcctgttgtggagtttatgacttttaacttctccatgcaggcaatagatcatattattaactctgccgcaaaatcaaactacatgtctgctgggcaaatatcggtacctattgtctttagaggacccaatggtgctgctgctggggttggtgctcagcattctcaatgttatgcatcttggtatggctcatgccctgggttgaaagtcttgtcaccatattcatctgaagatgctcgtggtttgcttaaagctgctataagggaccctgatcctgttgttttccttgaaaatgaattgttatatggtgagtcattccctgtttcggccgaagttcttgattccagtttttgccttcccataggaaaagcaaagattgagagggaagggaaagatgtgactattacagcctattcaaaaatggttggctatgctctcaaggctgctgagacactggcaaaggaaggaatcagtgctgaggtcattaatttgcgttcaatccgaccgcttgatcggtccacaatcaatacttctgtcaggaaaaccaacaggctggtgacagttgaagaagggtttcctcagcatggcgttggcgctgaaatctgcacatctgtcattgaggagagttttggttatctagatgcaccggttgagagaattgctggggctgatgttcccatgccttatgcagcaaatctggaaagaatggctgtcccacaggttgaagatattgttcgtgctgcaaagagaacatgctacagatccgtgcctttggctgcatccgcttgaatgttctggaaatttttcatgccatggactcacagatgctatacatttttttcccatctcatcatatctgggaggaagttaatgttaaataacttagacaacagtgacacaaggcagcaggaagttttcaatgtttttggtttctgcttggcaataactaaaagtcaactttttgaatacattatttccagcggaccactttagtgcaaagatctaacttgctgttatttcatcttcgtttactgttttagttacattggcaaactagagatatttgatttgatgtgaggtccttattcttgaggttgtgggtacttagttcatcttctat

SEQ ID NO: 4058 - DNA, 1438 bp, Helianthus annuus
tttctttctttctgagctatcatcggcgtcgcctctttctttcattcttctccacccgctgatccgaaacttgtatatttggtttgaaaggcagagaatatgttggggattgtaaggcgaaacgttgggggtgccggaggcttatactctcagggcttcgggagattaaggccagtagcatcggccataagaaattactcgtctggaggcaaagagatgacagtgcgagacgctttgaactctgctcttgatgaggaaatggctgctgatcctaatgttttcgttatgggtgaagaggttggagaataccaaggtgcatacaagataaccaagggtttattggataaatatggacctgaaagggttcttgatacccctattaccgaggctgggtttgccggtattggagttggttctgcatatcatggtctgaagccagtgatagagtttatgactttcaacttctctatgcaggcgattgaccatgttatcaactctgcagcaaagtcaaactacatgtctgctgggcagattaatgtacccattgtatttagaggaccaaatgggcccgctgccggtgttggtgctcaacattcccagtgttatggtgcgtggtacgggtcagtccctggtttgaaggtgctggtaccttactcatccgaagatgctcgtggacttctaaaagctgcaattagagaccctgatcccgttgtttttcttgaaaatgagttgctgtacggtgaatccttcccagtttctgccgaagctcttgattcgagtttctgccttcctattggaaaagcaaagattgaaagagaaggtaaagatatcacaatcacagctttctctaagatggttggctatgctcttaaggcagccgaaatacttgaaaaggatgggataaatgcagaggttataaatttgcggtccattcgaccactagatagagccacaatcaatgcttcagtcagaaaaactaaccgtctcgtcactgttgaggaagggttccctcaacatggcattggtgctgaaatctgtgcttcggtcattgaagatagcttcggttatcttgacgcaccagtggagagagttgcaggtgccgatgttcccacaccttatgccgccaatcttgagagaatggcttttcctcagatcgaggatattgttcgcgctgcgaagagagcatgctacaggtcggtacctatggctgcaagtgcttgatcacgggtataaagaaagctgacttttgatttgggatgttttaagagagcgtctttcgatttttgaggggcataaatgtcataagttggaaaaagctccgtttttttttaatttttgtattgtattgtgtgaattaactttatagaattttctctttacgtacgtacacatcagctctttttattcaataaggttgaatgcaatgcaagtgataaca

SEQ ID NO: 4059 - DNA, 1661 bp, Tropaeolum majus
cggccggggactcctcaaaaaagcaaaattggagctggtaggcggttgttcccttcgaccttcgtttaccccatttcatcgtataatctttcccgatcgaattcctactgaattcagattctttcagaatataaaaagcaaccaatcgttcagcttagaagggaagaaaatatgtttggggctttaaggcacaagatgttggggcagtccttagcgaaacttcgcccggcagtatcttctcttagatgttactcttctgctggaaaagagatgacagtaagagacgcactgaactctgcaattgatgaagagatgtctgcagaccctaaagtatttttgatgggtgaagaggttggagaatatcaaggtgcatacaagataaccaaagggcttttggagaagtatggccctgagagggtcctcgatacacccattactgaggctggttttactgggattggagttggtgctgcttattatggtcttaagcctgttgtggagttcatgacaatcaacttttctttgcaggcaattgaccacattattaattctgctgccaaatcgaactatatgtcatctggtcaaatcaacgtgcccattgttttcaggggacccaatggtgctgctgctggagttggtgcccagcactctcattgttatgcatcttggtatgcctcttgcccagggttgaaagtgctggccccatattcttctgaagatgcacgtgggcttctaaaagctgctataagggaccctgatcctgttgttttccttgaaaatgagttattgtatggtgagtcgttccctgtttctgctgaagttcttgattccagtttttgtgttccaatcgggaaagccaagattgagagagaaggaaaggatgtgactctcgttgctttttcaaaaatggtgggcttttgtttgaaggcagcagaaatactatcaaaggaaggaattagtgctgaggttgtaaatttgcgatcaattagacctctagatagagccacaatcaacgcttcagtcaggaaaaccaacagattagtgaccgttgaagagggctttcctcagcatggcattggtgctgaaatctgtacatctgttgttgaggagagctttggttatcttgatgcgcctgttgagaggattgccggagcagatgtccccatgccttatgcagccaatctagaaagattggctgttccacagattgaagatattgttcgtgctgccaaaagagcatgctacagatctgcaccaatgtccgctactgcgtagaggaattgtataatttttttcacccttctcatgtccggggaggaagtactcatgaaataatatagagatggcgatattgcgacaccgggattcagtgtttttcgctcatgatgttggcattcaggatttagccccaaactcccacatttttgtgtttttattcgaatctctatttttttcccagatttctgcccatttttttaattaataaagatgcctatttacgagaatctaatacgttattaagtctttggacttcgtcgatgtacaactcgaatgataaattatagctctaactgtaacctgagcaatatcaattgtcttctaaaaatttatgattgaattagttgtatgttcaaactagaaaaaaaaaaaaaaaaaggccg

SEQ ID NO: 4060 - DNA, 1504 bp, Lactuca sativa
agtccgcagttgggcttttgcctttagagtcaaaaatgggctgccactgaaggtacagtcccgatgtccaaagaaacaaacagaggagttgtgttttgtgtatctatattccagtatcgtttataaagggagggagacatacatcaagtggttcaacgattcgtagattgtcgtcaacttcggccagctcttcctattttgccgctgatcggaaagttgtgagtaggaaagaagatgtgggggcttataaggcaagaagttggtgccaggggcttatctgctttggtctctgggagttatgtgcagagtttaaggcctgtagcagcaactagaagacattattcatctgcaacaaaggagatgacagtaagagatgctctcaactctgctcttgatgaggaaatggctgctgaccctaatgtgtttattatgggtgaagaggttggagaataccaaggtgcatacaagatatccaagggattattggacaaatatggtcctgagagggttgttgacacgcctatcacagaggctgggtttgcagggattggtgttggttcggcatatcatggtctgaggcctgttatagagtttatgactttcaacttctccatgcaggcaattgatcatatcatcaattctgcagcaaagtccaactacatgtctgccggccagatcaatgtgcccattgtattcagaggaccaaatggtcctgctgctggtgttggtgcccaacattcacagtgttatggtgcatggtacggttcagtccctggcttgaaggtgcttgtaccttactcctctgaagatgctcgtggacttctaaaagctgcaatcagagaccctgaccctgttgttttccttgagaacgagctcttatatggtgagtcgttcccaatttctgctgaagccctagattcaagtttctgcctccccataggaaaagccaagattgaaagagaaggaacagatatcacaatcacagctttctccaagatggtgggatatgctcttaaggctgcagaaatacttgaaaaggaagggataagtgcggagataataaacctgcggtcgatcaggccactagatagagccacaataaacgcctctgtcaggaaaacaaaccgactggtgactgtggaggaaggctttcctcagcatggtgttggggctgaaatctgtgcatcggtggttgaggatagctttgcttatcttgatgcacctgtggagaggatcgccggggctgatgttcccacgccttatgctgctaatcttgagagatctgcttttcctcagattgaggacattgttcgtgcagctaaaagagtatgctacagatctgtacccatggctgcaaccgcttaactttaattaattatgccatttttctttcccatccatccaagttttgggttttctaccttacctgtacttgtacatgtcttccaaaagagttaaaagacatgatgtttttaataagcttgaaagtttaactttccttttt

SEQ ID NO: 4061 - DNA, 1241 bp, Manihot esculenta
actctattttaacagagagtaagaaatcgataaaaacgagcagtgaagcaaaagtgtcgatctggcaccggagcgcgtcctttttccatcttcgaactgattcgatctgtctcgaccaaagaactcgagtgaaagttagtagaagaagaagaaaagtatgttgagaattataaggcaaaaaaggattctgcctgcggcttcatcattgaggggttactcatccgcttctaaacagatgatggttagagaagctctgaactctgctcttgatgaggaaatgtcagctgatcctaaagtctttttgatgggagaagaggttggggaatatcagggcgcatataagatatctaaagggcttttggagaagtatggtcctgaaagggttcttgatactccaattactgaggctggattcaccggcatcggagttggtgctgcttactatggtcttaagccagttgttgagtttatgacttttaacttctctatgcaggcaattgaccatatcattaactctgcagcaaaatcatgttacatgtctgctggccagatatctgtgcctatagttttcagaggaccaaatggtgctgctgcaggagttggggctcaacactctcaatgttatgcttcatggtatgcctcctgtcctgggttgaaagtgctggccccttactcatctgaagatgctcgtggattgctgaaagctgccataagggaccctgatcctgtggttttccttgaaaatgagttattatatggtgagtcgtttcctgtttcagctgaagtacttgactctagtttttgccttcctataggaaaagccaagattgagagagaaggaaaggatgtgacaatcacagccttctcaaaaatggtgggctatgctctcaaggcagctgagatacttgcaaaggatggaatcagtgctgagattataaatttgcgctcaattaggccactagatagacctgcaatcaatgcttcagtccggaaaaccagcaggctggtgacagttgaagaaggattcccccagcatggtgttggggccgaaatctgtgcatctattatcgaagaaagctttggctatcttgatgcaccagttgagagaattgctggagctgatgttcccatgccctatgcagctaatcttgagagaatggctgtacctcaggtcgaggatatagtccgtgcagcaaagagagcttgctacagatccaagccaatggctgcagctcagtaat

SEQ ID NO: 4062 - DNA, 1498 bp, Ipomoea nil
ggttgcccaaacactcctccatcaaacagtcaaacacctcccagggctgtgattgtgcgagtagaagaggattgatatgtctggaattgtaggtcgcaaaatggcctctactggcatttctgctctgattgcaaacagatttttgatgagaagcagggtatttgcatcccgcagcttctcttcaacgactaaagagataacagtgcgtgatgccttgaattcagcacttgatgaagaaatgtctgcggatcctaaggtctttttaatgggtgaagaggttggtgagtaccagggggcatacaagattacaaaagggcttttggagaagtatggtccagacagagttcttgatacacctattactgaggctggatttgctgggattggagtgggtgcagcttactatggtctgaagcctattatagaattcatgacatttaacttttcaatgcaggcaattgaccatatcattaattctgctgcaaaatcaaactacatgtctgctggtcagatctctgtgcctattgttttcagaggacctaatggagctgcagctggtgttggtgcccagcactcccagtgctatgcagcatggtatgctgcatgtccaggacttaaggttctagctccatactcttctgaagatgctcgtgggcttctcaaagctgctattagggacccagatcctgttgtattccttgaaaatgaattgctatatggcgagtccttccctatttcagatgaagctcttgattctagtttctgtcttccaattgggaaagctaaaattgaaagagaaggaaaggatgtgactatcactgctttctcaaaaatggtgggctatgctctaaaggctgcagagattcttgcaaaggaaggaatcagtgctgaggttataaatttgcgctcaatcagacctcttgatagatccaccatcaatgcttctgtcaggaaaaccaacagacttgtaactgttgaagaagtgttcccacaacatggtgttggcgctgagatctgtgcaactgttgtcgaggaaagctttggataccttgatgcacctgttgaaaggatatcgggagctgatgttcctatgccttatgcagcaaatcttgaaagaatggcccttccacaggttgaagatatagttcgtgcagccaagaggacttgttatagatcagttcaaaaggccgctgctgcttagaattatccagattgaaatttgaaatttacacctttatttacacctgcccttttgtggatattgattctttgtccacctcggtgttgaggcagtcttccttttgctcttaacttgaaacttcagcatgaatgcaacacataggacaaacaaataactgatattgagcagtgtcggaataaattttttgtaaaaaataaaattcgcgggatatatatttcccccattttgtcataacacattggagaagccttgatgtggactgctgaaaagcagatatttcttcttatgttgcaacgc

SEQ ID NO: 4063 - DNA, 1591 bp, Capsicum annuum
gcacgaggattgagagcaagtgacaataatatcgggccgtggtgtgttgcaaagggaaagagcattcagaggtgcatagctttgtctctcgggtcccattattatactcttacctccgccattgacaaagctaacaaggaccagacatggctggaattattggccggacaatggccactgcaaagatatctaatttgaacaagtttttggtgggaagcagggtgtctgcatctagaacttactcttccgcagctaaagagatgacagtgcgtgacgcactaaattcagctctagatgaagaaatgtctgcggatcctaaggtctttgtcatgggggaagaggttggtgagtaccagggagcttataagattacaaaggggcttctggataaatatggtccagaaagggttctagatacaccaattactgaggctggatttactggaattggagttggtgcagcttactatggtctaaaacccataatcgaattcatgacattcaacttttctatgcaggcaattgaccatattatcaattctgctgcaaagtcaaactacatgtctgctggtcagatatctgtgcccattgttttcaggggtcctaatggtgctgcagctggcgttggtgcgcaacactctcagtgctatgcggcatggtatggtgcttgtccaggattaaaggtactagcaccatactcttctgaagatgctcgtggcttgctcaaagctgctatcagggatcctgatcctgttgtgtttctggaaaatgaattgctatatggtgaatctttccctgtttcagctgaagctcttgattctagtttctctcttcccatcggaaaagccaagatagaacgcgaagggaaggacgtgacaatcactgccttctcaaagatggttggctatgctctcaaggctgctgaaattcttgataaggaaggaattagtgctgaggttataaatctgcgctcgatccgaccacttgatagacctgccattaatgcatccgtgaggaaaaccaacagacttgtaactgttgaagaaggatttccacaacatggtgttggcgctgagatctgtgcatctgtggttgaggagagcttcgagtatcttgatgcaccagttgagaggataacaggtgctgatgtccctatgccatatgcagcaaatcttgaaagactggctgttccacagatagaagacatcgtgcgtgcagccaagagggcttgttaccgatcaaagtaactaatcagttgcagctgcttaggctggtccaacaaggtcttgcttgttccaaagcatttaacttcttttttgtggatattgattctttatccacctgtgtgtggatgcttctttgccatcttccggaaaagtttactcaactgtaaaaccagctaaactagttaaactaaattacctaatgaaatctgctgccagaattttcagcacacgaggaaacagtttttatagagaataaaatttacaccttctatgctttctggtaatacattccggaaaacgtttttgtaagagaacacatgcgtttgagaaatgtcaaatttcagtgccaaaaaaaaacctcgtgc

SEQ ID NO: 4064 - DNA, 1661 bp, Lippia dulcis
cggcaaccaggccaaggtcattttccaatttccgccattgtactcgggttgtctccttctacttgtagcgaggtcttgtgaaatcatcgggatttgttgttaagagaggaagaacaatgttggggattataagccggaggggggtctgcaaaggcagtcacgcttcgagttcggagcaaggaattcgatcaattgcattgagggctttttcttcctctgccaaggagcaaatgacagtgcgtgatgctttaaattctgcacttgatgaagaaatgtctgctgatgacaaagttttcttgatgggtgaagaggttggtgagtatcagggtgcatataagatcaccaaagggcttctggataaatatggtcctaagagagttgttgatacacctattactgaggctggctttactggaattggagtaggtgcagcatatcatggtttaaggccagtagtagagttcatgacttttaacttctctatgcaggccatcgaccatatcattaattcagctgcaaagtcaaattatatgtctgctggtcagatatctgtacctatagttttcagaggcccgaatggcgcggctgctggtgtgggtgctcaacattcacagtgctatgcagcatggtatggctcatgtccaggattaaaggttctggcgccatattcgtcagaagatgcacgtggcctgcttaaagctgctataagggatccagatcccgtcgtgttcctagaaaatgaacttctgtacggtgaatcatttcctatatcagctgaagctcttgattcaagtttttgtctgcctattggtaaagctaagatagaacgtgagggaaaagatgtaacaatcgttgccttctcaaaaatggttggatattctcttcaggctgctgagatcctagcgaaagaagggattagtgctgaggtgataaatcttcggtcaatccgcccgcttgatagatctacaataaatacctcagtcagaaaaacaaataggattgtgactgtcgaagaagcattccctcaacatggcgttggtgctgagatatgtgcttctgttgttgaagaaagctttgaatatcttgatgcacctgttgagaggattgctggggctgatgttcccatgccttatgctgcgaatctggagagattagctgttccacaggtggaagacattgtgcgtgcagccaagagggcttgttacaggtcgagttaaccaaaacctggaaatgaaggttcttatgtggttcctacgcatgtcttttgtcctaattgttcttcacacacgtctacggcctgcttatttaccagcgaaaagctttaatgaatgctgattccctgaagaccaagattgatagacatggtctttcttgctctatcaacattaaaaaaaaacgaactttaataggaaataaggttttgatactggcttctctattcttggaaattcttgggaatgttaatctgtaaaaaaactgattgaagcaaagtttttcggccgtttttctcactttgctgaattttgtgggcaattccagttctttggatgcattttttcaccatatttgtagtatatgttccgggaatgttatatgtaccaagtatttgttcttgatattaagctataaactgctcaaaatggatcgagtgatcgccaaag

SEQ ID NO: 4065 - DNA, 1332 bp, Plantago ovata
aacaaccacaaccagcaagcaataaagctgataggacataatggttggggattattaggcaaagagtagcctccataggcaatccatctctgagtttggagcaaggaatccgagccattgcttccaggacttttgcctcatctggaaagcagatgactgtgcgtgatgctttaaattcagcacttgatgaagagatggcagctgatcccaaggtctttattatgggagaagaggtcggagaatatcaaggtgcatataagatatccaaagggcttctggcaaaatatgggccggatagggttgtggacacaccaatcaccgaggctgggtttgctggaattggagttggtgctgcgtattatggtctgaaacctgtaatcgaatttatgacttttaacttctcaatgcaggctatcgatcacattatcaattctgctgccaaatcaaactacatgtctgctggtcaaatatcagtacctattgttttccgaggacctaatggtgctgctgctggtgttggcgctcaacattctcagtgctatgcagcatggtttggtgcctgtcctggattaaaggtattaaccccttattcttctgaagatgctcgtggactgcttaaagctgctataagggatccggatcctgttgtattccttgaaaatgaattgctttatggtgaatccttccccgtatcagatgaagtccttgattctagtttttgtcttcccatcggcaaggctaagatagaacgtcaaggaacggatgtaactatcactgctttctcgaagatggttggttatgctctccaggctgcggagattctagcgaaggaaggaatcagtgccgaggtgataaatcttcgctcaattcgccctctagatagatctaccataaatgcttctgtaaggaaaaccaataggcttgtaacactggaagagggattcccccaacacggtgttggtgctgagatctgtgcgtctgttcttgaagatagctttgagtatcttgatgcccctgttcagaggattgctggtgctgatgttcccatgccctatgctgcgaatcttgagagattagccctcccgcaggttgaagatatagttcgggctgcaaagaggacctgttacagatcatctgctgcgctggccgccactgcataaagttgaggaagaaaagagatttttcttgtactcatttttttggtgtccaaataattcttttatacaccttcatggtgtgtagtgtgtaccttcttgaaaatgtttggatgattcaagggttggcgcaacctggttaggtagcaacaaactgtgacggggaataaggttttcg

SEQ ID NO: 4066 - DNA, 1217 bp, Guizotia abyssinica
acaggaggcgtatcgtctcaggggctggggagttatatgatgaggttaaggcctgtagcatcagccatgagaaattactcatctgcaacaaaagagatgacagtgcgagatgctttgaactctgctcttgatgaggaaatggctgctgatcctaatgtttttgttatgggtgaagaggttggagaataccaaggtgcatacaagataaccaagggattattggataaatatggtcctgaaagggttgttgatacccctatcacggaggctggatttactggaatcggagttggtgctgcatatcatggtctgaggcccgtaacagagtttatgacattcaacttctctatgcaggcaatcgaccatatcatcaactctgcagcaaagtcaaactacatgtctgctgggcagattaatgtacccattgtttttagaggacctaatgggcccgctgctggtgttggtgctcaacattcccagtgttatggtgcatggtatgggtcagtccctggtttaaagtgcttgtaccttactcatctgaagatgctcgtggacttcctaaagctgcaattagagatcctgatcctggtgttttcttgaaaatgagttgctatatggtgaatccttcccagtttccgctgaagtccttgattcaagtttctgtcttcctattggaaaagcaaagattgaaagagaagggaaagatatcacaatcacagctttctctaagatggttggccatgctcttaaggcagctgaaatacttgaaaaggatgggataagtgcagaggttataaacctgcggtccattcgaccactagatagagctacaatcagtgcttcagtcagaaaaaccaaccgtctggtcactgttgaggaagggtttcctcaacatggcattggtgctgaaatctgtgcttcggtcgttgaagacagctttggttatcttgatgcaccagtggagaggattgcaggggctgatgttcccacaccttatgctgccaatcttgagagaatggcttttcctcagatagaggatattgttcgcgctgctaagagggcatgctaccggtcagtatcgatggctgcaagcgcttgatgaacgggtatagaaactgcactctgggtttggcatgttttggggattcatctctgattttgaggggcgtaatgtctagatccggaagctcccatcttgttttaatggtgtataactt

SEQ ID NO: 4067 - DNA, 1852 bp, Abies balsamea
attaagctttcacagtttacgctgtaatctataaataagcatctgcaaaatgctacccaagacatataccccacgttttgctttatgaaaacattattattctttggcagaattaagggttggtgaaagcgtgaaggttagctatacgcagacagacagaggaagaagaacagagcaaactctagggtttggtggggcaaccaacaaggacgtggttggtgaggaatacggatttttttccgacccgcttgcccttttctgcgaggaccgtgattcctgcgttggaggcaaatcggtcattggctgtcttcttcaatttcccctgctcaggatttcggtttccccagttaaactctaaggagagaagatgtggggcgctttgcggcaaaaatctggcttgacaactcttgtttcttcgttgaggcatggtcaagtttcggagaggttggtgtctatggcatccacacccttaagacagttatctactgctgctaaagagatgactgtgcgggatgctcttaactcagctattgatgaagaaatgtctgcagatccaaaagtctttttaatgggagaagaggttggtgaataccaaggagcatataagatatcgaaaggtcttttgcagaagtttggacctgatagggttcttgacaccccaatcacagaggcaggtttcactggaattggtgtgggtgcagcatattatgggctacgaccaattgtggagttcatgactttcaattttgccatgcaggctattgatcaaataataaattctgcagccaagacatgttatatgtctgccggtcaaatttccgttcccatcgttttcagaggaccaaatggagcggctgctggtgttggtgctcagcactcacagtgttatgctgcatggtatgcttcctgtccagggcttaaagttttgactccctattcagcagaagattctcgtggattgctgaaagccgccatccgtgacccagatcctgtcgtctttcttgaaaatgaattgctgtatggggagtcttttccagtctcagcagaatgtcttgatcctagcttctgtcttcccattgggaaagcaaagattgaacgagaaggaagagatgtaacaatcaccgccttttctaaaatggttggctatgcattacaggctgcacaagagcttgaaaaggaagggatcagtgctgaggtaataaatcttcgttcaattcgaccattggacagagctacaattaatgcgtctgttaggaagacgagtcgacttgtgacagtggaagaaggctttccacaacatggaattggtgcagaaatctgcacttctgtgattgaggaaagttttgaatatctggatgctcccgtcgaaagaattgctggtgcagatgttcctatgccctatgctgcaaatttggagcgcttagctgttccacaggttgaagacatcatccgtgcctcaaaaagagcttgttatagagcagttccaatgagcgcagttgcctagtttaaattttgatttcattcatcatcctcttgaggatgcaagtttgtatcctgtgaacaaagcctttatatattgaaatctgtccggaggcataaggcaatctttttaaacttttatatgcgaaggttatatggagagggcttgttgtttttggagtcgtaaaaaagtatattcgtctcacatgttttccatcagtcctctgaatgggaatcgatccttgtttggttcagctttaatatttatgcagtattattgtatgcctggtttttggaaaactggtgctagttcattcttccgagttaaaaaaataaatgctcaaatataagtgattgttcttaatgttaaccg

SEQ ID NO: 4068 - DNA, 1894 bp, Pinus pinaster
aagcatctccgtaaagctacccaatacccacaggcccccacggtttacttacgaaatcatcattattattaggcagactcaagttattgggcagactcaagggtttggtgaaaacgtgaaggttagctatacgcagacgcagacagacagaggaagaagaacagagcctagggtttggtgggagtaaccaacaaggttgtggttggtgaggaagacgactctttgtctgacccgacttcctttttctgtgagttctgtggttcctgcgtcggacgcaaatcggccattgacagtgttattcaatcttctcagttaaattctaagaagagaagatgtggggtgctttgcggcaaaaatctggcatgacaactcttttttcttcattgagacatggtcaagttttggagaggttggtgcctatggcatccacacccttaagaaatttatctactgctgctaaagagatatctgtgagggatgctcttaactcagctattgatgaagaaatgtctgcagatccaaaagtctttttaatgggagaggaggttggtgaataccaaggagcatataagatatcaaaaggccttttgcagaagtttggacctgacagggttctagacaccccaatcactgaggcgggttttactggaattgctgtgggtgcagcatactatgggctacgaccaattgtggagttcatgacctttaattttgccatgcaggctattgatcaaataataaattctgcagccaagacatattatatgtctgcaggtcaaatttctgttcccattgtttttagaggaccaaatggagctgctgctggtgttggtgctcagcactcacagtgttatgctgcatggtatgcttcttgtccagggctgaaagttttgaccccctattcagcagaagattctcgtggattgatgaaagctgccatccgtgatccagatcctgtcgtttttcttgaaaatgaattgctgtacggggagtcttttccagtctcagcagagtgtcttgatcctagcttctgtctccccattgggaaggcaaagattgaacgagaaggaaaagatgtaacgatcactgccttttctaaaatggttggctatgcattacaggctgcacaggagcttgaaaaggaagggatcagtgctgaggtaataaatcttcgttcgattcgaccattggacagagctacaattaatgcatccgttaggaagacaagtcgacttgtgacagtggaagaaggctttccacaacatggaattggtgcagagatctgcgcttctgtggttgaggaaagttttgaatatttggatgctcctgtggaaagaatcaccggtgcagatgttcctatgccatatgctgcaaatttggagcgcttagctgttccacaggtcgaagatatcatccgtgcctcaaaaagagcttgttatagagcagttccaatgagtgcagtcgcgtagtgtaaatgttgatttctttgatcatcgtcatgcaagtttgtatactgtgaacaaagtctctatatatggaaatctgcctaaggcacatggcaagctcatttttaactttgtttatgttaagattgttggcactgtctattttagtgcccgcgaaggtcacatggagagagggcttgtttttctggagttggaaaaaagtatgttcattctacatgttttccatgagtccagtgattagaatcgatccttgtttggttcagcttcaatattatgcactattattgtatgcctggttcttgagaaattggtgccagctcattcttctgagttcaaaaaataatgatcgaataccagtggttgttcgtaatgttagccgttcagaaaaaatggcatttcatttggatatatagcacattttaaagcat

SEQ ID NO: 4069 - DNA, 1837 bp, Pinus taeda
acccaatacccacaggcctccacggtttacttgacgaaatcatcattattgttgggcagattcaagccaccccggtttacctgacgaaaccatattattattgggcagactcaagggtttggtgaaaacgtgagggttagctgtaagcagacgcagacagacagaggaagaagaacagagcctagggtttggtgggagtaaccaacaagggcgtggttggtgaggaagacgactccttgtctgacccgacttcatttttctgcgatatctgtggttcctgcgtcgacgcaaatcggccattgacagtgttattcaatcttctcagttaaactctaagaagagaagatgtggggtgctttgcggcaaaaatctggcatgacaactcttttttcttcattgagacatggtcaagttttggagaggttggtgcctatggcatccacacccttaagaaatttatctactgctgctaaagagataactgtgagggatgctcttaactcagctattgatgaagaaatgtctgcagatccaaaagtctttttaatgggagaggaggttggtgaataccaaggagcatataagatatcaaaaggccttttgcagaagtttggacctgacagggttctagacaccccaatcactgaggcgggttttactggaattgctgtgggcgcagcatactatgggctacgaccaattgtggagttcatgaccttcaattttgccatgcaggctatcgatcaaataataaattctgcagccaagacatattatatgtctgcaggtcaaatttctgttcccattgtttttagaggaccaaatggagctgctgctggtgttggtgctcagcactcacagtgttatgctgcatggtatgcttcttgtccagggctgaaagttttgaccccctattcagcagaagattctcgtggattgatgaaagctgccatccgtgatccagatcctgtcatttttcttgaaaatgaattgctgtatggggagtcttttccagtctcagcagagtgtcttgatcctagcttctgtctccccattgggaaggcaaagattgaacgagaaggaaaagatgtaacaatcactgccttttctaaaatggttggctatgcattacaggctgcacaagagcttgaaaaggaagggatcagtgctgaggtaataaatcttcgttcaattcgaccactggacagagctacaattaatgcatccgttaggaagacaagtcgacttgtgacagtggaagaaggctttccacaacatggaattggtgcagagatctgcgcttctgtggttgaggaaagttttgaatatttggatgctcctgtggaaagaatcaccggtgcagatgttcctatgccatatgctgcaaatttggagcgcttagctgttccacaggttgaagatatcatccgtgcctcaaaaagagcttgttatagagcagttccaatgagtgcagttgcatagtgtaaatgttgatttctttgatcatcgccatgcaagtttgtatactgtgaacaaagtctctatatatggaaatctgtctaaggcacatggcaagctcatttttaacttttgtttatgttaagattgtcggcactgtctattttagtgcccgcgaaggtcacatggagagagggcttgttttttctggagttggaaaaaagtatgttcattctacatgttttccatcagtccagtgattagaatccatccttgtttggttcagcttcaatattatgcactattattgtatgcctggttcttgagaaattggtgccagctcattcttctgagttaaaaaaataatgattgaatacca

SEQ ID NO: 4070 - DNA, 2001 bp, Pseudotsuga menziesii
cgcccactcgacattctgctttaagaaatcattcttattgtttggacgaatcaagggtttggtgaaagcgtggaggttagctgtacgcagacagacagggaaggaaagccagtggcgtagggtttggtggagcgaccacaagggtgaggttggtgaggaaaacagattttctccaacccgctttcctgtttctgcgagtgccgtgcttcgtgcgttggatgcaaatcggccatcgacggtcttcttcaaactcttcagttaaactgtaaggagagaagatgttgggtgctttgcggcaaaaatccggtttgacaagtcttgtttcttcattgaggcatggtcaagttttggagaggttggcgcctatggcatccacacctttaagaaagttatctactgctgctaaagagatgactgtacgtgatgctcttaactcagctattgatgaagaaatgtctgcagatccaaaagtttttttaatgggagaagaggttggtgaataccaaggagcatataagatatcaaaaggccttttgcagaagtttggacctgacagggttctagataccccaatcactgaggcaggtttcactggaattggtgttggcgcagcatattatgggctacgaccaattgtggagttcatgaccttcaattttgccatgcaggctattgatcaaataataaattctgcagccaagacatattatatgtctgcaggtcaaatttctgttcccattgttttcagaggaccaaatggagctgctgctggtgttggtgctcagcattcacagtgttatgctgcatggtatgcttcatgtccagggctgaaagttttgactccctattcagcagaagattctcgtggattgttgaaagctgctatccgcgacccagatcctgtcatttttcttgaaaatgaattgctgtatggaatgtcttttcctgtctcagctgagtgtcttgatcctagtttctgtctccccattgggaaagcaaagattgaacgagaaggaaaagatgtaacgatcactgcgttttctaaaatggttggttacgcattacaggctgcacaggagcttgaaaaggaagggataagtgccgaggtgataaatctccgttcaattcgaccattggacagagcaacaattaatgcatctgttaggaagacaagtagacttgtgactgtggaagaaggctttccacaacatggaattggtgcagaaatctgcacttctgtggttgaggaaagttttgaatatttggatgctcctgtggaaagaatcactggtgcagatgttcctatgccttatgctgcaaatttggagcgcttagctcttccacaggtcgaagacatcatccgtgcctcaaaaagagcttgttatagagcagttccaatgagtgcagttgcctagtttaaattttgacttctttgatgatcctcttttagatgcaagtttgtaatatgtatcctgtgaacaaaagcttctatatattgaaatctgtcatgaggcataaggcaagctcattttgaacttctatataggtaaagattgtccccacttgctatttaatacctgcgaaggttacatggagagggcttttttgtctggagtcgggaaaaagtatgttcattctacatgttttccatcagtccaatggttgcaaatcgatccttgtttggttcagcttcaatatctatgcactattattgtttgccaggttcttggaaaattggtgccagctcattcttccgagtttaaaaaataaatgctcaaataccaatgattgttcttaatattagctgttcagaaaaatgacatatttcatttggatgataccggtttaaggaatatctactgtcattttaggtttggcctgaataaatgattcagctgcacagtgcattttcaacactttctgggtccaattggatatatagcacattttaaagcaatttatggacatgcattcagatatgatctagataagtatatcaat

SEQ ID NO: 4071 - DNA, 1401 bp, Vinca minor
acaaaaacctcaccaccgccactctcatcggaatccaccgcaagccgccataaccggcaaatattacttcagataagcagtgattccgccgagcttttgtaaataactcaacaagaagatatggcaggtgcattaaggaagatagtaggctgccgagggattcctgtttcggggattcgagtaattgggtctagagcttactcttcttcggggaaagagatgacagtccgagatgcgttgaattctgcactcgatgaagaaatgtcagccgattctagagtctttgtgatgggagaagaggttggtgagtatcaaggtgcatacaagatttccaaagggcttttggagaaatatggtcctgacagggttatcgacactcccattactgaggccggttttgctggaattggagtaggtgcagcttataaaggtctgaagcctgttatagagttcatgacatttaacttctcgatgcaggcaattgaccacatcatcaattcagctgcaaaatcaaactacatgtctgctggtcaaatttcagtgcctattgttttcagaggtcccaatggtgctgctgctggagttggtgctcagcattcccagtgctatgctgcgtggttcggttcggttcccgggttgaaagtacttgcaccatactcatccgaagatgctcgtggtcttctaaaggctgctataagggacccagatcctgttgttttccttgagaatgaattgctgtacggcgagtctttccctatttcatctgaggcccttgattcaagcttttgtcttccaattggcaaagctaaggtagaactggaaggaaaggatgtcacaattactgcattctcgaaaatggtgggctatgctcttaaggctgctgagattcttgccaaggaagggatcagtgcggaggtaattaatttgcgctccataaggccacttgatagggctactatcaatgcctcagtcaggaaaaccaacagacttgtgactgttgaagaagggttttctcaacatggcgttggagctgagatcagtgcatccgtcgttgaagatagttttgagtatcttgatgcacctgttgaaagaattacaggagctgatgttcccatgccttatgcagcaaatcttgagaggatggctgttccacagattgaggacattgtccgtgcagcaaagagggcatgctatagatcagttccacttgctgctgctgcctaaagttgaactgttatgcgcttcacttttaaaagttcttcctatcacaaaacaaaagcttttggaagttattcttttccttgatccaagggagtcttggcatgttgtttttcgatgatgttagtatcacataaacccaattatacttgacaacatgttaataagcaataagatcagatt

SEQ ID NO: 4072 - DNA, 1904 bp, Pinus taeda
cggccggggatctccgtaaagctacccaatacccacaggcctccacggtttacttgacgaaatcatcattattgttgggcagattcaagccaccccggtttacctgacgaaaccatattattattgggcagactcaagggtttggtgaaaacgtgagggttagctgtaagcagacgcagacagacagaggaagaagaacagagcctagggtttggtgggagtaaccaacaagggcgtggttggtgaggaagacgactccttgtctgacccgacttcatttttctgcgatatctgtggttcctgcgtcgacgcaaatcggccattgacagtgttattcaatcttctcagttaaactctaagaagagaagatgtggggtgctttgcggcaaaaatctggcatgacaactcttttttcttcattgagacatggtcaagttttggagaggttggtgcctatggcatccacacccttaagaaatttatctactgctgctaaagagataactgtgagggatgctcttaactcagctattgatgaagaaatgtctgcagatccaaaagtctttttaatgggagaggaggttggtgaataccaaggagcatataagatatcaaaaggccttttgcagaagtttggacctgacagggttctagacaccccaatcactgaggcgggttttactggaattgctgtgggcgcagcatactatgggctacgaccaattgtggagttcatgaccttcaattttgccatgcaggctatcgatcaaataataaattctgcagccaagacatattatatgtctgcaggtcaaatttctgttcccattgtttttagaggaccaaatggagctgctgctggtgttggtgctcagcactcacagtgttatgctgcatggtatgcttcttgtccagggctgaaagttttgaccccctattcagcagaagattctcgtggattgatgaaagctgccatccgtgatccagatcctgtcatttttcttgaaaatgaattgctgtatggggagtcttttccagtctcagcagagtgtcttgatcctagcttctgtctccccattgggaaggcaaagattgaacgagaaggaaaagatgtaacaatcactgccttttctaaaatggttggctatgcattacaggctgcacaagagcttgaaaaggaagggatcagtgctgaggtaataaatcttcgttcaattcgaccactggacagagctacaattaatgcatccgttaggaagacaagtcgacttgtgacagtggaagaaggctttccacaacatggaattggtgcagagatctgcgcttctgtggttgaggaaagttttgaatatttggatgctcctgtggaaagaatcaccggtgcagatgttcctatgccatatgctgcaaatttggagcgcttagctgttccacaggttgaagatatcatccgtgcctcaaaaagagcttgttatagagcagttccaatgagtgcagttgcatagtgtaaatgttgatttctttgatcatcgccatgcaagtttgtatactgtgaacaaagtctctatatatggaaatctgtctaaggcacatggcaagctcatttttaacttttgtttatgttaagattgtcggcactgtctattttagtgcccgcgaaggtcacatggagagagggcttgttttttctggagttggaaaaaagtatgttcattctacatgttttccatcagtccagtgattagaatccatccttgtttggttcagcttcaatattatgcactattattgtatgcctggttcttgagaaattggtgccagctcattcttctgagttaaaaaaataatgattgaataccagtggttgttcgtaatgttagccgttcaggaaaaatgacatttca

SEQ ID NO: 4073 - DNA, 1672 bp, Solanum lycopersicum
ttattctgattaataaaataagaagaaagaggaaaaagccgcagttagcgtgcctctctcacatttccaattttgtcactctcgactaattgttcgcgcccgccaccaccaaacacctaatctacagggaatttgatagctacaaggaagcggatatgtctgggattataaatcgaaaaatggctaccagaggcatttctgctttgaatatgaatcagttcctgttgggaagcagggtatttgcatctagaaatttttcttcagcaactaaagagatgactgtccgtgatgctttgaattctgctctggatgaagaaatgtctgcggatccaaaggtctttataatgggagaggaggttggtgaataccaaggagcctataagattaccaaagggctgttgaataaatatggtccacaaagagttcttgatacacccattactgaggctggatttactggaatgggagttggtgctgcttaccatggtttgaagcctgttatagaattcatgactttcaacttttcaatgcaggctattgaccatattatcaattctgctgcaaaatcaaattatatgtctgccggtcagatcgcagtccccatcgtcttcaggggtcctaatggtgctgcagctggagtaggtgctcaacactctcagtgctatgcggcgtggtttggtgcatgtcctggattgaaggtgctagctccatactcgtctgaggatgctcgcggtctgctaaaagctgctatcagggacccagatcctgttgtttttctggaaaatgaattgctatatggtgagtctttccctgtttctgctgaagttcttgattctagtttcgctcttcccattggaaaagctaagattgaacgtgaaggaaaggatatcacaattactgctttctcaaagatggttggttctgctcttaaggctgctgaaattcttgcaaaagagggaattagtgctgaggtcataaatttgcgctctatccgaccgcttgatagatccaccattaatgcttctgtgaggaaaaccaacaggcttttaactgttgaagaagggttcccacaacacggcgttggagctgagatctgtgcttctgtggttgaggaaagttttgaatatcttgatgcaccagttgagaggatatctggggctgacgttccgatgccatatgcagcaaatctagaaagaatggctgttccacagattgaagatattgttcgtggagcaaagagggcatgttacagagcagcaaaatcagttccaatggctgcaactgcttaagctttggtaggaacaaagactgccaagctggttctaagcgttttatttcctcttatgtggatattgattctttatccgcctgcgagtggatgcttctatatttaccatcctgagaagtttaatttgtccatgaaaagaaaatgctaaatgttagaaaataatttttgccgtttacttgcgctctcttttcactggtgttaccaaatgttatgtaagacttgtcagttttgaccgctgagggttcacgagaacaaactctgtagtgatatgtaatatgatatatgcttgcattatttgtaatctacaaaacaatgtattgatctcaaataacgccaatccagtttttgaagaggctcgaataacatcacttggtgtaacttgtt

SEQ ID NO: 4074 - DNA, 1645 bp, Solanum lycopersicum
agaggaaaaagccgcagttagcgtgcctctctcacatttccaattttgtcactctcgactaattgttcgcgcccgccaccaccaaacacctaatctacagggaatttgatagctacaaggaagcggatatgtctgggattataaatcgaaaaatggctaccagaggcatttctgctttgaatatgaatcagttcctgttgggaagcagggtatttgcatctagaaatttttcttcagcaactaaagagatgactgtccgtgatgctttgaattctgctctggatgaagaaatgtctgcggatccaaaggtctttataatgggagaggaggttggtgaataccaaggagcctataagattaccaaagggctgttgaataaatatggtccacaaagagttcttgatacacccattactgaggctggatttactggaatgggagttggtgctgcttaccatggtttgaagcctgttatagaattcatgactttcaacttttcaatgcaggctattgaccatattatcaattctgctgcaaaatcaaattatatgtctgccggtcagatcgcagtccccatcgtcttcaggggtcctaatggtgctgcagctggagtaggtgctcaacactctcagtgctatgcggcgtggtttggtgcatgtcctggattgaaggtgctagctccatactcgtctgaggatgctcgcggtctgctaaaagctgctatcagggacccagatcctgttgtttttctggaaaatgaattgctatatggtgagtctttccctgtttctgctgaagttcttgattctagtttcgctcttcccattggaaaagctaagattgaacgtgaaggaaaggatatcacaattactgctttctcaaagatggttggttctgctcttaaggctgctgaaattcttgcaaaagagggaattagtgctgaggtcataaatttgcgctctatccgaccgcttgatagatccaccattaatgcttctgtgaggaaaaccaacaggcttttaactgttgaagaagggttcccacaacacggcgttggagctgagatctgtgcttctgtggttgaggaaagttttgaatatcttgatgcaccagttgagaggatatctggggctgacgttccgatgccatatgcagcaaatctagaaagaatggctgttccacagattgaagatattgttcgtggagcaaagagggcatgttacagagcagcaaaatcagttccaatggctgcaactgcttaagctttggtaggaacaaagactgccaagctggttctaagcgttttatttcctcttatgtggatattgattctttatccgcctgcgagtggatgcttctatatttaccatcctgagaagtttaatttgtccatgaaaagaaaatgctaaatgttagaaaataatttttgccgtttacttgcgctctcttttcactggtgttaccaaatgttatgtaagacttgtcagttttgaccgctgagggttcacgagaacaaactctgtagtgatatgtaatatgatatatgcttgcattatttgtaatctacaaaacaatgtattgatctcaaataacgccaatccagtttttgaagaggctcgaataacatcacttggtgtaacttgtt

SEQ ID NO: 4075 - DNA, 1428 bp, Carthamus tinctorius
  misc_feature (946)..(946): n is a, c, g, or t
  misc_feature (1012)..(1012): n is a, c, g, or t
  misc_feature (1045)..(1045): n is a, c, g, or t
  misc_feature (1077)..(1077): n is a, c, g, or t
  misc_feature (1084)..(1085): n is a, c, g, or t
  misc_feature (1135)..(1135): n is a, c, g, or t
gcttcgcggggagtcatttattcatagtataaatctctctctctctctctctctctctctctctctctcttgctaccttcttcttcttcctccagcagccagccagccagccgctcatcggaaactttttttcaagatgcggggaattataagccaaaaacttggaggcttatccgctcaggttgtggggaattatatgcccagattaaggcctgctatgcctatgaggcattactcatctgcaaccaaagagatgacagtacgagatgctctgaactctgctcttgatgaggaaatggctgctgatcctaatgtctttgttatgggcgaagaggtaggagaataccagggtgcatacaagataaccaagggcttattggacaaatatggtcctgaaagggttgttgatacccctatcacagaggctggctttgccgggattggagttggctctgcatatcatggtctgaggcctgtaatagagtttatgactttcaacttctctatgcaggcaattgatcatatcatcaattccgcagcgaagtcgaactacatgtctgctgggcagattaacgtacccattgtttttaggggaccaaatgggcctgctgctggtgttggtgctcaacattcccagtgttatggtgcatggtatggctcagtccctggtttaaaggtgcttgtaccttactcctctgaagatgctcgtgggcttttaaaagctgcaattagagaccctgatcctgttgttttccttgaaaatgagttgctgtatggtgaatccttcccaatttcagcggaagcccttgattcaagtttttgcctcccaataggaaaagcaaagatagaaagagaagggaaagatatcacgatcacagctttttctaagatggttggctatgcccttaaggcggctgaaatactcgaaaaggaagggataaatgcngaggttataaacctgcggtctattcgaccactagatagagctaccatcaatgcttcagtgaggaanactaatcggctggtgactgtggaggaagggttncctcacatggtgttggtgcagaaatctgtgcnactgttnntgaagatagctttggttatcttgatgctcctgtggagaggattgctgganctgatgttccgacgccttatgctgctaatcttgagagaatggcttttcctcagattgaggatattgtacgtgctgctaagagagcatgctacaggtcggtgcctatggctgcaactgcttgaaaatgaaaatgctgacttttctttttcttttgtttggggtggatggatattttgaggggaaaaaacatcatcgcctgattcgtggaggggtataaatttctattttttacttgtgtattgtgtgaggtaggcaaagaaaggccacaacagaattctctctttctttttatc

SEQ ID NO: 4076 - DNA, 1540 bp, Trigonella foenum-graecum
atacaattttgatattaagaaaagggtgaggagaataataggagtaaaacagggaagagtctagttttctttcattagcatatattcaccaactctgaaacagtagttccacagcttcgcgaggaaagaaatcaaggaatcaagatgttaggtgttataagaaacaagagtattcggccttccttctccgcattcagatttctctcttcttccgctaaacagatgacagtgagagatgctctcaactccgcacttgatgaggaaatgtccgccgatcctaaagtcttcttgatgggtgaagaggttggagaatatcaaggtgcatataagatttccaagggtcttctggagaagtatggccctgatagggttctcgacactcccatcactgaggctgggtttacggggattggagttggtgctgcttactatggtctaaagcctgttgtggagtttatgacatttaacttctccatgcaggcaatagatcacatcattaattctgctgcaaaatcaaattacatgtctgctgggcaaataaatgtacctattgtctttagaggacccaatggagctgctgctggtgttggtgctcagcactctcattgttatgcatcttggtatggctcgtgccctgggttgaaagttttggcaccatattcatctgaagatgctcgtggtttacttaaagctgctataagggaccctgatcctgttgttttccttgaaaatgagttgttatatggtgagtcattccctgtttctgccgaagttctggattctagtttttgccttcccattggaaaagcaaagattgagagagaaggaaaagatgtgactattacagccttctcaaaaatggttggctttgctctgaaggctgctgagatactagcaaaggaaggaatcaatgctgaggttattaatttacggtcaatccgtcctcttgatcgatccactatcaacgcgtctgtcaggaaaaccaacagactggtgacagttgaagaagggtttcctcagcatggtgttggcgcggaaatctgtgcatctgtcattgaggagagttttggctatcttgatgcaccggttgagagaattgctggggctgatgttcccatgccttatgcagcaaatctggagaggttggctgtcccacagattgaagatatcgttcgtgctgcgaagagagcatgccacagatctgtgcctatggctgcaactgcctaaattaatcaatctagtcctgaaatttttcatgtcatggttagttctttggtgaccctttatgttaccaaaaataattccccccaaatttacaccacaacctcattaagaaagaggttttactcattgattctgttaggcattggtttgaaagattgtgatgtaagcatataatattgtccaaattttcaggagtaacaaattctgtacatttttttctttccttctgagtatacctgggagggagttcatgtttaataactttggatgataacaatgacacaagaaaggaagttttgtatgcaaccttgtggtc

SEQ ID NO: 4077 - DNA, 1861 bp, Sciadopitys verticillata
gggtttggtagggaataatagtacaataaaaatcgtctttgtattctatcggggtcgtctgccattgaaatccctgttctttgaagctttggattcgaatcggtcgttcatatcgttcaatcaccagtttaactccaaggaaaaaaatgttgggtgtcttgcggcaaaaatctgcaactggcttgataaatcttgtttcttcactgagacatggtcaggtgccagacagggtggtgcctatggcatccacaccattaagaaatttatctactgcagccaaagagatgacagtgcgggatgctcttaattcagctcttgatgaagaaatgtctgcagacccaaaagtatttttaatgggagaagaggttggtgaataccaaggagcttataagatctcaaaaggtcttctgcagaagtttggacctgacagggttattgacacccctattactgaggcaggttttactgggattggtgtgggtgcagcatattatggactgaaacctgttgtggagttcatgacatttaattttgccatgcaggctatggatcacatcataaattctgcagccaagtcatactatatgtctgcgggtcaaatctctgtgcccattgttttcagaggaccaaatggtgctgcttctggagtcggtgctcagcattcacagtgttatgctgcatggtatggttcctgcccaggactaaaagttttggtaccctattcatcagaagatgctcgtggattgctgaaagctgccatccgtgacccagatcctgttatttttcttgaaaatgaattgatatatggtgagtcttttccagtctcagcagaatgtctcgattctagcttctgtctcccaattggtaaagcaaagattgaaaaagaaggaaaagatgtaacaattacagccttttcaaaaatggtcggttatgcattacaggctgcaaaggaacttgcaaaggaaggcatcagtgctgaggttataaatcttcgttcaattcgacctttggatagagatacaattaatgcttctgttaggaagacaaaccggttggtgacagtagaagaaggttttccacagcatggtgttggtgcagaaatctgcacttctgtgattgaggaaagttttgaatatctggatgcgcccgtggaaagaattgccggagcagatgttccaatgccttatgctgcaaatttggagcgcatggctgttccacaggtagaagacattattcgtgctgcaaaaagagcctgctacagagaagttccaatgagcgcagctgcctagtgttaattttttttagtctgttttttcttatcgcatggcttagaagccacgatagggggaatccatttcgtcaaattcacctggaaatcgaacccagccccaaccgcgcccagcaggaattataccgtggtgggctctttgccagcacagctttctcaccaactggacttcaaccctatgggtcctagtgtaatttttgacatgcattgaccatgttttttttgctttaaatgtatttgtaatctgtccatgaggccccggtacacagtaagaatatggcatgctcattttgtacttttcaacaggttaagattgttacaaaatttaattggccttaatgatctgaaggttacatagaaggttcccttttccactgtttagtttatgtttctagtatctaccgtgcttttttcattggttcatttaatgcggagttgatccttagttgctttggtatcaatttctaagcactattgttatgcggacttttggctttcaccaaatgtttatttggtgcacaacttatgcaagtcataaaattattgctgaagtatcagcattgatccttaaat

SEQ ID NO: 4078 - DNA, 1632 bp, Taraxacum officinale
acggtccggaattccgggatcttttggcagagaaatccgacgcctccacccctgtggctgctgcaaaccgccgatcccagccacaaccgcctgcgattccacctccggcacacgcagattgcttctttgtgcccttctaatgcgactctaggaccttttgacaaacttattgctcatcatacttagttcttttcttactctgtctttttcatctgaagctcttgacttcatacgagaaaatatgtgggggattataaggcaaaacgttggtggtgccagagacttatcttctcagattctgaggagttctatgccgaggttaagacctatatcatcagctgtgagacattactcatctgcaaccaaagagatgacagtacgagatgctttgaactctgctcttgatgaggaaatggctgctgaccctaacgtctttgtaatgggtgaagaggtaggagaataccagggtgcatacaagataaccaaaggattactggacaaatatggtcctgaaagggtcgtggatacccctatcacagaggctggatttacagggattggagttggttctgcttatcatggtctgagacccgtgatagagtttatgactttcaacttctctatgcaggcaatcgatcatattataaactctgcagcaaagtcaaactacatgtcagcagggcagattaacgtacccattgtatttaggggaccaaatgggcctgctgctggtgtaggtgctcaacattcccagtgttatggtgcatggtacgcatcagtccctggtatgaaagttcttgtaccttactcctctgaagatgctcgtggacttttgaaagccgcaattagagaccctgatcctgtcgtgtttcttgaaaatgaattgctatacggagaatcgttcccggtatctgctgaagctcttgattccagtttctgcctcccaataggaaaagcaaagattgaaagagaagggacggatatcacaatcacggctttctcaaagatggttgggtacgccctaaaggcggctgagatacttgaaaaggaagggataagtgtggaggtgataaacctccggtcaattcgaccgctagatagggccaccatcaatgcttctgtcaggaaaaccaaccgccttgttactgtagaggaaggctttcctcaacatggcattggtgctgaaatctgtgcatcggttgttgaagatagctttgggtatcttgatgcgccagtggagaggattgctggggctgatgttcccactccttatgccgccaatcttgagagaatggcttttccacagattgaggatattgttcgggctgttaagagggtgtgctacagggcggtgcctttggctgcaactgcttgattttctgatttttgagaccgttttgggaccacattaatcatatgttttattttatgatgtactgcttttgtaaaaagatgccacaactatgctttggtttctcaagtaataatattaatgcggaacgatcaaatgagttgccatactcataaaaaaaacactaatattgtgtattttgtcttgctttttgtttgttgtactggaaaattttgtgcccaaaatgacttaagaatcggatgcagtcacttgttggaatc

SEQ ID NO: 4079 - DNA, 1528 bp, Plantago ovata
tggtgtgattatacaaggagactgaatcatgttgggtgctatcaggcaaagagtagcctgcaaatccagtctagcttcgaatggagttggagtccttgcggcgagggcattttcttcctctggaaaagagacgatgacagtgcgtgatgctttaaattcagctctagatgaagagatgtctgctgaccccaaagtgtttataatgggagaagaggtgggcgagtatcaaggtgcatataagatcaccaaaggtcttctgaataaatatggtcctgatagggtcgtcgatacaccaattactgaggctggatttgctggaattggagttggagcagcatattatggcctgaggcctgtaattgagttcatgacttttaatttctcgatgcaggctattgatcacatcatcaattctgctgcgaaatcaaattacatgtctgctggccaaatatcagtgccgatcgttttcagaggccctaatggggctgctgccggtgttggtgcgcaacattcacagtgctatgcagcatggtatggttcatgcccaggagtgaaggtattagctccatattcttcagaagacgctaggggtctacttaaagctgcaataagagatccagatccagttgtattcctcgagaacgagttactatatggtgaatcgtttccggtgtcagctgaagtgctcgattccagtttctcccttcctattggaaaagctaagattgaacgtgaaggtaaagatgtcacgatcacagctttctcaaagatggttggttacgcgcttcaggctgcagatattctttcgaaggaaggaattagtgctgaggtgataaatcttcgttcaatccgccctcttgacagagccactataaatgcatctgtcaggaaaacaaataggcttgtaaccctcgaagaaggatttcctcaacatggtgttggtgctgaaatctgtgcatctgttgtcgaagaaagctttgattgtcttgatgcacctatagaaagaattgctggggctgatgttcccatgccctatgctgcaaatcttgagagactagctgttccccaggttgatgacgtagtccgagctgcaaaaagggcctgttacagatcaaaatagattagggtcaaaatgggatgttcctaatttttctttgaaacctgattattcttttgtgcgtctgtggtgtgtacttatcatcaccacctggggaaacttcggatgatttccaacataccggagttgatatacatgaacaattcttttctttacatcaactcctgccttgagcccttcgctttcatggcttttggagaaatcccaaaatttaccctgtaaaagtaacagaaaagaattctatcattctatgtgctagatgaaattttactgggcacctgcaactatgccttgtgattgcatcacattgtcagagtaaattcaagcacaatgacagactactgttgctcgtttgcagattattgtgttccgttctatccctagttgatgtaatgaacacgccatgccagc

SEQ ID NO: 4080 - DNA, 2054 bp, Picea glauca
ttataccaccacattttcctttagggaaatattattattgtttggcagactcgagggtttggtgaatgcgtgaaggttagctgtacgcaggcgataaccagagccctagggtttggtggggtaaccaacaagggtgtgtggttggtgaggaagacggctttttcctctgcccgccttccttttttttttgtgaggatcgtgcttcctgcgttggatgctaattccttaaaatagatcgctgtacctatttcctattgatttatctgatccgatcctattgaatcagcccagcctgccttctatgaaactgccccaagcaagcaaagtccgcaataagcaagcgaagcgtacgtaattcccccggctcccagaagcgagcccatcgccaacagtggactgcagttaaactctaagaagagaagatgtggggtgctttgcagcaaaaatctggcttggcaactcttgtttcttcattgaagcatggtcaagttttggagagattggtgcctatggcattcacaccctcgagaaagttatctactgccgctaaagagatgactgtgcgggatgcgcttaactcagctattgatgaagaaatgtctgcagatccaaaggtctttttaatgggagaagaggttggtgaataccaaggagcatataagatatcaaaaggccttttgcaaaagtttggacctgacagggtactagacaccccaatcactgaggcgggtttcactggaattggtgtgggcgcagcatattatgggttacgaccaattgtggagttcatgaccttcaattttgccatgcaggctattgatcaaataataaattctgcagccaagacaaattatatgtctgcaggtcaaatttctgttcccatcgtttttagaggaccaaatggagctgctgctggtgttggtgctcagcactcacattgttatgctgcatggtatggttcttgtccagggctgaaagttttgaccccctattctgcggaagattctcgtggattgctgaaagctgccatccgtgatccagatcctgtcatttttcttgaaaatgaattgctgtatggggagtcttttccggtctcagcagagtgtcttgatcctagcttctgtctccccattgggaaagcaaagattgagcgagaaggaaaagatgtaacgatcactgccttttctaaaatggttggttatgcattacaggctgcacaagagcttgaaaaggaagggatcagtgcggaggtaataaatctccgttcaattcgaccattggacagagctacaattaatgcatctgttaggaagacaagtcgacttgtgacagttgaagaaggatttccccaacatggaattggtgcagaaatttgcgcttctgtggttgaggaaagttttgaatatttggatgctcctgtggaaagaatcactggtgcagatgttcctatgccctatgctgcaaatttggagcgcttagctgttccacaggtcgaagacattgtccacgcttcaaaaagagcttgttatagagcagttccaatgagtgcagttgtctagtgtaaaatttgatttctttgatcatcctctttagatgcaagtttgtatcatgtgaacaaagcctcgatgtatggaaatctgtcccgaggcataaggcaagctcatttttaacttttatataggttaagattgtcggcacttgctattttaatgcctgcaaaggttacatggagagggcttgttttttctgctgttggaaaaaagtatgttcgtcctacatgttttccatcagtccaatgattgggaatcaatccttgtttggtttagctttaatatttatgcacttttattgtatgcctggttcttggcaaattggtgccagctcattcttctgagttaaaaaaataaacgatggaataccagtgattgttcataatgttagccattcagaaaaatcacatatttcatttgtatgataccggtttaaggaatatctactatatcattttaggtttagcctgaataaatgattcagctgctcagtgcatttcaaca

SEQ ID NO: 4081 - DNA, 1742 bp, Picea glauca
tccccccggaatgaatgaatgctttcttgcgcgaagctttgagtgtagtgaaaacgagggtttattgtcctcaattagattcatatcgcaaagtttaatgataatgacgtgctggatcctaatttcatgaccaaacttgatttaatttgaatcggccgtctcggattttaatgtttaacgctcaatttgcagatgctgttatgtaagttaaattctaaggagagaagatgtggggtgctttgcgacaaaaatctggcttgacaactcttgtttcttcattgaagcatggtcaagttttggagaggtttgcgcctatggcttccacacccttaagacagttatctactgctgctaaagagatgactgtgcgggatgctcttaactcagctatcgatgaagaaatgtctgcagatccaaaagtctttttaatgggagaagaggttggtgaataccaaggagcatataagatatcaaaaggtcttctgcagaagtttggacctgacagggtactagacaccccaatcactgaggcaggtttcactggaattggtgtgggcgcagcattttatgggctacgaccgattgtcgagttcatgaccttcaattttgccatgcaggctattgatcaaattataaattctgcagccaagacatattatatgtctgcaggtcaaatttctgttcccatcgtttttagaggaccaaatggagctgctgctggcgttggtgctcagcactcacagtgttatgcagcatggtatggttcttgtccagggctgaaagttttgaccccctattcagcggaagattctcgtggattgatgaaagctgccatccgtgatccagatcctgtcatttttcttgaaaatgaattgctgtatggggagtcttttccagtctcagcagagtgtctcgatcctagcttctgtctccccattgggaaagcaaagattgaacgagaaggaaaagatgtaacgatcactgccttttctaaaatggttggttatgcattacaggctgcacaagagcttgaaaaggaagggatcagtgcggaggtaataaatctccgttcaattcgaccattggacagagctacaattaatgcatctgttaggaagacaagtcgacttgtgacagtggaagaaggatttccgcaacatggaattggtgcagaaatatgcacttctgtggtcgaggaaagttttgaatatttggatgctcctgtggaaagaatcactggtgcagatattcctatgccctatgctgcaaatttggagcgcttagccgttccacaggtcgaagacatcatccgtgcttcaaaaagagcttgttatagagcagttccaatgagtgcagttgcctagtgtaaattttgatttctttgatcatcctctttagatgcaagtttgtatcctgtgaacaaagcctcgatgtatggaaatctgtcctgaggcataaggcaagctcattttaaacttttatataggttaagattgtcggcacttgctattttaatgcctgtgaagggcttgttttttctgctgttggaaaaaagtatgttcgtcctacatgttttccatcagtccaatgattgggaatcgatccttgtttgtttcagcttcaatatttatgcacttttattgtatgcctggttcttcgaaaattggtgccagctcattcttctgagttaagaaaataaatgattgaataccagtgactgttcataatgttagccgttcaga

SEQ ID NO: 4082 - DNA, 1418 bp, Artemisia annua
gaagattcttatttttcaatttttgtggtagcccctatttcaacaaaaccttcagccgccgttgatcggaaaacatattatttcgtttgttgatataaagatgttgggggttataaggcaaaaagttataggtgctaaggatgtgatgaggttaaggcctgtggtgtcgtctatgaggcattattcgtctggaactaaagagatgacagtacgagacgctttgaactctgctcttgatgaggaaatggctgctgatcctaatgtttttgttatgggtgaagaggttggagaataccagggtgcatacaagataaccaagggattgttggataaatacggtcctgaaagggttgttgataccccgatcacagaggctgggttcgctgggattggagttggttctgcctatcatggtcttaagcctgtgattgagtttatgactttcaacttctccatgcaggcaatagatcatattatcaattctgcagcaaagtcaaactacatgtctgctggccagattaacgtacctatcgttttcaggggaccaaatgggcctgctgctggtgttggtgcccaacattcccagtgttatggtgcatggtatggctcagtccctggtttgaaagtgcttgtaccttactcctcagaagatgcccgtggtcttctaaaagctgcaattagagaccctgatcccgttgttttccttgagaacgagttgttatatggtgaatccttcccaatttctgacgaagcccttgattcaagtttctgcctcccaataggaaaagcaaagatcgaaagagaaggaaaagatatcacgatcacagctttctccaagatggttggctatgctcttaaggcggctgaaatacttgaaaaagacggaataagtgcagagattatcaacctgcgctccatcagacccctagatagagctacaatcaacgcttcagtgaggaaaactaacaggctagtcactgtggaggaagggtttcctcaacatggcattggtgctgaaatctgcgcatcggttgttgaagatagctttggctatcttgatgccccagtggagaggattgctggtgctgatgttcccacaccttatgctgccaaccttgagagaatggcttttcctcagattgaagatattgttcgtgccgctaagagagtatgctataggtcggtacctttggctgcaactgcttgatgttacgacgaaacgatttcaaaaggctgactggttttatttggaatatttcgagaatgcttctcctgatttttgaggggtgtacatgtacgttgagaagctccaatttttcactttgtgttgtgtgaagtaactttgctaaatggaggcaaagggccatagaattccctctatactcatgaactttttattttatataataaggttggaa

SEQ ID NO: 4083 - DNA, 1683 bp, Pinus taeda
tgaaacgtgagggttagctgtaagcagacccagacagacagaggaagaagaacagagcctagggtttggtgggagtaaccaacaagggcgtggttggtgaggaagacgactccttgtctgacccgacttcatttttctgcgatatctgtggttcctgcgtcgacgcaaatcggccattgacagtgttattcaatcttctcaggtgtcaagagtgatacgacgttggcatgtaaattaaattaaactctaagaagagaagatgtggggtgctttgcggcaaaaatctggcatgacaactcttttttcttcattgagacatggtcaagttttggagaggttggtgcctatggcatccacacccttaagaaatttatctactgctgctaaagagataactgtgagggatgctcttaactcagctattgatgaagaaatgtctgcagatccaaaagtctttttaatgggagaggaggttggtgaataccaaggagcatataagatatcaaaaggccttttgcagaagtttggacctgacagggttctagacaccccaatcactgaggcgggttttactggaattgctgtggcgcagcatactatgggctacgaccaattgtggagttcatgaccttcaattttgccatgcaggctatcgatcaaataataaattctgcagccaagacatattatatgtctgcaggtcaaatttctgttcccattgtttttagaggaccaaatggagctgctgctggtgttggtgctcagcactcacagtgttatgctgcatggtatgcttcttgtccagggctgaaagttttgaccccctattcagcagaagattctcgtggattgatgaaagctgccatccgtgatccagatcctgtcatttttcttgaaaatgaattgctgtatggggagtcttttccagtctcagcagagtgtcttgatcctagcttctgtctccccattgggaaggcaaagattgaacgagaaggaaaagatgtaacaatcactgccttttctaaaatggttggctatgcattacaggctgcacaagagcttgaaaaaggaagggatcagtgctgaggtaataaatcttcgttcaattcgaccactggacagtagctacaattaatgcatccgttaggaagacaagtcgacttgtgacagtggaagaaggctttccacaacatggaattggtgcagagatctgcgcttctgtggttgaggaaagttttgaatatttggatgctcctgtggaaagaatcaccggtgcagatgtccctatgccatatgctgcaaatttggagcgcttagctgttccacaggttgaagatatcatccgtgcctcaaaaagagcttgttatagagcagttccaatgagtgcagttgcatagtgtaaatgttgatttctttgatcatcgccatgcaagtttgtatactgtgaacaaagtctctatatatggaaatctgtctaaggcacatggcaagctcataattggtgtaacacctcatccacataggaatttgttggtaacatatagtgaagatagcacaatgaagatatggaaaccctaatatggattttatactgctattggatttgtatagaaataataatttttgaattttgatggtagcgtatggttgaaggaaaacttggatatatcatgtaaacatttt

SEQ ID NO: 4084 - DNA, 1393 bp, Taraxacum officinale
gggggattctaaggcaaaacgttggtggtgccagagacttatcgactcaaattctggggagttcgaagcggaggtaaagacctataacatcaactccgagacattactcatctgcaaccaaagagatgacagtacgagacgcttcgaactctgctcttgatgaggaaatggctgctgaccctagcgtctttgtgatgggtgaagaggtaggagaataccagggtgcatacaagataaccaaaggattattggacaaatacggtcctgaaagggtcgtggatacccctatcacagaggctggatttgcagggattggagttggttctgcttatcatggtctgagacccgtgatagagtttatgactttcaacttctctatgcaggcaatagatcatattataaactctgcatcaaagtcaaactacatgtcagcagggcagattaatgtccccattgtatttaggggaccaaatgggcctgctgctggtgttggtgcccaacattcccagtgttatggtgcatggtacgcatcagtccctggtttgaaagttcttgtaccttactcctctgaagatgctcgtggacttttgaaagccgcaattagagaccctgatcctgtcgtgtttcttgaaaatgaattgctatatggagaatcgttcccgatatctgctgaagctcttgattccagtttctgcctcccaataggaaaagcaaagattgaaagagaagggacggatatcacaatcacggctttctcaaagatggttgggtacgccctaaaggcggctgagatacttgaaaaggaagggataagtgtggaggtgataaacctccggtcaattcgaccgctagatagggccaccatcaatgcttctgtcaggaaaaccaaccgccttgtcactgtagaggaaggctttcctcaacatggcattggtgctgaaatctgtgcatcggttgttgaagatagctttgggtatcttgatgcgccagtggagaggattgctggggctgatgttccaactccttatgccgccaatcttgagagaatggcttttccacagattgaggatattgttcgggctgttaagagggtgtgctacagggcggtgcctttggctgcaactgcttgattttctgatttttgagaccgttctgggaccacattaatcataagttttattttatgttgtactgctcttgtaaaaagatgccacaactatgctttggtttctcaactaataataatattaaggcggaatgatcgaatgagttaccatactcataaaaaaacactagtattatgtatttctttcttactttttgtttgttatactggaaaattttgtgcccaaaacaagtaagtaagaatcggatgcacttgcgtgttggaatc

SEQ ID NO: 4085 - DNA, 1611 bp, Aristolochia fimbriata
attagaaaggagaggcgacacagttaaccagattcaagtgccattttctactgtagtcggccagaatccaacaaatgtccgatgaagtgtggttgaaccatcgttcagtgttggacattgctaatggatcatttgtaggacgttgctaatggatcatttgcaggacgttgctaatggatcatttgtaggacgttgcgaatggatcatttgcaggacgttgctgctattgttttttattttattcgaatggggacaaatatgtgggggattctgaggcaaaaagttggacgtggtggcttcccagcatcgattcttggacaatctttgcgaaggatacagcctgcagcttctgtgctgcccagaacattctccagtgcagcaaaggagattactgtgcgtgatgctttaaactctgcactcgatgaagaaatgtctgctgatccaaaagtattcctgatgggtgaagaggttggtgaatatcagggagcatacaagatatccaaaggtcttctggagaaatatggtcctgaaagggttcttgatacaccaatcaccgaggctggtttcactgggattggagttggttcagcgtactatggtctaaagcctgttgtggagtttatgacgtttaacttctctatgcaggcaattgatcatatcatcaattctgcagcaaaatcaaactacatgtctgctggtcagatcaatgttcctattgttttcagagggccaaatggtgcagcagctggagtaggagcacagcattcccagtgttatgcggcttggtatggtgcttgccctggattgaaagttcttgctccatactcatcacaagatgcaagaggattgctgaaagctgctatcagagaccctgatccagtagttttccttgaaaacgagttgctatatggtgagtcattccctgtgtcaccagaagctctagactctagcttctgcctcccaataggaaaagctaagatagaaagagaagggaaacacgtgacaattacagctttctcaaagatggtcggttatgctcttaaggcagctgaagaactctcgaagaatggaatcagtgctgaggttataaatcttcgatcagttaggccacttgatagggctgccattaatgcttcagtcaggaaaacaagcagactagtgactgttgaagagggtttccctcagcatggtgttggtgcagagatctgtgcatcggtggtggaagaaagtttcgactaccttgatgcacctgtggaaaggattgctggtgcggatgtcccaatgccatacgccgcaaatctggagagaatggctgtacctcaggttgaggatatcgtccgggcagcaaaacgagcgtgctacagatcatgcccttgagatgattctttttgtcagtgtttgaaacatggttggcatgttgtggtttcttgcggtgggctgaaagatcatcatcctgtttctttagtcatgaggagagccaattttggcgtcttgtaaaagttggcgaggaaggaaagccaatttcaataaattggactaaatgttttcctttttgaacagaagaaagaagcacatctgaaatgcgttgttgacactcgtagttcatgaaag

SEQ ID NO: 4086 - DNA, 2004 bp, Cephalotaxus harringtonia
gcgattttgaaatacaggtaagggtttcaagggtttggtggaaaataattataacatagaacacaaatctgattttagcatcataaatctcttctgcactgcgatcttggttcttggagcctgggattcaattcggtcgtagatatcactcaaccgccagttaaactccgaggaggaaaaatgttgggtgctttgcagaaaaaatctgcaactagcttgataaatcttgtttctttgttgagacatggtcaggagtcagagagggtggcgcctatggtatgcacacaattaagaaatctatcatctgcagctaaagagttgacagtgcgtgatgctcttaactcagctctcgaagaagaaatgtctgcagatccaaaagtatttttaatgggagaagaggttggtgaataccaaggagcttataagatttcgaaaggccttctgcagaaatttggaccggacagggttattgacaccccaatcactgaggctggttttactggcattggtgtgggcgcagcatattatggactgaaacccattgtggagttcatgacatttaactttgctatgcaggctattgatcacatcataaattctgcagccaagtcaaattacatgtctgctggtcaaatctctgtgcccattgttttccgaggaccaaatggagctgctgctggagttggtgctcagcactcacagtgttatgctgcatggtatggttcctgcccaggattaaaagttttggttccctattcgtcagaagatgctcgtggattgctgaaagctgccatccgcgacccagatcctgttatctttcttgaaaatgaattgatatatggtgagtcttttccagtctcagcagaatgtctcgattctagcttctgtcttcccattgggaaagcaaagattgaaaaagaagggaaggatgtgacgatcacagccttttctaaaatggttggctatgctttgcaggctgcccaagaactagcaaaggaaggaatcaatgccgaggtgataaatcttcgttccattcgacctttggatagagcaacaatcaatgcttctgtaaggaagacgaaccggctggtgacagtagaagaaggttttccacaacatggcattggcgcagaaatttgtgcctctgtgattgaggaaagctttgaatatctggatgcccctgtggaaagaattgctggtgcagatgttcccatgccttatgctgcaaatttggagcgcttagctgttccacaggtagaagacattattcgtgctgcaaaaagggcttgctacagagaagttcctatgagtgcaactgcctagtgtaatttttaacatccactgactattttttctttaaaatgtaatgagatctgtaattttgtcaacgaggcccaattattctttgagatttatctttagtatatagggcatgttcacttcgaaatttcctgtaggttaagattgtttcccatctgcgccagccttgtgatttttagtgctcctgaaggttaatggaaagcttttttccattttctttttcctactgtcagagtatgcatctatcgtcattgtttactggctagctgatggggaattgatccttgtttgtgtcgacatcaaattctaagcactgttatcatatgctgactgtcattttttaccaaatgtttggtgtcatttggtgcagagcttatatgagccataaaataatgctgtagcagcagtgtttatttttgaataaggagttattaaatgccattaaacatctcattttggacggaatcagttcaaacaattgcagcatgcacttttaaaaccctaaaaatgatttaattagttgctgactgtaactggatgggtgaaactgctttcacactatccgttcaaatgtgacctaaatgattatactacattttgagcactttgaaagctataattccattttcaaattgaagtaaaaatttccactcaaatttttatatatgttctgcatttatagtt

SEQ ID NO: 4087 - DNA, 1617 bp, Podocarpus macrophillus
taggtagcccacaagggtttggtggatcatatacaaagccattctaacatcttaatataatttcaacgtctctccttttcgatcggatctttgttcctcttcttcaccttgggattctcctcatccacagtttaattcaaggagaaaaaaatgtggggttctttgcgacagaaatctgcgattggcctgttgactcttgtttcttcattgagaaatgggcaggtggagagaatgggggctatggtatccaccccattaaggaagttatctactgcatctacggagatgacagtgcgggatgcgctcaactcagctcttgatgaagaaatgtctgcagatccaaatgtatttttgatgggagaagaggttggtgaataccaaggagcttataagatttcaaaaggccttctgcagaaatttggacctgacagggttcttgacactccaatcactgaggcaggtttcactggcattggtgttggtgcagcatattatggactcaaacccattgtggagttcatgacttttaattttgctatgcaggctattgatcacatcataaattctgcagctaagtcatattatatgtctgcgggccaaatctctgtacccatggtattcagaggaccaaatggagctgctgctggagttgctgctcaacactcacagtgttatgctgcatggtatggtgccatacctggattgaaagttttggttccctattcatccgaagatgctcgtggtttgctgaaagctgccatccgtgacccagatcctgttgtttttcttgaaaatgaattgatatatggggagtcctttccagtctcagcagaatgccttgactcaagcttttgtcttccaatcgggaaagcgaagattgaaagagaaggaaaggatgtgacgatcacagccttttcaaaaatggtgggttatgcattaaaggctgcacaggaacttgaaaaggacggaatcagtgccgaggtaataaatcttcgttcaattcgcccattggatagagctacaattaatgcatccgttaggaaaacaaataggctggtgacagtagaagaaggttttccacaacatggtgttggtgcagaaatctgtatgtctgtgattgaggaaagttttgaatatctggatgcccctgtggaaagaatcgctggggcagatgttcccatgccttacgctgcgaatttggagcgcttagctgttccacaggttgaggacatagttcgtgcagcaaaaagagcttgctatagagaagttcgaatgagtgcagttgcctagtgtaattttcaacttccattgagcgtgttgattgttttcgaaaattgtagtgaattttgtattccatcaacaaaacccctttcggcagcttaatttgttttgaggagcaggtcattcttgttctgaactgtgttatatgttaagattgttgccaaatttcaaaggcacatgttttcatttatctgaacatcaattagtaaagtctgattagtctgtcgaggccttttgtcagtctcatttttaattggttaatccaagcgttaatttctaggtattgctattatttggtaaccactgcacattcaacaaatggttggtgctacgcgt

SEQ ID NO: 4088 - DNA, 1462 bp, Senecio madagascariensis
tggatcccccgggctgcaggcggtgatcggaatctaggttttgaataaggagaaaagatgttggggattataaggcaaaaagctggtttatcatctcagggagttgggagttatgtgatgaggttaaggcctgtagcatcatcagctacgagacattacgcatctggaactaaagagatgacagttcgagatgctttgaactctgctcttgacgaggaaatggctgctgatcctaatgtttatgttatgggagaagaggtaggagaataccagggtgcatacaagatcactaaaggattattggacaaatatggccctgaaagggttgttgatacccctatcacagaggctgggtttgccggtattggagttggttctgcatatcacggtctgaggcctgtgatagagtttatgactttcaacttctctatgcaggcaattgatcacattatcaattctgcagcaaagtcaaactacatgtctgctgggcagattaacgtacccattgttttcagaggaccaaatgggcttgctgctggtgttggtgcccaacattcccagtgttatggtgcatggtatggatcagttcctggtttgaaagtgcttgtaccttactcatctgaagatgctcgtggacttctaaaagctgcaattagagacccagatcctgttgttttccttgaaaacgagttgttatatggtgaatctttcccagtttccgctgaagcccttgattcaagtttctgcctcccaataggaaaagcaaagattgaaagagaaggaaaagatatcacaattacagctttctccaagatggttggctatgctctaaaggcggctgaaattcttgaaaaggacggaatcaatgcagaggttataaacctgcgatccattcggccactagatagagctacaatcaatgcttcagtcaggaaaactaaccgtctattaactgttgaggaagggttccctcaacatggaattggtgctgaaatctgtgcatcggttgttgaagagagctttgcatatctagatgccccagtggagaggattgctggtgctgatgtacctacaccttatgccgccaatctcgaaagaatggcttttcctcagatcgaggatattgttcgtgctgcgaagagagtatgctacaggtcggttcccatggctgcaagtgcttgaatatcaaacgaaagggttttaaaatgctgactgtttttctttgggatgttatgagaatgcatctcctgattttttaggggtgtacatgtcaatgttggatatagctccaatcgatctcatgttttgttctcctattcgatacattttcttataaaagaaaaaaatattcttataaaagttggtatgcaaacaactggatgagcacgtattctaaaactgtgattatgtaagaaattgttagttttaaataactttaacggtgctgaaaaaaccctgcagc

SEQ ID NO: 4089 - DNA, 1487 bp, Arnica chamissonis
gggacacaaaaacaccaccgaattttataaccccctatatgacccaggggacaacaaacgatatttctaagccatcgcatcgcctccgtcaaacttctccagccggtgatcggaaagtacttttggcttaaaagacgaaagtatgtgggggattgtaaggcaaaacgtcgggggtgccagaggcttatcctctcagggcctggggaattatatgatgaggttaaggcctgtagcatcagccatgagaaattactcatctgcaaccaaagagatgacagtgcgagatgctttgaactctgctcttgatgaggaaatggctgctgatcctaatgtttttgttatgggtgaagaggtaggagaataccaaggtgcatacaagataaccaagggattgttggacaaatatggtcctgaaagggttgttgatactcctatcaccgaggctgggtttgctgggattggagttggttctgcatatcatggtctgaggcccgtgatagagttcatgactttcaacttctctatgcaggcgattgaccatgttatcaattccgcagcaaagtcaaactacatgtctgctgggcagattaacgtacccattgtttttagaggaccaaatgggcccgctgctggtgttggtgctcaacattcccagtgttatggtgcatggtatgggtcagtccctggtttgaaagtgcttgtaccttactcatctgaggatgctcgtggacttctaaaagctgcaattagagatcctgatcctgttgtctttcttgaaaatgagttgttatatggtgaatccttcccaatttccgctgaagcccttgattccagtttctgccttcctattggaaaagcaaagattgaaagagaagggaaagatatcacaatcacagctttctctaagatggttggctatgctcttaaggcggctgaaatacttgaaaaggatgggataaatgcagaggttataaacctccggtccattcgaccactagatagagctacaatcaatgcttcagtcagaaaaactaaccgtcttgtcaccgtggaggaagggtttcctcaacatggcattggtgctgaaatctgtgcttcggttgttgaagacagctttggttatcttgatgcaccagtggagagggttgcaggggctgatgttcccacaccttatgctgccaatcttgagagaatggcttttcctcagattgaggatatcgttcgtgctgctaggagagcatgctacaggtctgtacctatggctgcaactgcttgatgacgggcataaaaaagctgactcttagggttcggcgtgttttgagaatgcatcttccgattttttaggggcgtaaatttctaaattcggaaaagctccaatcttcgttttattgtgtgaattaactttatagaattctctactcttccatgaatttattttattcaataaggttaaatgcaatgcaagagatctcaggcttgttttttta

SEQ ID NO: 4090 - DNA, 4279 bp, Cedrus atlantica
agatcattgggctaaacaacaattatttgtatttccagggggtcgtgaggaggtcgcttgttgaacgatttattttctctcaggttgcgtgttcgaagctcaggaacggcgaagccggttagttccgagtcttctgtgctgctagatgatggatcttcgtttactattccgggggttttccatagcgtgcctgcttttactcttctcgcagcatggactgtgcggcgacattgttcatgatgacgatgttgcgcctaaacaacctggctgtgataacaaattcgtcctggtgaaaattcagacatatataaatggcaggaaggggaatgaatatgttggtgttagtgctcggtttggtacccctgtggaatcaaaggagaaagtcgctaacaagtctcgtcttgtcctagctaacccctatgatagctgcaccaccctaggagaaaagctcactggagatgctgctttggtacttcgaggcaattgcaatttcacaacaaaggccagggttgcacaggcagctggtgcagtagctcttcttgttgtaaatgacaaggaagagttatataagatggtgtgtgcaccaaacgacaccacattggacataaaaattcctgctgttatgttgccaaagactgcaggtgcaagcttaagaaaacggttgagcgcaggtggagcagttggagtagtcatctactcacctgaccgacccttggtagacattgcggaagtctttctatggcttatggctgtgggaactattctatgtgcttccttttggtcagcttggagtgctagagaggcatgcaatgagcactgcaagtcattgaaggataatccagatgcttttgtcatggaagaaagtagtggggataagggtgtggttgatatcagcacgacatctgcaattcttttcatagtgattgcatcttgctttctaattctcatctataaattcatgtcagaatggtttttggaacttttggtcgtgattttctgcattggtggagttgagggtttgcaaacttgtttggtcgctttgctctccaggtggttcagtcgtgccggaagactatatatacatgttcccttctttggagctgtctcaggcctgactttggctgtgttgccattttgtataacatttgctgttgtatgggctgtttatcgacgcatctcatttgcctggattggtcaggatatacttggcatcactttgatcataaccgttcttcaaattgttcggcttccaaatgttaaggtctctgcagttcttctaggttgtgcctttctgtatgacatcttttgggtgtttgtttcacctaaactatttcatgaaagtgtgatgattgtggtagctcgtggtgatagaagtggggaggatggcatacccatgctactgaaaattccacgcttgtatgatccgtggggtggctatagcatcattggctttggagacatacttttaccaggactgttgatagcctttgctttaagatatgattgggcagctaagaagagtttgcaagcaggctattttctatggtccatgattggctatggctttggtctattcattacgtatgttgctctgaatctgatggatggaaatggccaacccgctcttctgtatattgttccctgtaccctcggcactgttctagccttgggttggaagcggggtgaactgagtaatttatggtcaaagggagagcctcaaatgctttgtccacatgttggacccaagggtggtacatgagttgagggatggtgttctttgcagagtattttacggcttgaagttgcattcaaaactgtatatcttacctttacattatgtccatcaaatggcaatgccaagaattagcgatgctggatgctcatgccctactattatctggctcctgcagacagtaacttttagaatgtggcatttccatctaaggaatattaatgctgattatatgcatgataatgttaataacctacaaaatgctcaaaaccagattttaccagtcccatgaaaggcatgtatctgatctttaatgagaatttctttttatacctgctctaaattgtaccaagatggagtcgaagaaaatggattttcaattaaaaatgaaattctttctgttttgtcggaatgaaatccatgtaattaagaaagacaagcatgactcctattcattatggcatgagatatctgtgcctttgtaaacaattgtttgatgcctaccagtagaatctgaaaaattccattcataagagaacctcggcaaagactctgcttggcaaattaaagcatatatgagaaatagcacacgtttgctggcaatcagccgctgttgcgttgtgccgagaggcacattctttagtccaggtgatgggagatgtattttgttcgaccatccatctgtgtaatgctatggttggttaaataggggagggtttggtgaaagcgtgaaagttagctatacgcagacagatagaggaagaaccagaaagctagggtttggtggagtaaccaacaagggcgtggttggtgaggaatacggatttgtttcgactcgtcttccctttcctccgagtaccgctcttcctgtgttggatgcaaattggctattgacggtctacttcattttcctcagttaaactctaaggagataagatgtggggtgctttacggcaaaaatctggcttgacaactcttgtttcttcaatgaggcatggtcaagtttcggagaggttggtgtctatggcatctatacccttaagaaagttatctactgctgctaaagagatgactgtgcgggatgctcttaactcagctattgatgaagaaatgtctgcagatccaaaagtctttttaatgggagaagaggttggtgaatatcaaggagcatacaagatatcaaaaggtcttttgcagaagtttggacctgacagggttctagataccccaatcactgaggctggtttcactggaattggtgtgggtgcagcatattatggattgcgaccgattgttgagttcatgaccttcaattttgccatgcaggctattgatcaaataataaattctgcagccaagacaaattatatgtctgcaggccaaatttccgtacccattgttttcagaggaccaaatggagcagctgctggcgttggtgctcagcattcacagtgttatgctgcatggtatggttcctgtccagggctgaaagttttgactccctactcagcggaagattctcgtggattgatgaaagctgccatccgtgacccagatcctgtcatttttcttgaaaatgaattgctgtatggggaatcttttccagtctcagcagagtgtcttgatcctagcttctgtctccccattgggaaagcaaagattgaacgagaaggaaaagatgtaacgatcactgccttttctaaaatggttggctatgcattacaggctgcacaagagcttcaaaaggaagggatcagcgctgaggtaataaatcttcgttcaattcgaccattggacagagcgacaattaatgcgtctgttaggaagacaagtcgacttgtgacagtggaagaaggttttccacaacatggaattggtgcagaaatctgcacttctgtgatagaggaaagttttgaatatttggatgctcctgtggaaagaatcgctggtgcagatgttcctatgccctatgctgcaaatttggagcgtttagctgttccacaggtcgaagatatcatccgtgcctccaaaagagcttgttatagagcagttccaatgagtgcagttgcctagtttaagttttggtttctttgagcatcctccattagatgcaattttgtatcttgtgaacaaagcctctacatattggaatctgtcctgtggcataaggcaggctcattttaacttttatatcggttaagattgttggcacttgctattttaatgcttgcaaaggttatatggaaagggcttgctttttttgcagttgcaaaaaatatgttcgttccacatgttttccatcagtccactgattgtaaatcaatccttgtttggttcagcttcaatatgtatgcactatcattgcatgcctggttgttggaaaactggtgccaactcatttgctgagttcaaaaaataaaatgctcgaatatcagtgattgttcttaatgttagctgttgagaaaaatgacatatttcatttggatggtacgagtttaaggaatgcctatccctcatttcaggtataatctaaataaaagattcagc

SEQ ID NO: 4091 - DNA, 1416 bp, Aristolochia fimbriata
aaatatgtgggggattatgaggcaaaaagttgggcgtgggggcttccctgcaatgattcttggacaatctttgcgaaggatacagcctgcagcttctgtgctacccagaacattctccactgcagcaaaggagattactgtgcgtgatgctttaaactctgcacttgatgaagaaatgtctgctgatccaaaagtattcctgatgggtgaagaggttggtgaatatcagggagcatacaagatatccagaggtcttctggagaaatatggtcctgaaagggttcttgatacaccaatcaccgaggctggtttcactgggattggagttggttcagcgtactatggtctaaagcctgttgtggagtttatgacgtttaacttctctatgcaggcaattgatcatatcatcaattctgcagcaaaagcaaactacatgtctgctggccagataaacgttcctattgttttcagagggccaaatggtgcagcagctggagtaggagcacagcattcccagtgttatgcggcttggtatggttcctgccctggattgaaagttcttgctccatactcatcagaagatgcaagaggattgctgaaagctgctatcagagaccctgatccagtagttttccttgaaaacgagttgctatacggtgagtcattccctgtgtcagctgaagctctagactctagcttttgcctcccaataggaaaagctaagatagaaagagaaggaaaacacgtgacaattacagctttctcaaagatggtcggttatgctctgaaggcagctgaagaactctccaaggatggaatcagtgctgaggttataaatcttcgatcagttaggccacttgatagagctgccattaatgcttcagtcaggaaaacaagcagactagtgactattgaagaaggtttccctcagcatggtgtcggtgcagaaatctgtgcatctgtggtggaagaaagtttcgactatcttgatgcacctgtggaaaggattgctggtgcggatgtcccgatgccatatgctgcaaatctcgagagaatggctgtacctcaggttgaggatatcgtccgggcagcaaaacgagtatgctacagatcatacccttgagaagatttgttttgtgacacactctggaaggcaagctgcgtttgaaacatggatgccatgttgtcgtttctcgcggtgggactgaaagatgatcatcctgtttctttagtcatgcttcggagagcctattcgataaagctagaaacatattttgcggatcagtttgtcattggcgttttgtaaaagttggcgaggaaggaaagccaatttcaataaattggaccaaatgttttccttttttaacagaagaagcacatctgaaatgcgttgttgatgctcatagttcatgaaag

SEQ ID NO: 4092 - DNA, 1728 bp, Taxus baccata
aaagacaagtaggtaatcaacgcagagtacgcgggggatggaaggtagatagttaattttgaaccctaggttaggtttcaagggtttggtggaaaaataatcatttccatattatatttcatcagagatctctgttccctgaacattggattcaaatcggcctcccacatcactctatcgccagttaaattccaaggaggaaaaatgttgggtgctttgcggcaaaaatctgccactagcttgataaatcttgtttcctcattgagacatggccagggttcagagacggtggtgcctatgatatccacacaatttagaaattcatctactgctgctaaagagatgacagtgcgggatgctcttaattcagcaattgaagaagaaatgtctgcagatccaaaagtttttttaatgggagaagaggttggtgaataccaaggagcttataaggtttcgaaagggcttctgcagaaatttggacctgacagggttattgatacaccgatcactgaggctggttttaccggcattggtgtgggtgcagcatattatggtctgaaacccattgtggagtttatgacatttaatttcgctatgcaggctatcgatcacatcataaattctgcagccaagtcaaattacatgtctgcaggtcaaatctctgtgcccattgttttccgaggaccaaatggtgctgctgctggagttggtgctcagcactcacagtgttatgcggcatggtatggttcctgcccgggtctgaaagttttggttccctattcgtcagaagatgctcgtggattgctgaaagctgccatccgggacccagatcctgttatttttcttgaaaacgaattgatatatggtgagtcttttccagtctcagcagaatgtcttgattctagcttctgtcttccaattgggaaagcaaagattgaaaaagaaggaaaggacgtgacgatcacggccttttcgaaaatggtcggctatgctttgcaggctgcgcgagaacttgcaaaggaaggaatcaatgctgaggtgataaatcttcgttccattcgacctttggatagagctacaatcaatgcttctgttaggaagacgaaccggctggtgacagtagaagaaggttttccacaacatggcattggtgcagaaatctgtacttctgtgattgaggaaagctttgaatatttggatgcacctgtggaaagaattgctggggcagatgttcccatgccttacgctgcaaatttggagcgcttagctgttccacaggtagaagatattattcgagctgctaagagggcttgctacagagaagttcgtatgagtgcagctgcctagtgtaatttttgacatccatctactgtttttttctttaaaatgtaatgatttttgtaatctttcaacaaggccccagtatgattgagatttatctagtatacagggcatagtcattttgaaattttctttaggttaagattgttttacatctgtgccagccttacgattttgagtgttacatggaaaggtttgtttttccaccatcataaagtatgtatgtatcatcattgtttaccggccagctgatggggaattgatccttgtttgtgttgacatcgatttctaagcactgtcatcatacgttgacacatcattttttaccaaatgtttagtgtcggtggagagattatatgagctataggcccataaaactaatgctgt

SEQ ID NO: 4093 - DNA, 1404 bp, Brassica napus
gaatctacgtctcgtctaagttaattaaaaatctcgtgtgctgtgtgtggaacaacagcaagtaagtaccctttcgctcaagctttgagtcgtcgtcgtcttcttcttctcttctccgaatacgccggtgcggtagatcgtacaaacctaacataagagagaaaatgtggggaatcttgaggcaaagaggcattgatggcggcggcttgtctcttaggaggacacgatccgcattggtttccgcaaggagctacgcagctgggtcaaaagagatgactgtcagagatgccctaaattctgcaattgatgaggaaatgtctgcagatccaaaagtctttgtcatgggtgaagaggttggacaatatcaaggtgcctacaagatcactaaaggacttttggagaaatatggtcctgagagggtttatgatacccctattaccgaggctggattcactggaattggagttggtgccgcctatgctggcttaaagcctgttgtagaatttatgacgtttaacttttcaatgcaggcaattgatcatatcattaattctgctgcgaagtcaaattacatgtctgctggacagataaatgtacccatcgtctttagaggacccaatggtgctgctgctggtgttggtgctcagcattctcagtgctatgctgcctggtacgcctcagttcctggtttgaaagttctcgctccatattcagctgaagatgctcgtggtcttcttaaagctgccattagagaccctgaccctgttgtcttccttgaaaacgagttactatatggtgaatcatttccaatttcagaagaagcactggattcaagtttctgtcttcccataggcaaagccaagattgaacgacaaggaaaggatgtaacaatagtaactttctcgaagatggtcggttttgccctcaaggcagctgagaagctcgcagaagagggaataagtgctgaggtaataaatctgcggtcaatccgtccgctagacagagcaaccatcaatgcttcagtgagaaaaacaagtagattggtaacagttgaagaaggcttccctcagcatggagtctgtgcagaaatctgtgcgtcggttgtggaggagagcttttcatacttggatgcaccggtcgagaggatagcaggagctgatgtaccaatgccttatgcagccaacctagagagattggctcttcctcaggtagaggatatcgttcgagcagccaagagagcttgttacagatccaaatgaaaaaaaatgatcatcgtcaagaacacgttcttctttgatgaaagtaaaataagaaagaaaaaaaaagaggagaaattgatgtgtcttttgccacaaaaccaccattcgtgatttttatttgaccttttgctattattattcttgc

SEQ ID NO: 4094 - DNA, 1509 bp, Catharanthus roseus
aaaacaaaaatctgcaactacctgaggtagtctacctccacggctccacccttcccttgattcaaagcaaactcatcaacggcagccaccaacgtcaaagacggaattcgcactctaatagcctctgctttcaaataaattcttttgtaagaagatatggcaggtgcattaaggaagatagtaggctgccgagggactccagtttcgggaattcgagtaattgggtctagggcttactcttccttggtgaaacagatgactgtccgagatgcattaaactccgcacttgacgaagaaatgtctgctgattctagcgtctttttgatgggtgaagaggttggtgaatatcaaggtgcatacaagatttcaaaagggcttttggagaaatatggtcctgacagggttattgacactcccattactgaggctggttttgctggaattgcagtgggtgcagcttacaaaggtctgaagcctgtcatagagttcatgacaattaacttctcattgcaggcaattgaccatatcatcaattcagctgcgaaatcaaactacatgtccgctggtcaaatttcagtgcccattgttttcagaggtcccaatggagcagctgctggagttgctgctcagcattcccagtgctatgcttcatggtacggttcagttccagggttgaaggtactggcaccatactcagcggaagatgcccgtggcctgctaaaagctgctataagagacccagatcctgttgttttccttgaaaatgaattaatgtatggtgagtctttccctgtttcatctgaggccctggattcaagcttttgtcttccaattggcaaagctaaggtagaacgcgaaggaaaggatgttacaattactgcattctcgaaaatggttggctatgctcttaaggctgctgagattctggaaaaggaagggatcagtgcagaggttataaatttgcgctccataaggccacttgacagagccacaataaattcttcagttaggaaaaccaacagacttgtgactgttgacgaaggatttcctcaacatggcgttggagctgagatctgtgcatgtgttgttgaagagagctttgagtatcttgatgcacctgttgaaagaatcgcaggagctgatgttcccatgccttatggagcaaatcttgagagaatggctgttccacaggttgaggatattgtccgtgcaacaaagaggacatgctacagatcatcagtcccgcttgctgctgctgcctaagttaactggaacgcgctctgctttagacaggttatcgcatcaccataaaacaaaagacttttggaagctattcttttgtcttcacgatgggaattttggctttgtatcaataaaactcaattaagcaatcctcacttatgcatgttttttgaaatcaagaggatgaatgtttccttttcttctcttataggttagtgcttgttgagtatatgctatttacttcaattgtttgaggcaagaggaagt

SEQ ID NO: 4095 - DNA, 1394 bp, Distylium racemosum
aaaagtctgcatctggcttgatagctcttgctagttcattgagacatggtcaagtgtcagaaggtatggtgcccatggtatctgcctcattaagaaaattatctactgcactaaagagatgacagtgcgggatgcacttaactcagctattgatgaagaaatgtctgcagatccaagtgtctttttgatgggagaagaggttggtgaataccaaggagcttataaggtttcaaaaggtcttctgcagaagtttggacctgacagggttcttgacaccccaatcactgaggcaggttttactggcattggtgtgggtgctgcatactatggactgcgacccattgtggagttcatgactttcaattttgctatgcaggctattgaccacattataaattctgcagccaagtcaaattatatgtctgcaggccaaatctctgtgcctattgtattccgaggacccaatggagctgctgcaggagttgctgctcagcactcacagtgttatgctgcatggtatgctgcctgcccaggattgaaagttttgtctccctattcatcagaagatgctcgtggattgttgaaagctgccatccgtgatccagatcccgttgtatttctcgaaaatgaattgctgtatggtgagtcttttcctgtgtcagcagaatgcctcgattctagcttctgtctccccattgggaaagcaaagattgaaagggaaggaaaggacgtgacgatcacagcattttcaaaaatggttggctatgcattgaaggctgctgaggaacttgcaaaggagggaatcagagctgaggtgataaaccttcgttcaattcgaccattggatagagctacaattaatgcttctgttaggaagacaaatcgactggtgacagtagaagaaggttttccacagcatggtgtcggtgcagaaatctgtacttctgtgattgaggaaagttttgaatatttggatgcacctgtggaaagaattgccggggcagatgttcccatgccttacgctgcaaatttggagcgcttagctgttccccaggtagatgacattattcgagcagcaaaaagagcttgctacagagaagttcccatgagcgcagctgcttagtgtaatttttaatgtctgtagaccgtgtttttcttttaaaatgtaatgaaatttgtattttgtgaactaggcactggtatgcagtgagatactggggcataggcaagctcattttgaactttttcgaaatttacctttggccttgcgattagcgaccgtgaagtttacatgggaacgtttgcttatttcactgtcagtctatttttctgccgttggttttccagtggtccattgatgtgaaatgatctttattttcttcggcaacaatttt

SEQ ID NO: 4096 - DNA, 1495 bp, Fagopyrum esculentum
cgggggagggagacgtttggggcgtttacgatctcccgttctctcgcacaagtctaaaatcgacccaggctgtagagaaatatgtcgaggattatgatgcaaaagattgcaaatggcggagtttcatcatcgagactttggcgtctgcaacaagcggctagggctttctcgtctggtgggaaagagatgaccgtgagagacgctctaaattctgcccttgacgaagaaatggctgcagactccagggtgtttgtgatgggtgaagaggttggtgaatatcaaggtgcttacaagattacgaagggacttttagataagtacggtcctgagagagttattgacactcctatcacagaggctggttttgctggtattggagttggtgcagcttacaagggtttgaggcctgtaatagagtttatgacgttcaacttctcgatgcaggcaattgaccacataatcaattcagcagccaaatcaaattatatgtctgctggtcagttgtcagtaccaattgtttttagaggtcccaatggagctgctgctggagttggtgctcaacattcccagtgttatgcagcatggtatggttcatgtcctgggttgaaggtgttgtgtccgtactccgcagaagatgccagagggctactcaaagctgctataagggacccggaccctgttgttttccttgaaaatgagttgctatatggtgaatctttccccatttcagaagaagctcttgactccagtttctgccttcctattggaaaagcgaagatagagcgaccaggaaaggatgtaacaatcattgctttctccaagatggttggctatgcccttaaggccgctgatattttggagaaggaaggaattaatgctgaggtcataaaccttcgtacaattcgtcctcttgatagagccacaattaatgaatctgttaggaagaccaacaggctagtcacccttgaggaaggtttcccccagcatggagtgggtgctgaaatatgtgcaactgttgtggaggacagttttgagtaccttgatgcccctgttgaaagaattacaggtgctgatattcccatgccttatgctgcaaatcttgagagattggctgttcctcagattgatgatattgttcgtgcagcaaagaggacatgctatagatcagttccaatggctgccactgcttagtggcttcagatcacaaggtgaccgagttcatcttctgtatttgttcttgttacggcgctgcttgatgttagttttgatgttgattatcaaattcataaaaaaaaaaccgcattagaagcatgcggttgctccttcagtccggaaatgtacaatcctgctgaacaacttagccaaattttggaaataattttacatcaaatatgcctagagaggccaaaccattgtagaatctctggagaagatgtacaagtgtgacaacaaataaaactttgctttattattgacaaactgatttcatggtttg

SEQ ID NO: 4097 - DNA, 1320 bp, Fagopyrum esculentum
aggctgtagagaaatatgtcgaggattatgatgcaaaagattgcaaatggcggagtttcatcatcgagactttggcgtctgcaacaagcggctagggctttctcgtctggtgggaaagagatgaccgtgagagacgctctaaattctgcccttgacgaagaaatggctgcagactccagggtgtttgtgatgggtgaagaggttggtgaatatcaaggtgcttacaagattacaaaggggcttttagataagtacggtcctgagagagttattgacactcctatcacagaggctggttttgctggtattggagttggtgcagcttacaagggtttgaggcctgtaatagagtttatgactttcaacttctcgatgcaggcaattgaccacataatcaattcagcagccaaatcaaattatatgtctgctggtcagttgtcagtaccaattgtttttagaggacccaatggtgctgctgcaggagttggtgctcaacattcccagtgttatgcagcatggtatggttcatgtcctgggttgaaggtattgtgtccatactctgcagaagatgccagagggcttctcaaagctgctataagggacccggaccctgttgttttccttgaaaatgagttgctatatggtgaatctttccccatttcagaagaagctcttgactctagtttctgccttcctattggaaaagcaaagatagagcgaccaggaaaggatgtaacaatcattgctttctcaaagatggttggctatgcccttaaggctgctgatattttggagaaggaagggattaatgctgaggtcataaaccttcgtacaattcgtcctcttgatagagccacaattaacgaatctgttaggaagacgaacaggctagtaaccctcgaggaaggtttcccccaacatggagtgggtgctgaaatatgtgcaagtgttgtggaggacagttttgagtacctggatgcccctgttgaaagaattacaggtgctgatattcccatgccttatgctgcaaatcttgagagattggctgttcctcagattgatgatattgttcgtgcagcaaagaggacatgctatagatcaattccaatggctgccactgcttagtggcttctgctgcttgatgtttagttttgatgttgataatcaatttgataaaaaccacattagaagcatgtggttgctccttcagtccggaaattttggaaataatttaatttacatcaaatatcaaatatggggagagagtccacccattgtagaatatctggagaagatatacaaatgtgacaacaaataaaa

SEQ ID NO: 4098 - DNA, 1514 bp, Sequoia sempervirens
atctgcaactagcttgataaatctcgtttcttcattgagacatggtctagggtcagaggggtggtgcccttgcatcaacacaactaaaaagtctatctactgcggctaaagagatgacagtgcgtgatgcacttaactcagctctcgaggaagaaatgtctgcagatccaaaagtatttttaatgggagaagaggttggtgaataccaaggagcttataagatttctaaaggccttctgcaaaagtttggacctgacagggttcttgataccccaatcactgaggctggttttaccggcattggtgtcggtgcagcatattatggactgaaacccgttgtggagttcatgacattcaattttgctatgcaggctattgatcacatcataaattctgctgccaagtcaaattatatgtctgcaggccaaatctctgtgcccattgtcttccgaggaccaaatggagctgctgctggagttggtgctcagcactctcagtgttatgctgcatggtatggttcctgcccaggactaaaagttttggttccctattcgtcagaagatgctcgtggattactgaaagctgccatccgtgacccagatcctgttatatttcttgaaaatgaattgctgtatggtgagtcttttccagtctcagcagaatctcttgattctagcttctgtcttccaattgggaaagcaaagattgagaaagaagggaaggatgtgacaatcacggctttttcaaaaatggttggctatgctttgcaggcagcacaagaacttgcaaaagaaggaatcagtgctgaggttataaatcttcgttcaattcgacctttagatagagctacaataaatgcttctgttaggaagacaaataggctggtgactgttgaagaaggttttccacaacatggcattggtgcagaaatttgtacttctgtggttgaggaaagctttgaatatctggatgcacctgtggaaagaattgcgggggctgatgttcctatgccttatgctgcaaatttggagcgcttagcagttccacaggtagaagacatcattcgtgctgcaaagagggcttgctacagagaagttccaatgagtgcaacagcctagtgtaaattttatttccttaaaatgtaatgaaatttgctctatattaatgtggcccaatgatgcgttcagatttatcctactatatagggcatggtcattttgaactttcttttggttaggattgtttccatctgtgctggcctcgcaatttttaatgctggaaaggtttgtttttccgctgtcagagtatatttctctcattgttatttactggtcagttgatgggaattgatccttgtttgtgttgaaatcaatttctatgaactgttatcatctgctgtccatcatttttaaccaaaattttggtgtcatttgttgcagagcctatatgagccttaaaattaaatggtgtaatgccagtttttatccttgaataataatgagttgctaaatgcc

SEQ ID NO: 4099 - DNA, 1420 bp, Silene vulgaris
aagtagaaaaagcttcgtgagcgcgaaaaaatgtcgtcgcttgtgaggcaagttattaacactggacgtctttcctcttcgagagttcaggcgttgcagcatgttgctagaactttcgcaaccggtggtaaacagatgacagtcagagatgctctaaattctgcaatagatgaagaaatggctgcagatcctaaggtgtttgtgatgggtgaagaggttggtgagtatcaaggagcctacaagattaccaaaggtcttctggacaagtatggtccacaaagggttattgacactccgatcacagaggctggctttgctggtattggtgtcggtgcagcatacaaagatctcagaccagttatagaatttatgacattcaatttctcaatgcaggcaattgatcacataattaattctgctgcaaaatcaaactacatgtctgctggtcagatatcggtaccaattgttttcagaggcccgaatggtgctgctgctggggttggtgctcagcattcccagtgttatgctgcttggtatggttcatgccctggtttgaaggtattgtgtccgtactctgcagaggatgcacgcggcttgctgaaagctgccatcagggaccctgatcccgttgttttccttgagaatgagttgctatatggagagtcttttcctgtttcagaggaggtccttgactctaattttacactacctattgggaaagccaagatcgaacgacaaggaaaggatgtgacaattactgctttctcaaagatggttggctatgctctccaggcagctgaaatcttggcaaaagacggaattagtgccgaggtcataaatctgcggtcaattcgccctcttgatagggctacaatcaatgagtctgttaggagaacgaacagactggtgactcttgaagaaggtttccctcagcatggagttggtgcagaaatatgtgccagcgttgtcgaagatagctttggatatcttgatgccccggttgagaggatttcaggtgctgacatccccatgccctatgcagcaaatcttgaaaagttggctgtcccacagattgaagatattgtccgagcttgcaagcgagcgtgccaccgatcagttccaatggcagcaactgcttaattccagcgaactgaactacggagtataacttttcgtttgtaatgtttcgttttgatgttgatataaccgtcattcatgccactacgtgattgctctgatcaagttatcaataccggcaactttttcctcgaggaaataaatttttgtggccttcagtgaccagtaccaaatcgatggggactgacgtgagtcgttgacatatcattttctgagtgctgagaatgctatatattgcttttaattggttcataaatcattggtccgtaattattcctttgta

SEQ ID NO: 4100 - DNA, 1347 bp, Trigonella foenum-graecum
cggccgggggtaatttcatatgtggaagaagaaaaatgattgttgaaagagaatttttctaaggataataatctgaaacccaatcgagtatttttaaagaggcgcccacctaccaacaaagaagagaatcgggtttatctcatcaaagagcttcatagaatcactgctcagcttcgcaaggaaagcaatcaaggaatcaaaatgttaggtgttataagaaacaagagtattcggccttccttctccacattcagatttctctcttcttccgctaaacagatgacagtgagagatgctctcaactccgcacttgatgaggaaatgtccgccgattctaaagtcttcttgatgggtgaagaagttggagaatatcaaggtgcatataagattaccaagggtcttctggagaagtatggccctgagagggttctcgacactcccatcaccgaggctgggtttactgggattggagttggtgctgcttactatggtctaaagcctgttgtcgagtttatgacatttaacttctccatgcaggcaatagatcacatcattaattctgctgcaaaatcaaattacatgtctgctgggcaaataaatgtacctattgtctttagaggacccaatggagctgctgctggtgttggtgctcagcactctcattgttatgcatcttggtatggttcgtgccctgggttgaaagttttggcaccatattcatctgaagatgctcgtggtttgcttaaagctgctataagggaccctgatcctgtagttttccttgaaaatgagttgttatatggcgagtcattccctctatctgccgaagttctggattctagtttttgccttcccattggaaaagcaaagattgagagagaaggaaaagatgtgactattacagccttctcaaaaatggttggctttgctctaaaggctgctgagatactagcaaaggaaggaatcagtgccgaggttattaatttacggtcaatccgtccacttgatcgatccactatcaatgcttctgtcaggaaaaccaacagactggtgacagttgaagaagggtttcctcagcatggtgttggtgccgaaatctgtgcatctgtcattgaggagagttttggctatcttgatgcaccagttgagagaattgctgggtctgatgttcccatgccttatgcagcaaatctggagaggttggctgtcccacagattgaagatatcgtccgtgctgcgaagagagcatgccacagatctgtgcctatggctgcaactgcctaaattaatcaatctggttagttctttggtaaccctttatgttgccaaaaattactccccccccct

SEQ ID NO: 4101 - DNA, 1669 bp, Aquilegia formosa
caagctttttatttctctttttttctcgatagcttttcgacaccttaccaaccaacgaacgaacttgtgtagtacagtatactagtatagatgaagcgaaaataaacacacaaatcgtatttattaacaaatctaattcgttgaagaatttcatcaaacatatcatattcagagagagttcgagagcataataaagaagcgaaaatgttgggatctttaagacacaaggttattgggcagttgttacagagaattcgtccttcgttctcagcaacaagaagctatgcttcttcttcttctgttaaagagatgacagtgcgtgatgctctaaactctgctcttgacgaggaaatgtctgcggatccgaaagtatttgtgatgggagaagaagttggtgaataccagggtgcatacaagattaccaaaggtctactggacaagtatggtcctgagagggttgttgatactccaattactgaggcggggtttactggaattggagttggtgctgcttaccatggtctccgaccagttatagagtttatgacatttaacttctccttgcaggcaattgaccacataataaattcagctgcaaaatcgaactacatgtcagctggccagatatctgtacctattgtttttagaggaccaaatggtgctgctgctggggttggtgcccaacactctcagtgttatgcagcctggtatgcttcgtgtcctgggttgaaggtgctggctccatactcttcagaagatgctcgtggtctgctaaaagctgcaattagggaccccgatcctgttgttttccttgaaaatgaattgctatatggtgaatctttccctattccagcagaagcgcttgattctagtttttcccttccaataggaaaagctaagattgagcgagaggggaaggatgtgactattgtagcctactcaaagatggttggttatgccatccaggctgctgagattctctccaaagaaggaattagtgctgaggttataaatctgcgttccattcggccactggatagacctgcgattaatgcctctgtcagaaaaacgaacagactggttacagttgaggaaggctttccccagcatggtgttggagctgagatctgtgcatctgttgttgaggaaagctttgagtatcttgatgcaccagtcgaaagaatttctggagctgatgttcccatgccttacactgcaaatctcgagagaatggctgttccacaggtagaagacatcgttcgagcagctaagagagcgtgtttccgatcccgttcagtggaaggtctggttgcgcagcagaactaaggtgtctctctcagtttcttttgtttgctgtaatagccttcctttagaggaatgctagctagctgctcctcataaggttggacgccatacccagactgaccttgttaaccagtttttcagtttctcttttaatttacacttacgcaataaagagagtttgcttcaaatatttaatctccttccttgaaatgtggtaattcaacgtatcaactagattacaataaagcataaactaaggatagatttagggtttaaattcttgaaattgtagaagcaaagttgtaaaactatggagtaattataggtatgtcgtgttagaataaaatctatattttattttgct

SEQ ID NO: 4102 - DNA, 1544 bp, Solanum tuberosum
ggcaattttgtccttcaaagggagagaggagtcggagtacagcttttgctctcggggtcccataatcgtccgccattaacaaggattttgaattttagctaacaaggaccagacatgtctggaattataggtcgaacaatggccaatagaaggatttctgatttgaacaagttcttggtgggaagtagagtatttgcatctagaacttactcttccgcagttaaagagatgacagtgcgtgacgcactaaattcagctctagatgaagaaatgtctgcggatcctaaggtcttcgttatgggggaagaggttggtgagtaccagggtgcctataagattacaaaggggcttctgacaaaatatggtccgcaaagggttatcgatacaccaattactgaggctggatttactggaattggagttggtgcagcttaccatggtctaaggcccgtaatcgaattcatgacattcaacttttccatgcaggcaattgaccatattatcaattctgctgcaaagtcaaactacatgtctgctggtcagatatctgtgcccattgttttcaggggtcctaatggtgctgcagctggtgtcggtgcccaacactctcagtgctatgcggcatggtatggtgcatgtccaggattaaaggtactaactccgtactcttccgaagatgctcgtggcttgctcaaagctgctatcagggatcctgatcctgtcgtgtttctggaaaatgaattgctatatggtgagtctttccctatttccgctgaagctcttgattctagtttctctctccccatcggaaaagctaagatagaacgcgaagggaaggatgtgacaatcactgccttctcaaagatggttggctatgctctcaaggctgctgaaattcttgccaaggaaggaattagtgctgaggttataaatctgcgctcgatccgaccacttgatagacctgctattaatgcatctgtgaggaaaaccaacagacttgtaactgttgaggaaggatttccacaacatggtgttggcgctgaaatctgtgcatctgtggttgaggagagctttgagtatcttgatgcaccgattgagaggataacaggtgctgatgttcctatgccatacgctgcaaatcttgaaagactggctgttccacaggtagaagacatcgttcgtgcagtcaagagggtttgttaccgatcaagtaaataaatcagttccaatggctgcagctgcttaggcttggtccagcaaggtcttgattgatccaaagcatttaacttctttttgtggatatcaattctttacccgcctatgagcgtatgctttctgccatcttctggaaagtttaattgactgtaaaaccagccaaactggtaaactaacgaatgaaatctgctgccacacgaggaaatagttcttgtagaaaataatatttacagcttctttcctttttttggtgatacgttcaagaaaatgatgttacaagagaatacatacgttctgctgtgccaatgattaaagtttcttctttgtcc

SEQ ID NO: 4103 - DNA, 1549 bp, Raphanus sativus
ttacaacaaactgaaaaaaaaaaacagtgccctttcgcgcaagctttgagtcgtcgtcgtcgtctcttctctctctttcgaatccgccgtctccgatacgcttttccgccggcgcggttagatcgtacaaagcctaagataagagagaaaatgtggggaatcttgaggcgaagtgccgtcgatggaggaggcttctctgctgcttcgtctctcggaaagacgcgattcgctttggtttccgcaaggagctatgcagctggttcaaaagagatgacagtcagagacgctctaaactctgcaattgatgaggagatgtctgcagatcctaaagtttttgtcatgggtgaagaggttggacaatatcaaggtgcctacaagatcactaaaggccttttggagaagtatggtcctgagagagtttacgatacccctattaccgaggctggatttactggaattggagttggtgccgcctatgctggcttaaagcccgttgtagaatttatgacgttcaacttttctatgcaggcaattgatcatatcataaattctgctgcaaagtcgaattacatgtctgctggacagataaatgtacccattgtctttagaggacccaatggtgctgctgctggtgttggtgctcagcattctcagtgctatgcagcatggtacgcttcagtacctggtttgaaagttcttgctccatattcagctgaagatgctcgtggtcttctgaaagctgctattagagaccctgaccctgttgtcttccttgaaaacgagttactatatggtgaatcatttccaatttcagaagaagcacttgattcaagtttctgtcttcccataggcaaagccaagattgaacgagaaggaaaggatgtaaccataacaactttctcgaagatggtcggttttgccctcaaggcagctgagaagctcgcagaagagggaataagtgctgaggtaataaatctgcggtcaatccgtccgctagacagagcaaccatcaatgcttcagtgagaaagacaagtagattggtaacagttgaagaaggtttccctcagcatggagtctgtgcagaaatctgtgcttcggtagtagaggagagcttttcatacttggatgcaccggtggagaggatagcaggagctgatgttccgatgccttacgcagctaacctagagagattggctcttcctcaggtagaggatatcgttcgagcagcaaagagagcttgttacagatccaaataaagaatatgatcatcttcagaaaccccacccccaacacaaataagaaaaaaaagaggagaaaatgacgtctctttttgctacaaacaaccgttccttgtgattttatttgatctcttttgatattgttaatcctctgccctgcggttttcatttttcctttttgtcttgcgaattgaaaattatacatcttttggggtctagtgaaagagttcataacacctgcctttttctttgagaaatgattgggcagacaaatcccacaagtttaatgaattgaggtgctcctactcca

SEQ ID NO: 4104 - DNA, 1688 bp, Solanum lycopersicum
ttcagtggtagcagacatattccgtggacaatattatcggggaattttgtccttcaaaggagagaggagtcggagttgtatagcttttgctctggggtcccataatcatccgccattaacaaggattttgatttttagctaaaaaggaccagacatgtctggaatcataggtcgaacaatggccaatagaaggatttctgatttgaacaagttcttggtgggaagtagactatttgcatctagaacttactcttccgcagttaaagagatgacagtgcgtgacgcattaaattcagctctagatgaagaaatgtctgcggatcctaaggtcttcgttatgggggaagaggttggtgagtaccagggtgcctataagattacaaagggacttctggcaaaatatggtccgcaaagggttatcgatacaccaattactgaggctggatttactggaattggagttggtgcagcttatcatggtctaaggcccgtaatcgaattcatgacattcaacttctccatgcaggcaatagaccatattatcaattctgctgcaaaatcaaactacatgtctgctggtcagatatctgtgcccattgttttcaggggtcctaatggtgctgcagctggtgtcggtgcccaacactctcagtgctatgcggcatggtatggtgcgtgtccaggattaaaggtactagctccatactcttccgaagatgctcgtggcttgctcaaagctgctatcagggatcctgatcctgttgtgtttctggaaaatgaattgctgtatggtgagtctttccctatttccgctgaagctcttgattctagtttctccctccccattggaaaagctaagatagaacgcgaagggaaggatgtgaccatcactgccttctcaaagatggttggctatgcgatcaaggctgctgaacttcttgccaaggaaggaattagtgctgaggttataaatctgcgctcgatccgaccacttgatagacctgccattaatgcatctgtgaggaaaaccaacagacttgtaactgttgaggaaggatttccacaacatggtgttggcgctgaaatctgtgcatctgtggttgaggagagctttgagtatcttgatgcaccagttgagaggatatcaggtgctgatgttcctatgccatacgctgctaatcttgaaagactggctgttccacaggtagaggacatcgttcgtgcagtcaagagggtttgttaccgatcaagtaaatagatcatttccaatggctgcagctgcttaggcttggtccagcgatgccttgattgttccaaagcatttaacttctatttgtggatatcaattctttatccgcctataagcgtatgctttcagccatcttctgggaagttcaattgactgtaaaaccagccaaactggtaaactaacgaatgaaatctgctgccagatttttcggccacgcaaggaaatagttcttgtagaaaataatacttaacagcttttttcccttaaagaaaatgttgttacaagagaatacatgcgttctaggaattatcgaactgctgtgccaatgtttttttctttttgtctaatcatctctttaactggtgttgttgctataaaatgttcaaggaacaactcctcttggtggatatgcgacatgactcctatttaattatgtttt

SEQ ID NO: 4105 - DNA, 1547 bp, Arabidopsis thaliana
aattgaaatcatttcgttgtgttttagaacaacaacaaaaaaacagtgccctttcgctcacgctttgagtcgtatctgctctcttcttaatccgccgtctctcactttttcgccggcgtggttagatcgtacaaagctcagagagaatgttgggaatcttgaggcaaagagccatcgatggagcttcgactcttaggaggacgcgattcgcattggtttctgctaggagctatgcagctggtgcaaaagagatgacagtcagagatgctctaaattctgcaattgatgaggaaatgtctgctgatcctaaagtatttgtcatgggtgaagaggttggccaatatcaaggtgcctacaagatcactaaaggccttttggagaaatatggtcctgagagagtttacgatacccctattactgaggctggatttactggaattggagttggtgctgcctatgctggcttaaagcccgttgtagaatttatgacgtttaacttctctatgcaggcaattgatcatatcatcaattccgctgcaaagtcaaattacatgtctgctggacagataaatgtacccatcgtctttagaggacccaatggtgctgctgctggtgttggagctcaacattctcagtgctatgcagcgtggtatgcctcagttcctggtttgaaagtccttgctccgtattcagctgaagatgctcgtggtcttcttaaagctgccattagagaccctgaccctgttgtcttccttgaaaacgagttactatatggtgaatcattccctatttcagaagaagcccttgattcaagtttctgtcttcccataggcaaagccaagattgaacgagaaggaaaggacgtaacgatagtaactttctcgaagatggtcggtttcgccctcaaggcagctgagaagctcgcagaagagggaataagtgctgaggtaataaatcttcgatcaatccgtccgcttgaccgagccaccatcaatgcttcagtgaggaaaacgagtagattggtaacagttgaagaaggtttcccacaacatggagtctgtgcagaaatttgtgcgtcggttgtagaagagagcttttcgtacttggatgcaccggtcgagaggattgcaggagctgatgttccaatgccgtatgcagctaacctagagagattggctcttcctcagatagaggacatcgttcgtgcatcaaagagagcttgttacagatcgaaataaaatcgtcaacatcaacacatttcttctttgatctttaaagggaaaggaaaataagaaaaaaggagaaaaatgatctctctgtctctcacttttgctataagaaaccaccattcctcgtgatttatttcatcttttgctattattctttactgcagcggttttcgtttttctttttgtcccttcccaaattgataattctaatctttggggttaattgataaaaattgatcgagaatgctagtaaaggagttcacaacacctgtttttccatcaaataatgaatgaggtgtgcctaattcatgtctgata

SEQ ID NO: 4106 - DNA, 1640 bp, Gossypium hirsutum
agcttagttgagctatccttgcttgcctaccggtatctaaaattcctttctatttttagccattttcttgcccattaatttccctttaaaaaaaaatacaaatcccaaaattctaatttctttatcattattgaaggaaaaaggaggaggaattagaaacctaaattgaagaaggaaaagatgttgggaattgtaaggcaaaagatgttggaacagtcattgaagaagattcgacctgccgtgtcggtgttgagaagttactcatctgctgcaaaacagatgactgtaagagaggcattaaactctgctctcgatgaggagatgtcagctgattcgaaagtctttttgatgggtgaagaggtcggagaatatcagggtgcatacaagataaccaaggggcttcttgataagtacggacccgagagggttcttgatactccgattactgaggctggttttaccggaattgcggttggtgctgcttactatggtgtaaagcctgttgtggagttcatgacatttaacttctccatgcaggcaatcgaccacattattaactctgccgcaaagacaaattacatgtcttctggccggatatccgtacccattgtttttagaggtcctaatggtgctgcagccggtgtcggtgcccaacactctcagtgttatgccgcatggtacgcttcttgtcctgggttgaaagtgctggcaccgtacagttctgaagatgctcgtggacttctcaaagctggtattagagatcctgacccggttgttttccttgagaatgagttgttatacggtgaatccttccctgtttctgatgaagttctggattccagtttttgtcttccaattggaaaagctaagatagagaggaaaggaaaggatgtgaccattgcagcttattcaaaaatggtgggctatgctcttaaggcagccgagacgcttgaaaaggatggaatcgatgctgaggttataaatttacgttccattaggccactagatagatccacgatcaatgcctcggtcaggaaaaccaacagattagtaacagttgaagaagcgtttccacagcacggtgtcggtgctgaaatctgcgcatctattgtggaggaaagttttgcatatctcgatgcaccggttgagagaatcgccggagctgatgttcctatgccatatgcagcaaatctcgagagaatggctgtgccacaggtcgaagatatagtccgtgctgcaaagagaacttgctatagatcggtatcgtaggctgctgctccataatcaaaaccagtccaggcagctttcttttcctaatacatgaatcaagagagattgattctcaacactgtggggggaggagctgatttctcaagccaagatttatgttttgtagcataaggtaatagaattaatacgagtataacatgaaaattaccatgtcttgaaataaggtttactgtgcgaaaggaactaatgttgtaatgagctcataaatggcaaaccaacgggctcggctgggttcagattggattgttttgaaactccatatattggtgttcaatcttcgggtttagattatttcatatttaaatatttaggggattaagatatatggatttcagactatgtcgattttt

SEQ ID NO: 4107 - DNA, 2061 bp, Eucalyptus grandis
tccaaattcaaaacgtcgagagagagcgagagagagagagctgcaggtgtctgctctcatggccgtccacgtcgagatgcctccacccgatcgccgccatcacctccgctccgacttcaaccgagggcttcttcttctcgaacgctctcccttcgtctccgcaggtcgagctgatactacacctcatcttctctctctctctctctcccccttcctccaagacgccattcgcaggagcgcagtttttgcccgaaccggacggctgctgctgcggcggcggcggcgctgctttcgaagttccgagttctctccggtcgtgcggagtctcctcttctctcgatcggcggcgcggcgacgttgctgacgcctcgtctccggtgattgcagttatctggcgcggcgagagcgagctcgctcgagagatcgaggatcgagagcgcgcgagatgttgtcggtcctgagacgaaaggccgccgccgccgccgtcggaggctcggatgctatgctgttgggagggaggctgcggaagagttgtgctgcagcggcggcggggttacggggctatgccactgcggcgaaggagatgactgtgagagaggctctgaattcagcgcttgatgaggaaatgtcagcagatcctaaagtctttctaatgggtgaggaggttggagaataccagggagcctacaaggtatctaaaggttttttgccgaagtttggacctgagagggttgttgatactccaatcacagaggcgggtttcactggaattggagttggtgctgcttactatggtctcaagcctgtcgtggagtttatgacattcaatttcgctatgcaggcaattgaccacattataaattctgctgcaaagacaaactacatgtcggctggcaatatatcggtccctatagttttcagaggacctaatggagctgcagcaggagttggtgcccaacactctcaatgttatgcagcatggtatggctcgtgcccgggtttgaaagtgttggcaccctactcgtcggaagatgctcgaggactgctaaaagcagcaataagggatcctgatcctgtggtcttccttgaaaatgagctgatgtatggggagcgttttcctgtttcggcagaagctcttgattccagtttttgtcttcccatagggaaagccaagattgagagagaaggaaaggatgtcacaattactgctttttcgaaaatggttggcctttctcttgaggcagctgagatccttgcaaaggaaggaatcactgcagaggtcataaatctgctctctattcgaccactggatagacctacgattaatgcttcagtcaggaaaaccaacagactggtgacagttgaggaagggtttcctcagcacggtgttggcgcggagatctgcatgtcaattattgaggacagctttggttatctcgatgctccgattgagaggattactggggctgatgttcccatgccttacgcagcgaatctggaaagaatggctctccctcagattgaggatatcgtacgggctgcaaagagagtgtgccatagatcggtaccaatggctgcaactgcttaagctaagaagcattgcatacagggtttttgaactttggtttgcccccgtaattggagtcttcaaactgcgggttacgatttggaaattctctgcttattttctcctagcttgtttatatcgaagtacgtgacttgcgtggtttccttcaccgcctgtttgtttccctttcccgtttcctacaagaggtggagatgtcacatgtaactctctgtatcataggtcgcaagtggctgttgtaacttgtatggcacttgtggagaatctttgtagcctattgatatccaccgatggtgcaataatttctatcattctagtaactgaaggttacaaactctagatggtttgggaaagggagaattctactatgctaattgtatctcccgagtatggcattttcacggattatgttcgttgtgcctctgggatatgatttcatttggcaggagaaaattgaaactgttgtatagacctca

SEQ ID NO: 4108 - DNA, 1574 bp, Brassica napus
gtgacctttcgcgcaagctttgagtcgtcgtcccttctctctttcgaatccgccgtctccgatacaccttttttccggcgccgtagatcgttcaaagctaagtaagagagagagagagaagatgtggggaatcttgaggcgaagtgccgtcgatggaggaggcttctctgcttcgtctctcagaaggacgcgatccgcgttggtctccgcaaggagctacgcatctggttcaaaagagatgacagtcagagacgctctaaactctgcaatcgatgaggagatgtctgcagatcctaaagtattcgtcatgggtgaagaggttggacaatatcaaggtgcctacaagatcactaaaggccttttggagaagtatggtcctgagagagtttacgatacccctattaccgaggctggattcactggaattggagttggtgccgcctatgccggcttaaagcctgttgtagaatttatgacgtttaacttctctatgcaggcaattgatcatatcataaattctgctgcaaagtcgaattacatgtctgctggacagataaatgtacccattgtctttagaggacccaatggtgctgctgctggtgttggtgctcagcattctcagtgctatgcagcatggtatgcctcagttcctggtttgaaggttctggctccatattcagctgaagatgctcgtggtcttcttaaagctgccattagagaccctgaccctgttgtcttcctcgaaaacgagttactatatggtgaatcatttccaatttcagaagaagcacttgattcaagtttctgtcttcccataggcaaagccaagattgaacgagaaggaaaggatgtaaccataacaactttctcgaagatggtcggctttgccctcaaggcagctgagaagctcgcagaagagggaataagtgctgaggtaataaatctgcggtcaatccgtccgctagacagagcaacgatcaatgcttcagtgagaaaaacaagtagattggtaacagttgaagaaggtttccctcagcatggagtctgtgcagaaatctgtgcgtcggttgtggaggagagcttttcatacttggatgcaccggtggagaggatagcaggagctgatgttccaatgccttacgcagctaacctagagagattggctcttcctcaggtagaggatatcgttcgagcagccaagagagcttgttacagatccaaataaagaaaatgttcatcgtcagacaccaccacccccaacacatttcttctttgatctctaaagggaaggaaaataagaaaaaaaggagaaaaatgatgtctcttttgctacaaaacaaccgttcctcgtgattttttatttgatctcttgctattgttaatcctctggctgcggtttttcatttttcctttttgtctttcggattgaaaattatacatctttgggagtctaggaagagagttcagataacacccgccttttcttttgtgaaatggttgggctgtccaatcccaacaaataatgaatgaggtgttcctaatcctgttttatgttctataattgttcaagtata

SEQ ID NO: 4109 - DNA, 1390 bp, Raphanus sativus
  misc_feature (928)..(928): n is a, c, g, or t
gacaacaagagcaagtaccctttcgctcaagctttgagccgtcttcttcttcttctcctcctctgaatccgccggtgcggttgatcgtacaaagctaagatagagagagagaaaatgtggggaatcttgaggcgaagagccgtcgttgatggaggcttgtctctcaggaggacacgatccgcattggtttcagcaaggagctacgcagctggttcaaaagagatgacagtcagagatgccctaaattctgcaattgatgaggaaatgtctgcagatcctaaagtatttgtcatgggtgaagaggttggacaatatcaaggtgcctacaagataactaaaggacttttggagaaatatggtcctgagagagtttatgatacccctattaccgaggctggattcactggaattggagttggtgccgcctatgctggcttaaagcctgttgtagaatttatgacctttaacttttcaatgcaggcaattgatcatatcattaattctgctgcaaagtcaaactacatgtctgctggacagataaatgtacccatcgtctttagaggacccaatggtgctgctgctggtgttggtgctcagcattctcagtgctatgcagcctggtacgcctcagttcctggtttgaaagttctcgctccatattcagctgaagatgctcgtggtcttcttaaagctgccattagagaccctgaccctgttgtcttccttgaaaacgagttactatatggtgaatcatttccaatttcagaagaagcacttgattcaagtttctgtcttcccataggcaaagccaagattgaacgagaaggaaaggatgtaacaatagtaactttctcgaagatggtcggttttgccctcaaggcagctgagaagctcgcagaagagggaataagtgctgaggtaataaatntacggtcaatccgtccgctagacagagcaaccatcaatgcttcagtgagaaaaacaagtagattggtaacagttgaagaaggtttccctcagcatggagtctgtgcagaaatctgtgcgtcggttgtggaggagagcttttcatacttggatgcaccggtggagaggatagcaggagctgatgtaccaatgccttatgcagctaacctagagagattggctcttcctcaggtagaggatatcgttcgagcagccaagagagcttgttacagatccaaatgaaaaaaaaaatgatcatcgtcaagaacacattttttctttgatcttttaaaggaaaggaaaataagaaaaaaaaaaagagaaattgatgtctcttttgctaccaaaccaccattcgtgatttttatttgatattttgctattatttatcttgttaatcttcgctcactgcggttttcttttt

SEQ ID NO: 4110 - DNA, 1366 bp, Silene vulgaris
tgtaaaaccctagaaaatgtcgtggcttgcgagaaaagtaatcaccgatgcgcgccttacctcctcttcatcgagagttagggcgttgcaacatgctgccagaagtttcgccaccggtggcggtaaagagatgacagtcagggatgctctaaattctgcattagatgaagagatggctgcagatcctaaagtttttgtgatgggtgaagaggttggtgagtatcaaggagcctacaagatcaccaaaggactcctggataaatatggcccacaaagggttattgataccccaatcacagaggctggctttactggtattggagttggtgctgcatacaaagagctcagacctgttatagaattcatgacatttaacttttcgatgcaggcaattgatcacataattaattctgctgcaaaatcaaactacatgtctgctggtcagatatctgtaccaattgttttcagaggtcccaatggtgctgctgctggagttggtgctcagcattcccagtgttatgctgcttggtatggtgcatgccctggtttgaaggtactagctccgtactcctcggaggatgcgagaggcttgcttaaagctgccattagggacccagatcctgttgttttccttgagaatgagttgctatatggggagtcttttcctgtttcagagaaggtccttgacccgaattttgttctgcctattgggaaagccaagattgaacgccaaggaaaggatgtgacaattactgctttctctaaaatggttggctatgctcttcaggcagctgaaattctggcaaaagacggaattagtgcagaggtcgtaaatcttcgatcaattcgcccgcttgatagagctacaatcaatgagtctgtaaggaaaacgagcaggctagtgactgttgaagagggtttccctcagcatggagttggtgcagaaatatgtgcaaccgttgtcgaagatagctttggatacctagatgcaccagttgagaggatcgcaggtgctgatgttccgatgccctatgctgcaaatttggaaaggatggctgtgccgcaggttgaggacatcgtccgagctgctaagcgagcatgctaccgatctgcttaaaaccatcagctaggaagtataagaggtcatatgtagcgtttagttggtgttgataatttgttattcatgccactcaatttggcagcttcgatcaagatgctcaaacaggcaacatttcctcaccggaaaataaaattttgtcgcatttatacagtttgtttggtataaacagagctacaaggtcatttttttttgttgacatgcgtattgtagacagttgtcaggatcttattaatgatcgaagaagat

SEQ ID NO: 4111 - DNA, 1453 bp, Solanum phureja
ttcattggtagcagacatatatattccgtggacaatattatcgggcaattttgtccttcaaagggagagaggagtcggagtacagcctttgctctcggggtcccataatcgtccgccattaacaaggattttgaattttagctaacaaggaccagacatgtctggaattataggtcgaacaatggccaatagaaggatttccgatttgaacaagttcttggtgggaagtagagtatttgcatctagaacttactcttccgcagttaaagagatgacagtgcgtgacgcactaaattcagctttagatgaagaaatgtctgcggatcctaaggtcttcgttatgggggaagaggttggtgagtaccagggtgcctataagattacaaaggggcttctgacaaaatatgggccgcaaagggttatcgatacaccaattactgaggctggatttactggaattggagttggtgcagcttaccatggtctaaggcccgtaatcgaattcatgacattcaacttttccatgcaggcaattgaccatattatcaattctgctgcaaagtcaaactacatgtctgctggtcagatatctgtgcccattgttttcaggggtcctaatggtgctgcagctggtgttggtgcccaacactctcagtgctatgcggcatggtatagtgcatgtccaggattaaaggtactaactccgtactcttccgaagatgctcgtggcttgctcaaagctgctatcagggatcctgatcctgtcgtgtttctggaaaatgaattgctatatggtgagtctttccctatttccgctgaagctcttgattctagtttctctctccccatcggaaaagctaagatagaacacgaagggaaggatgtgacaatcactgccttctcaaagatggttggctatgctctcaaggctgctgaaattcttgccaaggaaggaattagtgctgaggttataaatctgcgctcaatccgaccacttgatagacctgctattaatgcatctgtgaggaaaaccaacagacttgtaactgttgaggaaggatttccacaacatggtgttggcgctgaaatctgtgcatctgtggttgaggagagctttgagtatcttgatgcaccgattgagaggataacaggtgctgatgttcctatgccatacgctgcaaatcttgaaagactggctgttccacaggtagaagacatcgttcgtgcagtcaagagggtttgttaccgatcaagtaaataaatcagttccaatggctgcagctgcttaggcttggtccagcaaggtcttgattgatccaaaacatttaacttctttttgtggatatcaattctttacccgcctatgagcgtatgctttctgccatcttctggaaagtttaattgactgtaaaaccagccaaactggtaaactaacgaatgaaatctgctgcca

SEQ ID NO: 4112 - DNA, 1546 bp, Arabidopsis lyrata
ttgaaatcatttcgctgtgttttagaacaacaacaaaaaaaacagtgccctttcgctcacgctttgagtcgtatcttcttctctctcgcttttttcgccggcgtggttagatcgtaccaaagctcagagagaatgttaggaatcttgaggcaaagagccatcgacggaggcttggctgcttcgactcttagaaggacgcgattcgcattggtttctgctaggagctatgcagctggtgcaaaagagatgacagtcagagatgctctaaattctgcaattgatgaggaaatgtctgcagatcctaaagtatttgttatgggtgaagaggttggccaatatcaaggagcctacaagatcactaaaggtcttttggagaagtatggtcctgagagagtttacgatacccctattaccgaggctggatttactggaattggagttggtgccgcctatgctggcttaaagcctgttgtagaatttatgacgtttaacttctctatgcaggcaattgatcatatcatcaattccgctgcaaagtcaaattacatgtctgctggacagataaatgtacccatcgtctttagaggacccaatggtgctgctgctggtgttggggctcaacattctcagtgctatgcagcgtggtacgcctcagttcctggtttgaaagtcctcactccgtattcagctgaagatgctcgtggacttcttaaagctgctattagagaccctgaccctgttgtcttccttgaaaacgagctactatatggtgaatcgttccctatttcagaagaagcacttgattcaagtttctgtcttcccataggcaaagccaagattgaacgagaaggaaaggatgtcacgatagtaactttctcgaagatggtcggtttcgccctcaaggcagctgagaagctcgcagaagagggaataagtgctgaggtaataaatcttcgttcaatccgtccgcttgacagagccaccatcaatgcttcagtgagaaaaacgagtagattggtaacagttgaagaaggtttccctcaacatggagtctgtgcagaaatctgtgcgtcggttgtagaagagagcttttcatacttggatgcaccggtggagaggattgcaggagctgatgttccaatgccttatgcagctaacctagagagattggctcttcctcagatagaggatatcgttcgagcatcaaagagagcttgttacagatcgaaataaaatcgtcaacagcaacacatttcttctttgatctttaaagggaaaggaaaataagaaaaaaaggagaaaaatgatctctctctctctctctctctctcttttgctataaaaaccaccattcctcgtgatttaatttcatctttttgctattattcttggctgcagcggttttcgtttttctttttgtccttcccaaattgataattctaatctttggggttaactgataaaaaaattgatcgagaacgctagtaaggagttgacaacacctgtttttccagcaaataatgaatgaggtgtgcctaattcatgt

SEQ ID NO: 4113 - DNA, 1185 bp, Brassica oleracea
  misc_feature (763)..(763): n is a, c, g, or t
  misc_feature (799)..(799): n is a, c, g, or t
  misc_feature (1141)..(1141): n is a, c, g, or t
  misc_feature (1155)..(1155): n is a, c, g, or t
tctctctctcgaatccgccgtctccgatcgcttatcgccggcgctgtaaagctaagttagcgagaaaatgtggggaatcttggggagaagagccgtcgatggaggcttctctgcttcgtctctcagaaggatgcgatccgggttggtttccgcaaggagctacgcagctggttcaaaagagatgacagtcagagatgcccttaattctgcaatcgatgaggaaatgtctgcagatcctaaagtctttgtcatgggtgaagaggttggacaatatcaaggtgcctacaagatcactaaaggccttttggagaaatatggtcctgagagagtttatgatacccctattaccgaggctggatttactggaattggagttggtgccgcctatgctggcttaaagcctgttgtagaatttatgacgtttaacttttctatgcaggcaattgatcatatcataaattctgctgcaaagtcaaattacatgtctgctggacagataaatgtacccatcgtctttagaggacccaatggtgctgctgccggtgttggtgctcagcattctcagtgctacgcagcatggtacgcctcagttcctgggttgaaagttctcgctccatattcagctgaagatgctcgtggtcttcttaaagctgccattagagaccctgaccctgttgtcttccttgaaaacgagttactatatggtgaatcatttccaatttcagaagaagcacttgattcaagtttctgtcttcccataggnaaagccaagattgaacgagaaggaaaggatgtaacnataacaactttctcgaagatggtcggttttgccctcaaggcagctgagaagctcgcagaagagggaataagtgctgaggtaataaatctgcggtcaatccgtccgctagacagagcaaccatcaatgcttcagtgagaaaaacaagtagattggtaacagttgaagaaggtttccctcagcatggagtctgtgcagaaatctgtgcgtcggttgtggaggagagcttttcatacttggatgcaccggtggagaggatagcaggagctgatgtgccaatgccttacgcagctaacctagagagattggctcttcctcaggtagaggatatcgttcgagcagcnaagagagcttgttncagatccaaataaaacaatgaccatcttca

SEQ ID NO: 4114 - DNA, 1478 bp, Brassica rapa
gcacgagggaaatctttgtcacaaaaaaaaaacaagcatttgagtcgtcttcttcttcttctctctctcgaatccgccgtctccgatctcttttcgccggcgccgtagatcgtataaacctaagttagctagaaaatgtggggaatcctggggagaagagccgtcgatggaggcttatctgcttcgtctctcagaaggatgcgatccgggttggtttccgcaaggagctacgcagctggttcaaaagagatgacagtcagagatgctctgaattctgcaatcgatgaggaaatgtctgcagatcctaaagtctttgtcatgggtgaagaggttggacaataccaaggtgcttacaagatcactaaaggccttttggagaaatatggtcctgagagagtttatgatacccctattaccgaggctggatttactggaattggagttggtgccgcctatgctggcttaaagcctgttgtagaatttatgacttttaacttttctatgcaggcaattgatcatatcataaattctgctgcaaagtcaaattacatgtctgctggacagataaatgtacccatcgtctttagaggacccaatggtgctgctgctggtgttggtgctcagcattctcagtgctatgcagcatggtacgcctcagttcctggtttgaaagttctcgctccatattcagctgaagatgctcgtggtcttcttaaagctgccattagagaccctgaccccgttgtcttccttgaaaacgagttactatatggtgaatcatttccaatttcagaagaagcacttgattcaagtttctgtcttcccataggaaaagccaagattgaacgagaaggaaaggatgtaacaataacaactttctcgaagatggtcgggtttgccctcaaggcagctgagaagcttgcagaagagggaataagtgctgaggtaataaatctgcggtcaatccgcccgctagacagagcaacgatcaatgcttcagtgagaaaaacaagtagattggtaacagttgaagaaggtttccctcagcatggagtctgtgcagaaatctgtgcgtcggtagtagaggagagcttttcatacttggatgcaccggtggagaggatagcaggagccgatgttccaatgccttacgcagctaacctagagagattggctcttcctcaggtagaggatatcgttcgagcagcaaagagagcttgtttcagatccaaataagacaatcatcatcttcagaaaccaaccccccaacacattccttctttgagtaaaggaaaataagaaaagaggagaaaatgatgtctcttttgccacaaaaccaccattccccgtgatttttatttgatcttttgctactaatgtcaatcctcgctgcggttgtctttttgtccttcaatttgaaaattattgaatcttttgggttaattgataaatcgatcgagaaagctagtaaagaatct

SEQ ID NO: 4115 - DNA, 1479 bp, Brassica napus
ggttacaaaagaaaaagaaaacagctttgagtttgtcttcttcttctctctctctcgaatccgccgtctccgatcgcttttcgccggcgctgtaaagctaagttagcgagaaaatgtggggaatcttggggagaagagccgtcgatggaggcttctctgcttcgtctttcagaaggatgcgatccgggttggtttccgcaaggagctacgcagctggttcaaaagagatgacagtcagagatgcccttaattctgcaatcgatgaggaaatgtctgcagatcctaaagtctttgtcatgggtgaagaggttggacaatatcaaggtgcctacaagatcactaaaggccttttggagaaatatggtcctgagagagtttatgatacccctattaccgaggctggatttactggaattggagttggtgccgcctatgctggcttaaagcctgttgtagaatttatgacgtttaacttttctatgcaggcaattgatcatatcataaattctgctgcaaagtcaaattacatgtctgctggacagataaatgtacccatcgtctttagaggacccaatggtgctgctgctggtgttggtgctcagcattctcagtgctacgcagcatggtacgcctcagttcctgggttgaaagttctcgctccatattcagctgaagatgctcgtggtcttcttaaagctgccattagagaccctgaccctgttgtcttccttgaaaacgagttactatatggtgaatcatttccaatttcagaagaagcacttgattcaagtttctgtcttcccataggaaaagccaagattgaacgagaaggaaaggatgtaacaataaccactttctcgaagatggtcggttttgccctcaaggcagctgagaagctcgcagaagagggaataagtgctgaggtaataaatctgcggtcaatccgcccgctagacagagcaacgatcaatgcttcagtgagaaaaacaagtagattggtaacagttgaagaaggtttccctcagcatggagtctgtgcagaaatctgtgcgtctgtagtagaggagagcttttcatacttggatgcaccggtggagaggatagcaggagctgatgtgccaatgccttacgcagctaacctagagagattggctcttcctcaggtagaggatatcgttcgagcagcaaagagagcttgtttcagatccaaataaaacaatgaccatcttcagaatccaaccccccccccaacacattccttctttgagaaaaggaaaataaggaaagaggagaaaatgatgtctcttttgccacaaaaccaccattccccgtgatttttatttgatcttttgctactattattctgtcgatcctcgctgcggttatctttttgtccttcaaattgaaaattattgaatcttttgggttaattgataaatcgatcgagaaagctagtaaagaatctcacacctgtttttt

SEQ ID NO: 4116 - DNA, 1228 bp, Arnica chamissonis
agccacgggattatcatctcagggtcttgggaatcatatgttgaggttaaggcctgtaacatcagctttgagaaattactcatctgcaaccaaagagatgatggtacgagatgctctgaactccgctcttgatgaggaaatggctgctgatcctaatgtttttgtgatgggtgaagaggtaggagaataccagggtgcttacaagataaccaaaggattattggacaaatatggtccagaaagggttgttgatacccctatcacagaggctgggtttactggtattggagttggttctgcatatcatggtctgaggcccgtgatagagtttatgactttcaacttttctatgcaggcgattgatcatattatcaattctgcagcaaagtcaaactacatgtctgctgggaagataaatgtacccattgtttttcggggaccaaatgggcccgctgctggtgttggtgctcaacattcccagtgttatggtgcatggtatgggtcagttcctggtttgaaagtgcttgtaccttactcctctgaagatgctcgtgggcttctaaaagctgcaatcagagaccctgatcctgttgtttttcttgaaaatgagatgctgtatggtgaatctttccctgtttctgctgaagcccttgattcaagtttctgtcttcctattggaaaagcaaagattgaaagagaagggaaagatatcacaattacagctttctcaaagatggttggctatgctcttaaggctgctgaaatacttgaaaaggaagggataaatgcagaggttataaacctgcgttctattcgaccactagatagagctacaatcaatgcttcagttagaaaaactaaccgcctggtcactgttgaagagggatttcctcagcatggcattggtgctgaaatttgtgcatcggttgttgaagatagctttgggtatcttgatgcaccagtcgagaggattgcaggggctgatgttcccacaccttatgccgccaatcttgagagaatggcttttcctcagatcgaggatattgttcgtgcggccaagagagtgtgctacagatcggtatgaaaatggtgactccttttgttcctggtgtgaattaaatttgtagaattctgtgtctacacataaaatctttctacttaatgaggttggatgcaatgcaaaagatctcagattctggtttcttttgacatgcaatcttttcaataa

SEQ ID NO: 4117 - DNA, 1528 bp, Lactuca sativa
cgggggatcttcgttctgtcgttcacatcagaccttcgcccgtcacataacttcacacttcttcacaacgttcaactgtatcttcccacaccgccgaaccttctcagacctcagctccagacgtccgatcgctggcgccggatacacagttttctccttctccgattacctgcttttgacttcaaaggagaaaaagatgtgggggattataaggcaaaacgttggtggtgccagagacttatcttctcaggttctggggagttctctgatgaggttaaaacctataacatcagctatgagacattactcatctgcaactaaagagatgacagtacgagatgctctgaactctgctcttgacgaggaaatggctgctgatcctaatgtctttgtaatgggggaagaggtaggagaataccagggtgcatacaagataacgaagggattattggataaatatggtcctgaaagggttgtggatacccctatcacagaggctgggtttgcggggattggggttggatctgcatatcatggtctgaggccggtgatagagtttatgactttcaacttctctatgcaggcaatcgatcatattataaattctgcagcaaagtcaaactacatgtctgcggggcagattaacgtgcccattgtttttaggggaccaaatggacctgctgctggtgttggggctcaacattcccagtgttatggtgcatggtatggatcagtccctggtttgaaagttgttgtgccatactcctctgaagatgcccgtggacttctaaaagctgcaattagagaccctgatcctgttgtttttcttgaaaatgagttgttgtatggcgaatccttcccagtttccgcagaagcccttgattcaagtttctgcctccctataggcaaagcaaagattgaaagagaagggaaagatatcaccatcactgctttctctaagatggttggctatgctcttaaggcggctgaaatacttgaaaaggaagggataagtgcagaggtaataaacctgcggtccattcgaccattggatagaggtacaatcaatgcttctgtaaggaaaactaaccggctggtgactgttgaggaaggctttcctcaacatggtgttggtgctgaaatctgtgcttcggttgttgaagatagctttggttatctggatgccccagtggagaggattgctggggctgatgttcccactccttatgctgccaatcgttgcagataatggctttttccacagattgaggatattgttcgtgctgctaagagagtttgttataggtcggcactacctttggctgcaactgcttgatgcatttattatcttctgatttttcattatgttcttcacacacaaactcataaacattcactgccacatttttttttttttcaattatcattttatactacactcagtaaaaagatgaaagctttggcgaaagtcttgattctagagctagggtactacatgcataaagaaacaataatattatttacttta

SEQ ID NO: 4118 - DNA, 1508 bp, Pisum sativum
gaaaaagagaccaaaatccggagaagatagtttggttgatctgtgagtagcgattcaaatcggattcagctttcacttcattcagttcttctacaaaatcaaccatgttgggtgttataagaaacaagactattcgcccttcattctccgcattcagatttttctcttcagctaaacagatgacagtgagagatgctcttaattctgcacttgatgtggaaatgtctgctgattctaaagttttcttgatgggggaagaggttggagaatatcaaggtgcttataagattaccaagggattgctagagaagtatggtcctgaaagggttctcgacactcccatcaccgaggctgggtttactgggattggagttggtgctgcttactatggtctaaagcctgttgtggagtttatgacatttaacttctccatgcaggcaatagatcacatcattaactctgctgcaaaatcaaattacatgtctgctgggcaaatatctgtacctattgtctttagaggactcaatggtgatgctgctggagttggtgctcagcactctcattgttacgcatcttggtatggctcatgccctgggttgaaagttttggcaccatattcagctgaggatgcccgtggcttacttaaagctgctattagggaccctgatcccgtagttttccttgaaaatgagttgttatatggtgagtcattccctgtttctgccgaagttcttgattccagcttttggcttcccattggaaaagcaaagattgagagagaaggaaaagatgtgactattacagccttctcaaaaatggttggctttgctctaaaggctgctgagatacttgaaaaggaaggaatcagtgccgaggttattaatttacggtcaatcaggccacttgatcgacccaccatcaatgcttccgtaaggaaaaccaacagattggtgacagttgaagaaggatttcctcagcacggtgttggcgctgaaatctgtacttctgtcattgaggaaagttttgggtatcttgatgcacctgtcgagagaattgctggcgctgatgttcccatgccttatgcagctaatctcgagagattggctgtcccacatgttgaagatatcgtccgtgctgctaagagagcatgccacagatccgtgcctctggccgcagctgcctaaaataatcaatttaggtccgaaatttttatgtcgtggtttgttctttggtaacacttaatgttaccaaaaataatttcccccaaatttcaccacagcctcataaagaaagaggttttactcgctgattctgttaggctttggtttaaaaaattgtgatgtaagcatataatattgtccaagttttcaggagcaatagattctatacattttttttaatccatctcagcatttctgagaggaagttcatgtttaattacaatgacacacaagacgggaagttgtatgcaacctagtgataaactttttgattaaaaaaaaaaaaaa

SEQ ID NO: 4119 - DNA, 2762 bp, Zostera marina
cttattcgcccgccacccggaaaattctaggtgacgaaagatgttgggggttctgtcgaggaaagcttgctccatatccgttttagatcgctctccatggacaattaggcacgccttgcctgtttcgacaaggaactactccactgctacgaaagagatgactgtaagggatgctctaaactctgcactagatgaagaaatgtctgctgattcaagggtttttatgattggcgaagaggttggggaatatcaaggtgcatacaagatttctaagggtctcttagataagtatggaccagacagagttcgtgatactccaatcacagaggctggctttgctggaattgctgtcggcgcagcttatcatggtcttcggcctgttgttgaatttatgacattcaacttctcgatgcaggcaattgaccacattgtcaattctgctgccaaaatgaactatatgtctgctggcgaaatatctgtgccaattgtttttaggggaccaaatggtgcagctgcaggagttagttctcagcactcacagtgctatggagcttggtatggttcaattcctggacttaaggttctaaccccatattcttctgaggatgctcgtggtttgttaaaatctgcaatcagagaccctgatccagttgttttcttggagaatgagcttctatatggtgaatcattccctgtcacagaagaagttatggattccagtttttgcgtcccaattggaaaggccaagattgaacgagaaggaaaggatgttactattgtgactttttctaagatggttggttattctctcaaggcagcagaattactttcaaaagaaggaattagtgcagaggttataaatcttcgatcaattagaccactagacagagacacaatcaatgcctctgtcaggaaaaccaaccgacttgtcacagtggaagaagggtttccacagcatggcattggtgctgaaatttgtgcgtctgttgtggaggaaagtttcgagtatcttgacgcagcagtggagaggattgctggagctgatgttcccaccccttatgcagtaaatcttgagagaatggctgttccacagattgaagatatagtcagggcagctaaaagagcttgctacaggtctgtctccatggctgttgctgcttgatccatttatcctcattggtgcttttccattgctaactgtaataaaagtatgattctcaacagcagaatggcctgctcaggtatttgacttttatggtcatcttcttccatagagtgtctatggttggttgtgttgaatattggtttttttaccagttgatttttttagctaataaattaaattattggcgccattattccattttgccaaattggcaatgctaaaaaaattggctgttgaaattgtcttattgataaattgtaagctatagacaagtttcaatttataatatttatgtttaggtatatagtcgtatagatagtaaacttgattggtacttttctttgtctctaatatcactaaaaaaaattagtctcttttggtataaacaagtttgcaatttctttggctcttttaacaaggagagttgtggttttcctccagattatttagtggttgttacagaatatgaacaaaaatattcaaatttaagcagctaatatattccttggcattgtcatttgtaaaagctacccaagcataccgaacaagaacagttaaataacaaaaaatatttagagttaggcatttttcttgggagctactttggtgcttgtagaattttttagatgcttcgactgatacttggcaacaataccatagcatatccataggtagcacaaaccgacaaagcgtgtgaagctgataccgactaattcgatgaatgccattatgtaagatctttgaggagacaacccagcagtagaaatagagagtatgtgaccaatgaagctgcaggacactatgaagtctccggattctataccgttcaaaaccttttcagcaacatcttctgctttcatcacaggagagtactgtgctaatttgtttgtgatcttaggtcttctcttcttctcttctactatgcctggtgtctctgtatatggaggtgttatgagggaaacatgaatgttatccgaaataacttcctgctgcaacgcttctgcaagacctctaagagcaaatttacttgcagaatatgcagcatatccatagatcccaatctgtccggcctgagaagaaatgattccaatagacttaggcagatcagaaccacccgaaccctctttcatcttaggcaatgcagccttaattagatgaaaagttccaacaacattgacatccaacataaacttgatgtcattcatatcgacatccaccagctcacccgatatgtacactccctgattacagatcaaaacgtcaatcggccctgcagcctcgatcgccgaacgcactgcctccatgttccgtacgtcagcgctgtaaacagcaacctccacaccagtagcgttacgaatgtcttctttggcctcttccaactttgaaacactcctagcaaggatcgaaacgcgagatccggcagacgccgcgcggtgggcgagtgcaagacctatgccgcttgatccaccggtaatgaagacgtggcgatccttaatcgggatcttgactggccgtggtcggcaaagaaaccggaggatgctgaggccgaggacggcgacaacgacgaggaggtagatcagtgccattttttttggag

SEQ ID NO: 4120 - DNA, 1580 bp, Raphanus sativus
ctctgttgttgttacaaagccaaaaaaaaagccaagcttcgagtcgtcttcttcttattctctctctttgaatcagccgcctccgatcgcatttcgcaggcgccaagttaacaagaaaaatgtggggaatcttggggcgaagagccgtcgtcgtcgatggaggtttctctgcttcgtgtctcagaagtaggatgcgatccgggttggtttcagcaaggagctacgctgctggttctaaagagatgacagtcagagatgccctcaattctgcaatcgatgaggaaatgtctgcagatcctaaagtttttgttatgggtgaagaggttggacaatatcaaggtgcctacaagattactaaaggccttttggagaaatatggtcctgagagagtttatgatacccctattaccgaggctggatttactggaattggagttggtgccgcctatgctggcttaaagcctgttgtagaatttatgacgtttaacttttctatgcaggcaattgatcatatcataaattctgctgcaaagtcaaattacatgtctgctggacagataaatgtacccatcgtctttagaggacccaatggtgctgctgctggtgttggtgctcagcattctcagtgctatgcagcatggtacgcctcagttcctggtttgaaagttctcgctccatattcagctgaagatgctcgtggtcttcttaaagctgccattagagaccctgaccctgttgtcttccttgaaaacgagttactatatggtgaatcatttccaatttcagaagaagcacttgattcaagtttctgtcttcccataggaaaagccaagattgaacgagaaggaaaggatgtaacaataacaactttctcgaagatggtcggttttgccctcaaggcagctgagaagctcgcagaagagggaataagtgctgaggtaataaatctgcggtcaatccgtccgctagacagagcaacgatcaatgcgtcagtgagaaaaacaagtagattggtaacagttgaagaaggtttcccacagcacggagtctgtgcagaaatctgtgcgtcggtagtggaggagagcttttcatacttggatgcaccggtggagaggatagcaggagctgatgttccaatgccttacgcagctaacctagagagattggctcttcctcaggtggaggatatcgttcgagcagcaaagagagcttgtttcagatccaaataaacacaatgatcatcgttcctcacaaaccaaccacaccccaacacattccttctttgagaaaaaggaaaataagaaaagaggagaaaatgatgtctcttttgcctacgtgatttttatttgatcttttcctactattattcttgtcaatccttcctgcggtcatctttttgtccttcccaaattgaaaaatattgaatattttgggttaattgataaattgatcgagaaagctagtaaatggcttttctctgtggaatgttgtgcacaaaaaaaaagcccccaccaagtagtgaggttttaatgtacggtgtacacccaatctactctacttaaaagaaaataactcttatt

SEQ ID NO: 4121 - DNA, 1626 bp, Aquilegia formosa
cccagtagactcttcaaccccttaaaaagccatttctcactcagattccaatcaacgaaaaaaaaacacagagagaaagagatcataaacaatcgaaaatgttgggaactttaagacagaaagtcttttctaccggtgtttcttcttcatcggttattgggcagtcattgctgagaattcgtccatcgttctcggcaacgagaagctatgcttcttctgtcaaagagatgacagtgcgtgatgctctaaattccgctcttgacgaggaaatgtctgcagatccaaaagtatttgtgatgggcgaagaagttggtgaataccagggtgcatacaagatcaccaagggtctactggacaagtatggtcctgagagggttgttgatactccaataactgaggcggggttcactggaattggagttggtgctgcttaccatggtctccggccagttatagagtttatgacatttaacttctccatgcaggcaattgaccacataataaattcagctgcaaaatcaaattacatgtctgctggacagatatctgtacctattgtttttagaggaccaaatggtgctgctgctggggttggggcccagcactctcagtgttatgcagcatggtttggttcgtgtcctgggttgaaggtgctggctccatactcttcagaagatgctcgaggtctgctaaaagctgcaattagggaccctgatcctgttgttttcctggaaaatgaattgctatatggtgaatctttccctatttcagccgaagcacttgattctagttttgcccttccaattggaaaagccaagattgagcgagagggaaaggatgtgactattgtaacctactcaaagatggttggttattctatccaggctgctgagattctctccaaagaaggaattagcgctgaggttataaatcttcgttccattcgaccactggatagacctgcgattaatgcctctgtcaggaaaacaaacagactgattacagttgaggaaggcttcccccagcatggtgttggagctgagatctgtgcatctgttgttgaggaaagctttgagtatcttgatgcaccagtggagagaatttctggggctgatgttcccatgccatatgctgcaaatctcgagagaatggctgttccacaggtagaagacatcgttcgagcagctaagagagcgtgtttcagatccagttgagtggcaggtctgcttacgtagcagggctaaggcttccccactcagtttcttttgagagaggatatatgggaaagatcaaagaggatttatgggaaaaattcaaatttcttgtgaatgtccacagtttacacacatcaaccctccacccattctaatggagtgtttgggggtgttttttccttggtaaaattcatgtgttaataatggtgtacccaaatttctacagtaagatgagcagtcaattcttttgttatgaaaacaacagttaggaagcaaccaattttgttatttggtatgtttcttcaacaaactaaacatggttttcgcttgtttctttccacttgttagatgagggtaaaatggggtcaagaaattgtgaccagtgaaaaaagtactgaccaacttctaatgc

SEQ ID NO: 4122 - DNA, 1687 bp, Gossypium hirsutum
attgaaggaaaaaaaaggaggaattagaaacctaaattgaagaaggaaaagatgttgggaattgtaaggcaaaagatgttggaacagtcattgaagaagattccacccgccgtgtcggtgttgagaagttactcatctgctgcaaaacagatgactataagagatgcattaaactctgctctcgatgaggagatgtcagctgattcgaaagtctttttgatgggtgaagaggtcggagaatatcagggtgcatacaagataaccaaggggcttctcgataagtacggacccgagagggttcttgatactccaattacggaggctggttttaccggagttgcggttggtgctgcttactatggtgtgaagcctgttgtggagttcatgacatttaacttctccatgcaggcaattgaccacattattaactctgccgcaaagacaaattacatgtcttctggccagatatccgtacccattgtttttagaggtcctaatggtgctgcagccggtgtcggtgcccaacactctcagtgttatgccgcatggtacgcttcttgtcctgggttgaaagtgctggcaccatacagttccgaagatgctcgtggacttctcaaagctgctattagagatcctgacccggttgttttccttgagaatgagttgttatacggtgaatccttccctgtttctgatgaagttctcgattccagtttttgtcttccaattggaaaagctaagatagagaggaaaggaaaggatgtgaccattgcagcttattcaaaaatggtgggctatgctcttaaggcagccgagacgcttgaaaaggatggaattgatgctgaggttataaatttacgttccattaggccactggatagatccatgatcaatgcctcggtcaggaaaaccagcagattagtaacagttgaagaagcttttccacagcacggtgtcggtgctgaaatctgcgcgtctattgtggaggaaagttttgcatatctcgatgcaccggttgagagaatcgccggagctgatgttcctatgccatatgcagcaaatctcgagagaatggctgtgccacaggtcgaagatatagtccgtgctgcaaagagaacttgctatagatcggtatcgtaggctgctgctccataatcaaaaccagtccaggcagctttcttttcctaatacatgaatcaagagagattgattctcaacactgtggggggaggagctgatttctcaagccaagatttatgttttgtagcataaggtagtaaaattatagaagtaattaaaataatgtgagaatagattgtaaagcgaacatgaaaattaccatgtcttgaaataaggtttacagtgcgaaaggaactaatgttataatgagctcataaatggcaaactaacgggctcggctgggttcagattggattgttttgaatctccagatattggtgttcaatcttatttcgggtttagattatttcatatttaaatattttggggattaagatatatggatttcagactatttcgatttttgactatcagatttttgttcaagtggaaggttttttttctcagttttcgataactttttaatgtatgttggatcgagtggtaggaaattcaatattctttaagaaaaagtttaagttcaagttttgtaaataaacctgcgcgg

SEQ ID NO: 4123 - DNA, 1343 bp, Vinca minor
tgtcttaacggcggcgcttcggcttgtttccgaagaagaactgaatcatgctggggattctaaagcaaaaggttcgtgttggaacaaaacaaaagattttaagcccagctgtgtcagcaattagaagctattcctcggcgtctaaaaagatgatggttagagaagctctcaactctgcccttgacgaggaaatggctgctgatcccagagttttcttgatgggtgaagaggtaggagagtatcaaggtgcttacaaggtttctaaaggactgctgcagaaatatggaccagaaagggttgttgatactccaatcactgaggctggatttaccggactaggagttggcgctgccttttatgggcttaggcctattgttgaatttatgacatttaatttcgcaatgcaggcaatagatcacataattaattctgctgcaaaaacgaactacatgtcttcggggaatataagtgtgcctatagtttttcgaggaccaaatggtgctgctgcaggggttggtgcacaacattctcagtgttatgctccttggtacggctcagtaccgggaatgaaagtattggccccatattcatctgaagatgctcgtggacttctaaaagctgcgataagagatcctgatccagttgtattccttgaaaatgaattgctgtatggcgaatctttccccgtctcagaagatgttctggattccagttttagtcttcccattgggaaagctaagatcgaaagagaaggaacagatgtcactattgcaaccttttcaaaaatggtcggctatgctttgaaggcagctgagattcttgaaaaagaagagattgatgcagaggttattaatctgcgatcaattaggccgctggatagagccgcaatcaatgattcagttcgaaaaaccaacagactcgtgacagttgaagaagggtttcctcaacacggcgttggtgccgaaatctgtgcatcggttgctgaggaaagttttcagtatcttgatgctcctgttgagaggattgctggtgcggatgtccccatgccttactccgctaatctcgagagactggctcttccacaggttgaggatgttgttcgagcagctaagagagcatgctacagggctgtatccacagcagccactgcttaagacccccctcttttcggccgggtaactaagaggtgggatggttccatcagacccgatcctacctacctcttgcataatatcatatgggccttgcatgtagatataggatacattaagcagaaagaaggatcatgtggggagggagggaggtgggaccagaactattggtatttgttcgccttccggttt

SEQ ID NO: 4124 - DNA, 1506 bp, Fagopyrum esculentum
tctcctctatcgatccatcgatcggatctctgcttcctcttccacgacccacgaacgaattcaatcaaaacctcttgtatttctccatcacctaactcccgtcaggccggatagaacaatgtcgaggattatgatgcaaaagattgtacgtggaggagtttcctctacgagattctggcgtatgcatcaggccgccagagctttctcctcgggtggaaaagagatgactgtcagagatgctttaaattctgcaattgatgaagaaatggctgcagactccaaagtgtttgtgatgggtgaagaggttggtgaatatcaaggcgcttacaagataacaaaagggcttttggacaagtatggtcctgaaagagttattgatactcccatcacagaggctggttttgctggtattggagttggcgcagcttacaagggtttgaggcctattatagaatttatgacatttaacttctcaatgcaggcaattgaccacataatcaattcagcagccaaatcaaactatatgtctgctggtcagctgtcagtgccaattgtcttcagaggaccaaatggtgctgctgctggagttggtgctcagcattcccagtgttatgcagcatggtatggttcgtgtccggggttgaaggtgttgtgtccatactcctcagaagatgccaggggcttacttaaagccgctattagagacccagaccctgttgttttcctcgaaaatgagttgttgtatggtgaatctttccctgtttctgcagaagtcctggactccaacttttgccttccaataggaaaagccaagattgaacgaccaggaaaggatgttacgatcgttactttctccaagatggttggctattcccttaaggcagctgatattctggagaaggaaggaatcagcgctgagatcgtaaaccttcgttcaattcgcccccttgatagagctacaatcaacgaatctgtgaggaagaccaacaggcttgtagctgttgaagagggtttcccccagcacggagtgggtgctgaaatctgtgcgactgttgtggaggatagctttgagtatctagattccccagttgaaaggatttcaggtgctgatattcccatgccttatgctgcaaatttggagaggatggctgttccacagatcgaagatattgttcgcgcagcaaagagggcgtgctacagatcaagttcctagggttgctgcgtccaagggtttcacaattacaagatgactaaattcagcttctgctttcttcccgatttgttatcctctctttgatcgttacatcgatgttgataattatttttgatcaatcacattgtaagcatgtgatttctaggtctgtttggaagtgcctgatacaattttggttaacttgcctgatatccggaaataatgatgatttgctgtcatcacaaccctgcctaggagggctcaacattgtaaaatcttgagataatatacaacttcttttgagaatttagttg

SEQ ID NO: 4125 - DNA, 1636 bp, Euonymus alatus
taagcgaaataaacaaagactagtgggagtggcggctcttcttcgcgtctatttcacatctcgtcgtcgatcggatccagctccagttcttttaaagaagaagagatgtggggggttagttagccaaaaggttttagcaaagtccctgcaacctcttcgccctgcagcatcagcatggagaggttttgcctctggaacgaaagagattaccgtgagagaggctctaaactctgcacttgacgaagaaatgtcagctgatcctaaggtctttttgatgggtgaagaggttggagaatatcaaggtgcatacaagatttccaaggggctattggacaagtatggccctgagagagttcttgataccccgatcacagaggctggttttactgggatcggagttggtgctgcatactatggtcttaagcctattgtagagtttatgacgttcaacttctcaatgcaggcaatcgatcacatcataaattctgctgcaaaatcaaactatatgtctgctggccagatatctgtgccaattgttttcagaggacccaatggtgctgctgctggagttggtgcccaacattcgcactgttatgcagcatggtatgcctcttgccctggtttgaaagtgctatccccatattcatctgaagatgctcgtggactgctaaaagctgctataagggacccagatcctgttgtttttcttgaaaatgagttattgtatggtgagtccttccctgtttctgatgaagtacttgattccagcttttgccttcctattgggaaagctaagattgagagggaaggaaaggatgtgacaattacggcattttcgaaaatggttggctatgcgcttaaggcagcagagacacttgagaaagagggaattagtgctgaggttataaatttacgttccattaggccactggatagggacacgataaattcttctgtcaggaaaactagcagactggtaacagttgaagaaggatttcctcagcatggtgttggagccgaaatctgcacatctgtagttgaggatagctttggttatcttgatgccccagtcgagagaatctctggagctgatgtgcccatgccatacgctgccaatcttgagagaatggctgtcccacaggttgaagatatagtccgcgcggccaagagagcttgctacagatctgtctcagtggctgcaactgcctaaaactctctcaacagtcctagctgccttttcattccaggaaatgcagtcattaaacatttttttcccttctccaacacttttggggaggacttggctttcaaataactcggagaaggaagagacggcgggaagttttgtggctttgttgtgttaatttgttgagttacgtaggaatgaatactatagttggaagccaaaattgacgttttaatttcgactgctgttctggttatttccgagaagtgctgtctctgttctttccaagattgttttctgattaattttttgtctagtcttgatcctttcatggcctgaaggactgaaactattttctgtcatggtgtatgctctataatctctcgcgagagaaatgcagaatcatccaaaatggtagattttcttgaatgtaatttttgtcagaatagt

SEQ ID NO: 4126 - DNA, 2451 bp, Sorghum bicolor
acaactccacgagcttccacggctcagcgtcggcgcgcagccatgactgctcctactccgagggcgctatcccagcacaccgcgcggcgcgtgggcgtggcgagcagcccccagggccgccactcccgttcctctcctgcgccgccgcgccaccatctccacccacagcacaagcagcaggggcccacggcgccgtcggcgtccgtgttgggcgtcggcgtcccgagagtcgcctggctctcgcagcgcacccctgtcctgggcctccgcgcctgggtcctcgtcgccgcaggcgccgcggcggccgccctcgccctcctctgcctcatcgtctgcctctgccgccgctgcagccggcgtcgccgcacacctcgcctcgccccgtgcccgcaccgccccggcgccatcaagtccctcaagcaccgcgtgcatgcgcaccatcaacatgaagcagtgccaatgccgccgccggccaacaaggacgtcgaggaggcggccgccgctcggtggcgcccccgccccgcttcgttcgaacagccgccgatcgaggccatcagggcggagcagaaggcgccgctgatcctcgcggagcatttcgcgaggacgagcggcgaggagacggccacaagcagcggtggcagcgatgatgcggaggttccagaggcggcggcacagcgcgggtggggccggcggtacacgcgccgcgagatggaggaggccacggccgggctcgcccccgccaacgtgatgggggaaggcgggtacggcgtcgtgttcaggggcgtgctccgcgacggcaccgccgtcgccatcaaaaacctccacaacaacaggggtcaggccgagagagattttaggatggaggttcagacgatcgggcgcgtccggcacaagaacctggtcagtttgctcggctactgcagcgagggagcttgcaggatgcttgtttacgagtacatggagaacagcaatctggataagtggctgcaccatgatgacagtgaaatcagcccactgacctgggacatcaggatgcgcatactccttggaacggctaaagggctggcgtatctccacgagggtctggagcccaagatagtgcaccgcgacatcaaatccagcaacattctcctggaccggcagtggaacgccaaggtgtcggatttcgggctcgccaagcttctctgctcggagagatcctacatcaccactcgtgtcgtgggaacgttcgggtacgtggcaccggagtacgccaagaccgggatgctgaacgagaggagcgacgtgtacagcttcggagtgctggtgatggaggtcatcaccggcaggactccagtggactacactagacccaccgacgaggtggacctggtggagtggctgaagcgcatggtggccgagcggagggtggaggaggtgctggacccgaggctgccggagccgccgccgtccaaggcgctgaagcgggcggtgctcgccgcgctccggtgcgtcgacccggacggcagccagagacccaccatgccgcatgtggttcatatgctggaagacgaccagattctcagagacgagttcaagctcgcgcgggacctgtcgcctcgggagtcagatagctacgaagaacgcgaacgcagcagtaatgtttcgctcagcgtgctttcgattgctgctgctcgcaaccgcgcaccacgcgcccatccgcaggggagggggtgtgaattcgtgaatcgtgatggtgccgacgcctcttgtaccccggtggtcgtcgtcgtcgccggcgggattcgagcgcactgcgcgtcggcaccagcttcgacagcggcctgttcttatctttcagaaaagctccttgcctttttcactaccagacgacgacgatgcgcctcaaccatccgctcggcggccacggacagcagcttcgggaccggcggcgacgcggcgccgtccaagaagaccacccggaaggagaagcagcaggagcggcggcggcagcaggacctgcaggaccggcagcagcagctcctgatgatggaagaaaaaacgtccctcgcgaagcgagacggcggcaccggcagcagcagcagcggcggcggcgaggtcgacggcgacgacgacgagcttccgcagcccgtgttcgaccgcatcctgcgccggatcgcgttcacggtgggccttcccatggcgacgggcgtcgcgctgctcaacgtgtacgacgcgctcaagcgcggccagggggtggtggtgccttcgtgggtgccgctgctcaccatcctcgtcgccttcggcacgtcggcgctcggcatcgcctacggcacgctgtcggcgagctgggaccccgacagggaaggctcgctgctcggcatcgacgaggcccgggccaactggcccgtgctgtggcaggaagagatccagaaggagaaggagaagaaggccaagcagatgaagaaatga

SEQ ID NO: 4127 - DNA, 905 bp, Triticum aestivum
catcgctgtctggaaggcaagccaaaagcaagaagcgcccaggaaagaacacacacaggcacaggcacaggcagagaggagaggcaatggcgaccactaagatggcggtggtggcgatcctggcggcgctgctgctgatggcagctgtggagccggcttcggccacgccgcccagcatgctggcggcaagaaagttgcagatgcctcgcctcatggatgtcgtcttggcagagtcaaagctggcttgcctcccagcaggcggtttttgcatgtttcgtcctatggattgctgcggtaactgcggttgtttatatcctgccggggtttgctacggcacgcggtgtgaggaatgaactgcacgtacgtgtccattttattactagcttatcacgcatctgtgtcacaataaatcgtgttctgcgttcggtccctagcttgttgctcatgatcaacaagctctgttcaagtatcgagtctgttagtttgttagcgtgtactgtcaggtacgtgttgtgcatgagctcacgagttgtgtgacgccgtgcaagtagtggtggcgagaataggtagctcgcagtaccgagtctagcttccggccttggactcgctcttcacgtcctgcgtcgtggggatggacgcgacaatggcgtggcgggatgtgagaaggatcgagctcccagggccgttcctttgagtcatgtaatcaccaataaataaaatgtcaatagagtctcagaaaacgctgcaacctctgtgtgtgtcaaattcatttctgaacccacgatttcattcacaaatttacttgtggaaaacgaactagtggatgacatgtgggtctagttgatttgagtttgctaggataatatgtttgacttcaggcaaatgataatatgtctgactatttg

SEQ ID NO: 4128 - DNA, 726 bp, Triticum aestivum
gaattcggcacgaggaagaagcgcccaggaaagaacacacacaggcacaggcacaggcagagaggagaggcaatggcgaccactaagatggcggtggtggcgatcctggcggcgctgctgctgatggcagctgtggagccggcttcggccacgccgcccagcatgctggcggcaagaaagttgcagatgcctcgcctcatggatgtcgtcttggcagagtcaaagctggcttgcctcccagcaggcggtttttgcatgtttcgtcctatggattgctgcggtaactgcggttgtttatatcctgccggggtttgctacggcacgcggtgtgaggaatgaactgcacgtacgtgtccattttattactagcttatcacgcatctgtgtcacaataaatcgtgttctgcgttcggtccctagcttgttgctcatgatcaacaagctctgttcaagtatcgagtctgttagtttgttagcgtgtactgtcaggtacgtgttgtgcatgagctcacgagttgtgtgacgccgtgcaattagtggtggcgagaataggtagctcgcagtaccgagtctagcttccggccttggactcgctcttcacgtcctgcgtcgtggggatggacgcgacaatggcgtggcgggatgtgagaaggatcgagctcccagggccgttcctttgagtcatgtaatcaccaataaataaaatgtcaatagagtctcagaaaa

SEQ ID NO: 4129 - DNA, 897 bp, Zea mays
acttggacataacgcaacgcccgccgcgaaaagcactaccggcctgtgctgctgtggtagttagtttcaagcagcaatggaagccgtggtggccacgacgacaacgagggtgtccttccctctgctgcccaccgcggggaggcccctgctcccgccggtcctggcgcggccccgccgcggcttcgcctccgtctccgccacctccacatccggcgcaggcggcggcggggggcgctcatctgcaggcggctgcggcggcgacggtggaggggacgactccggtgccggcgcagccgcggccgccgcggctgtggcggctctgggtgagtccgagcagcaggaggacggcgactctgacgcaatcgtgctccatgtcgggggaatgacgtgcggcggatgtgcggacaaggtgaagcgaattctggagagccagcctgaggttgctgcagctacagttgatgtcgaaaaggccaccgctattgtgtggacgacacctgaagcgaaggctaccaaagactggcaaaaacaattggccgagaaacttgccaaccatctcacctcttgcgggttccagtctcatctgcaagacgaaggcgaggctgaacaaactgatgcttaacctcagcagtgcattacgtatgtatgactatgagtggccaggaagttttagcatggagggtccttgcatgaagcaatgtctcccacttcagaagttgttacatgcgggtctacgatgtacttcttttatttatttgtcgcagtttagttcaaaaatgaactcgcaggaagtttttatgccgttatattgttgttaaggacttgtggttgaacttcgaaacagctgaactgttgagtatcgaaggcgaactagcgataaaataaaatgatgaagtatcg

SEQ ID NO: 4130 - DNA, 2126 bp, Sorghum bicolor
ctcactcgcctcagccgtcaccacacgcacacatcctccatctcctcctcctccttgcacggctgcacgcgagcagcgacagcgagcgaacgacaagctagctaggcatggaccagctccccaagcgcccggccaactacgtgccgctgagccccgtgggtttcctgccacgcgccaatgccgtctacggcgaccgcgcgtccgtcatctacgggcgcgtccgcttcacctggcgccagacgtaccaccgctgccgccgcctcgcgtccgcgctgctgtccctcggcgtccgcaggggcgacgtcgtctccgtgctcgcgcccaacgtgccggccatgtacgagatgcacttcgccgtgcccatggccggcgccgtgctcaacaccatcaacacgcgcctcgacgccggcgccgtcgccaccatcctgcgccactccggcgccaagttattcttcgtggactacgactacgtgcgcctcgccagcgacgcgctccgcctcctcgccgccgacggcacgcccgccgtcccgctcgtcgccgtcatcgacgacattgactcgcccacgggggcccggctcggggagctcgagtacgaggctctcgtcgcgcacgccgaccccgacgcggacctcccgccgctcgaagacgagtgggacgcggtcacgctcaactacacctccggcaccacgtccgcgcccaagggcgtcgtctacagccaccgcggggcgtacctgagcaccaccagcctgctgctgcagtggggggtaaccaccgagcccgtctacctctggacgctccctatgttccactgcaacggctggaccttcacctggggcatggcggcgcggggcggcgtcaacgtctgcatccgcgacgcgcgcccagccgacatctaccgcgccatcgcgcgccaccgcgtcacccacatgtgctgcgcgcccgtcgtcttcagcatcctcctcgagggccagggcgccggcgacggcgccgccaggcagctggaggcccccgtccacgtcctcacgggcggcgcgccgccgccggccgctctgctcgagcgcgtcgagcggatcggtttcaaggtcacgcacgcctacggcctcacggaggcgacggggcccgcgctcgcgtgcgagtggcggggccagtgggaccgcctcccgctcccggagcgcgcgcgcctcaaggcgcgccagggggtcagcgtcctgtccctcgccgacgccgacgtcaagaacgccgaaaccatggtcagcgtgccgcgcgacggcaagaccgtcggggagatcgtcctgcgaggcagcagcgtcatgaagggctacctcaataacccggaggcgaacgaaaacgccttcaggggcggctggttcctcaccggcgacgtcggcgtcgtgcaccaggatggatacatcgagatcaaggaccggtccaaggacgtgatcatcagcggcggggagaacatctgcagcaaggaggtggaggaggtgctgttccgccacccggccgtggccgacgcggcggtggtggccatgccgcacccctactggggcgagacgccgtgcgcttttgtcgtgcgcaggaacagcgctgccgagctcagtgaggacgacgtgctcgcgttctgccgcaagcgcatggcgcgcttcatggttcccaagaaggtgcaggtcgtcggagcgctgcctaggaacgcgctcggaaaggtcgagaaggtgaagctccgggaggcggcacggaagctggcgcccaccgtaccggcgcagaagcccaaggggaagacgacaacctcatcgacgacggtcggcggtcgccgcgaggaccagccggtggcgcacgtcatggcggtgtcaaggctataggtagcacaacactacagagcatagctggtgctacatagtctttgccatagttttggagctacttacacgtgccacagctccaagaataagaaggatggcgtagttttcaacatcttttatgtgcagtgatagtgtaggtacggatgaggatcactcgcacacatttgtttttcctacatttttctgtttgtactttgatacttaatactatgtgcacattgtaaaatacatggtgtcaaaacgtcaaggaaataaatttttgtctcg

SEQ ID NO: 4131 - DNA, 1747 bp, Sorghum bicolor
catggaccagctccccaagcgcccggccaactacgtgccgctgagccccgtgggtttcctgccacgcgccaatgccgtctacggcgaccgcgcgtccgtcatctacgggcgcgtccgcttcacctggcgccagacgtaccaccgctgccgccgcctcgcgtccgcgctgctgtccctcggcgtccgcaggggcgacgtcgtctccgtgctcgcgcccaacgtgccggccatgtacgagatgcacttcgccgtgcccatggccggcgccgtgctcaacaccatcaacacgcgcctcgacgccggcgccgtcgccaccatcctgcgccactccggcgccaagttattcttcgtggactacgactacgtgcgcctcgccagcgacgcgctccgcctcctcgccgccgacggcacgcccgccgtcccgctcgtcgccgtcatcgacgacattgactcgcccacgggggcccggctcggggagctcgagtacgaggctctcgtcgcgcacgccgaccccgacgcggacctcccgccgctcgaagacgagtgggacgcggtcacgctcaactacacctccggcaccacgtccgcgcccaagggcgtcgtctacagccaccgcggggcgtacctgagcaccaccagcctgctgctgcagtggggggtaaccaccgagcccgtctacctctggacgctccctatgttccactgcaacggctggaccttcacctggggcatggcggcgcggggcggcgtcaacgtctgcatccgcgacgcgcgcccagccgacatctaccgcgccatcgcgcgccaccgcgtcacccacatgtgctgcgcgcccgtcgtcttcagcatcctcctcgagggccagggcgccggcgacggcgccgccaggcagctggaggcccccgtccacgtcctcacgggcggcgcgccgccgccggccgctctgctcgagcgcgtcgagcggatcggtttcaaggtcacgcacgcctacggcctcacggaggcgacggggcccgcgctcgcgtgcgagtggcggggccagtgggaccgcctcccgctcccggagcgcgcgcgcctcaaggcgcgccagggggtcagcgtcctgtccctcgccgacgccgacgtcaagaacgccgaaaccatggtcagcgtgccgcgcgacggcaagaccgtcggggagatcgtcctgcgaggcagcagcgtcatgaagggctacctcaataacccggaggcgaacgaaaacgccttcaggggcggctggttcctcaccggcgacgtcggcgtcgtgcaccaggatggatacatcgagatcaaggaccggtccaaggacgtgatcatcagcggcggggagaacatctgcagcaaggaggtggaggaggtgctgttccgccacccggccgtggccgacgcggcggtggtggccatgccgcacccctactggggcgagacgccgtgcgcttttgtcgtgcgcaggaacagcgctgccgagctcagtgaggacgacgtgctcgcgttctgccgcaagcgcatggcgcgcttcatggttcccaagaaggtgcaggtcgtcggagcgctgcctaggaacgcgctcggaaaggtcgagaaggtgaagctccgggaggcggcacggaagctggcgcccaccgtaccggcgcagaagcccaaggggaagacgacaacggtcggcggtcgccgcgaggaccagccggtggcgcacgtcatggcggtgtcaaggctataggtagca

SEQ ID NO: 4132 - DNA, 1954 bp, Zea mays
aatacaccaccgctcgatccgctgcgcctcaaccatctcacctcgcctcgcctcgccagtcaccaacacgtacgctaagcaccatggaccagctccccaagcgcccggccaactacgtgccgctgagccccgtggggttccttccccgcgccaatgccgtctacggcgaccgcacgtccgtcatctaccggggcgtccgcttcacctggcgccagacgtacgcgcgctgccgccgcctcgcgtccgcgctgctgtccctcggcgtcgtccgcaggggcgacgtcgtctccgtgctcgcgcccaacgtgcctgccatgtacgagatgcacttcgccgtgcccatggccggcgccgtcctcaacaccatcaacacgcgcctcgacgccgccgccgtcgccaccatcctgcgccactccggggccaagctcttcttcgtcgactacgactacgtgcgcctcgccagcgacgcgctccgcctcctcgacgccgccgacgtcccgctcgtcgccgtcatcgacgacatccactcgcccacgggggcccgcctcggggagctcgagtacgaggcgctgctcgcgcacggcgaccccgacgccgacctcccgccgctccaagacgagtgggacgccgtcacgctcagctacacgtccggcaccacgtccgcgcccaagggcgtcgtctacagccaccgcggcgcgtacctcagcaccaccagcctgctgctgcagtggggggtgcccgccgagcccgtctacctctggacgctccccatgttccactgcaacggctggaccttcacctggggcatggcggcgcgcggcggcgtcaacgtctgcatccgcgacgcgcgccccgccgacatctaccgagccatcgcgcgccaccgcgtcacccacatgtgctgcgcgcccgtcgtcttcagcatcctcctcgacggcgacggcgacagcgacggcgccgccaggcagctccaagcccccgtccacgtcctcaccggcggcgcgccgccgccggccgcgctgctcgagcgcgtcgagcggatcggcttcaacgtcacgcacgcctacggcctcacggaggccacgggccccgcgctcgcgtgcgagtggcgcgaccagtgggaccgcctcccgctcccggagcgcgcgcgcctcaaggcgcgccagggggtcagcgtcctgtccctcgccgacgccgacgtcaagaacgccgacaccatgctcagcgtgccgcgcgacggcaggaccgtcggggagatcgtcctccggggcagcagcgtcatgaagggctacctcaacaacccggaggccaacgagagcgccttcagggccggctggttcctcaccggcgacgtcggcgtcgtgcacccggacggctacatcgagatcaaggaccgctccaaggacgtcatcatcagcggcggggagaacatctgcagcaaggagctggaggaggtgctgttccgccacccggccgtggccgacgccgcggtcgtggccatgccgcacccgcgctggggcgagacgccctgcgctttcgtcgtgcccagggacaaggccgccgtgctcagcgagggcgacgtgctcgccttctgcagcaagcgcatggcgcgcttcatggttcccaagaaggtggaggtcgtcggagcactaccgaggaacgcgcttggaaaggttgagaaggtcaagctccgggaggcggcacgtaagctggcgcccaccgtagcagcggcgcagaagcccaaggcgaagacgacgacggtcggcggtcgccgcgacgggcagccggtggcgcacgtcatggcggtgtcaaggctataggtagcagtggcagcacacagcgcgctccagggcacagctcgtgctacacagtaaacttctttttgccaaaagttttggagctactcacacatatgacatgccaaagctcctataataaggatgccgtacttttc

SEQ ID NO: 4133 - DNA, 1930 bp, Zea mays
tgccactgcccgagcggcctatataaaccaccgatccgccacggccgtgccagcacaccagcccactcgcgccaccacctcacctcgcctccgcgcgcggtcgatcactccaccaccacacacatcctccgtcttgcacgaccagctgcacggtgtagccatggaccagctccccaagcgcccggccaactacgtgccgctgagccccgtggggtttctggcgcgcgccaatgccgtctacgccgaccgcgcgtccgtcgtctacggcggcgtccgcttcacctggcgccagacgtacgagcgctgccgccgcctcgcgtccgcgctgctgtccctcggcgtccgcaggggggacgtcgtctccgtgctcgcgcccaacgtgccggccatgtacgagatgcacttcgccgtgcccatggccggcgccgtgctcaacgccatcaacacgcgcctcgacgccgccgccgtcgccaccatcctgcgccactccggggccaagctcttcttcgtcgactacgactacgtgcgcctcgccggcgacgcgctccgcctgctcgccgccgccgccggcggcaccgtcccgctcgtcgccgtcgtcgacgacatcgactcgcccacgggggcccggctcggggagctcgagtacgaggccctggtcgcgcacggcgaccccgacgccgacctcccgccgctcgccgacgagtgggacgccgtcacgctcaactacacgtccggcaccacgtccgcgcccaagggcgtcgtctacagccaccgcggggcgtacctgagcaccaccagcctgctgctgcagtggggggtggccaccgaccccgtctacctctggacgctccccatgttccactgcaacggctggaccttcacctggggcatggcggcgcgcggcggcgtcaacgtctgcatccgcgacgcgcgccgcgccgacatctaccgcgccatcgcgcgccaccgcgtcacccacatgtgctgcgcgcccgtcgtcttcagcatcctcctcgacggcgacggcgacggcgacggcaggcagctcgaggcccccgtccacgtcctcaccggcggcgcgccgccgccggccgcgctgctggagcgcgtcgagcggatcggattcaaggtcacgcacgcctacggcctcacggaggcgacggggcccgcgctggcgtgcgagtggcgcgaccagtgggaccgcctcccgctcccggagcgcgctcgcctcaaggcgcgacaggggatcagcgtcctgtccctcgccgacgccgacgtcaagaacgtcgacaccatggccagcgtgccgcgcgacggcaagagcctcggcgagatcgtactccggggcagcagcgtcatgaagggctacctcaacaacccggaggcgaacgacggcgccttcaggggcggctggttcctcaccggcgacgtcggcgtcgtgcacccggacgggtacatcgagatcaaggaccggtccaaggacgtgatcatcagcggcggggagaacatctgcagcaaggaggtggaggaggtgctgttccggcacccggccgtggccgacgcggcggtggtcgcgatgccgcacccgcgctggggcgagacgccgtgcgccttcgtcgtgcccagggacggcaaggcccacgggctcagcgaggacgacgtgctcgcgttctgcgccaggcgcatggcgcgcttcatggtccccaagaaggtggaggtcatcggtgcactgccgaggaacgcgctgggaaaggttgagaaggtcaagctccgggaggcggcacgtaagctggcgccaaccgtgccggcgcagataaagccaaaagggaagacgacgacctcaactgtggtcggcggtggtcgctgcgaggagcagccggtgtcgaggttataggtagcaaaacactacagaccataacttgtgttcaac

SEQ ID NO: 4134 - DNA, 1756 bp, Setaria italica
ctctggctgatcgatcgaccatgaaccagctcccgaagcgcccggccaactacgtgccgctgagccccgtcgggttcctgccgcgcgccaatgccgtctacggcgaccgcttgtcggtcatctacggccgcgtccgcttcacctggagcgagacgtaccgccgctgccgcagcttcgcctccgcgctcctcgcgctcggcatccgcaggggcgacgtcgtctccgtgctcgcgcccaacgtcccggccatgtacgagatgcacttcgccgtgcccatggccggcgcggtgctcaacaccatcaacacccgcctcgacgccaacgccgtcgccaccatcctgcgccactccgaggccaagctcttcttcgtcgactacgactgcgtgcgcctcgccggcgacgcgctccgcctcctcgccgccgaagccggcaggcatgtcccgctcgtcgccgtcatcgacgacatcgacgcgcccaccggggtccgactcggcgagctcgagtacgagggcctggtcgcgcacggtgacgcggaagccgagctcccgccgctcgccgacgagtgggacgccgtcacgctcaactacacgtccggcaccacgtcggcgcccaagggggtcgtttacagccaccgcggcgcgtacctgagcaccaccagcctgctgctgcagtggggggtgggcaccgagcccgtctacctgtggacgctccccatgttccactgcaacggctggaccttcacgtggggcatggcggcgcgcggcggcgtcaacgtctgcatccgcgacgcgcgcgccgcggacatctaccgcgccatcgcgcgccaccgcgtcacccacatgtgctgcgcgcccgtcgtcttcagcatccttctcgagggcgacgacgccaccagcagcaagcggcagctcgaggccccggtccacgtcctcaccggcggcgccccgccgccggccgcgctgctggagcgcgtcgagcggatcggcttccgcgtcacgcacgcctacggcctcacggaggcgacggggcccgcgctcgcgtgccagtgggaccgcctgccgctcccggagcgcgcgcgcctcaaggcgcgccagggggtcagcgtcctgtccctcgccgacgccgacgtcaagaacgccgacacccagcgtgccgcgcgacgggaagaccttgggggagatcgtgctccgcggcagcagcgtcatgaagggctacctcaacaaccccaaggccaacgaggaggccttcaggggcggctggttcctgacgggcgacgtcggcgtcgtgcacgaggacgggtacatcgagatcaaggacaggtccaaggacgtgatcattagcgggggagaaaacatttgcagtaaggaggtggaggaggtgctgttccggcacccggccgtggcggacgcggcggtggtcgccatgccgcacccgcgctggggcgagacgccgtgcgccttcgtcgtggccagggacaaggccgcccgcgtctctgaggacgatgtgctcgcgtctgcagcaagcgcatggcgcgcttcatggtgcctaagaaggtggtggtcatggaagccctacccagaaatggactcggaaaggtcgagaaggtcaagctccgggaggtggcacgtaaactggcgccaacagtgacggcgcagaagcccaaggggaagacgacgacggtcggcgggcgccgcgacgagcagcaggtggcgcacgtcatggccgtctcgaggctatagcccaacactgcgcgcgg

SEQ ID NO: 4135 - DNA, 2152 bp, Oryza sativa
tcacctcgatcatatcatccataatccttcaagctcttgttggctttgcttaattgcagctgccactagctttgttaggatcaatcacatccatctacgtgtgtagagcgtcgtgacagagagttttgtgatggagcagcttcccaagcgcccggcgaactacgtgccactgagccctgtggggttcctgccgcgcgccaatgccgtctacggcgaccgcacctccgtcatctacggccgcgtccgcttcacctggagccagacctacgcccgctgccgccgcctcgcctcctccctcctctccctcggcgtccgcaaccacgacgtcgtgtcggttttggcgccgaacgtgccggcaatgtacgagatgcacttcgcggtgccgatggccggggcggtgctcaacaccatcaacacgcggctcgacgcgagggcggtggcgggcatcctgcggcactccgaggccaaggtgttcttcgtcgactaccagtacgtgcgcctcgccagcgacgcgctccagatcgtcgccgacgaggggaggcacgtcccgctcgtcgccgtcatcgacgacattgacgtgcccaccggcgtccgcctcggcgagctcgagtacgaggggctggtcgcccgtggcgaccccgccgccgagctgcccagcctcgccgacgagtgggacgccgtcacgctcaactacacgtcgggcaccacgtcggcgcccaagggcgtggtgtacagccaccgcggcgcgtacctgagcaccatgagcttgctcatgtcgtgggtcgtcggcgacgagccggtgtacctgtggacgctgcccatgttccactgcaacgggtggaccttcacctggggcatggcagcgcgcggcggcgtcaacgtctgcatccgcgacgcgcgcgccgcggacatctaccgcgccatcgcgcgccacggcgtcacccacctgtgctgcgcgccggtggtgttcaacatcctgctcgagggcggcgaggcggcggcgaagcagctcgcggccccggtccacgtgctcaccggcggggcgccaccgccggccgccctcctcgagcgcgtcgagcggatcggcttccgcgtgacgcacgcgtacgggctcaccgaggccaccggcccggcgctggcgtgcgagtggcgcgcgcagtgggaccgcctgccgctgccggagcgcgcgcggctcaagtcccggcagggcgtcagcgtcctgtccctcgccgacgccgacgtcaaggacgccaagacgatggcgagagtgccgcgcgacggcaagaccgtcggcgagatcgtgctccgcggcagcagcatcatgaagggctacctcaacaacccggaggcgaacagcgacgccttcaagggcgagtggttcctgaccggcgacgtcggcgtcgtgcacgccgacggctacatcgagatcaaggacaggtccaaggacgtgatcatcagcggcggcgagaacatctgcagcaaggaggtggaggaggtgctgttccagcaccccgccgtcgccgacgcggcggtggtcgccatgccgcacccgcactggggcgagacgccgtgcgcgttcgtcgtggcgagggacaaggcggccggggtgtgcgaggacgacgtcgtcgcgttctgccgcaagcacatggcgcggttcatggtgcccaagaaggtggtcgtctacgacgccatcccgaggaacggcaacggcaaggtcgagaagaacttgctccgggaggcggccaagaagctggcgccggcggccgtgccggcgcagaagacgaaggtgaagacgacgacgacgacggtcggcggccgccgcggcgagcacccggtggcgcatgtcatggccgtgtcaaggctttagggcaatcaccaaaatgtcaccaatctttatcggtgaaccggtgatatcaccttttgcacgtaggaatttggcactacgcctgccaaaaatttacaaaaaataagcatggcgtgtgtttggaagagttttggtctgtccaggtgtaagagcgaacttggtgtattgctgggcagtgaccactccggtgtacttttttttaacctccttttttgtttgttcagatttcgcacttgtgtacattgtaaaataacagtgttgaaatgtggaggaagttgttcttctcaa

SEQ ID NO: 4136 - DNA, 756 bp, Panicum virgatum
acactcgctagctagctaagctgctatataaattaaattaaagctagcagcgcgcggcaagtagtactgatcgatcggcatcgccggccggagatcgacatgacgatgatgaagaagcagcagcaagctgtggtgctgctgctgctgctgctgctggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatcactacatgcatgcgtgtatctatacatacatacatatatatgatcgctcgctcgatcgatcgatcttagtcgtctacgtgtggcttgctgctgttcatccagctgctcgctacgtgtgtgtgtacacacacacacacgacggataaataaaagatgcatgggttgcctccgggccgctccctatatagctactttgttgtgtactactagtatcaatcaatcctactttctgatgtcttcactacatgtgaaaagctgataatcttatagctgtagctactccatgtaataattttgttgcattatcgaaagtgtatgtctgaagc

SEQ ID NO: 4137 - DNA, 746 bp, Panicum virgatum
acactcgctagctagctaagctgctatataaattaaattaaagctagtagtactgatcgatcggcatcgccggccggagatcgacatgacgacgatgatgaagaagcagcagcaagctgtggtgctgctgctgctgctgctgctggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagctagctagcttatctgtatctatacatacatacatatatatgatcgctcgctcgctcgatcgatcttagtcgtctacgtgtggcttgctgctgttcatccagccgctcgctacgtgtgtgtgtgcgcgtatacacacacacacgacggataaataaaagatgcatgggttgcctccggaccgctccctatatagctactttgttgtgtactactagtatcaatcaatcctactttctgatgtcttcactacatgtgaaaagctgataatcttatagctgtacctactccatgtaataattttgttgcattatcgaaagtgtatgtctgaagcc

SEQ ID NO: 4138 - DNA, 781 bp, Panicum virgatum
ccacgcgtccgacactcgctagctagctaagctgctatataaattaaattaaagctagcagcgcgcggcaagtagtactgatcgatcggcatcgccggccggagatcgacatgacgatgatgaagaagcagcagcaagctgtggtgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggagcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagctagcttatctgtatctatacatacatacatacatatgatcgctcgatcgatcttagtcgtctacgtgtggctcgctgctgttcatccagccgctcgctacgtgtgtatatatacacacacacacgacggataaataaaagatgcatgggttgcctccggaccgctccctatatagctactttgttgtgtactactagtatcaatcaatcctactttctgatgtcttcactacatgtgaaaagctgataatcttatagctgtagctactccatgtaataattttgttgcattatcgaaagtgtatgtctgaagccatgaatgtgtcgtcaaaattataagagaacatat

SEQ ID NO: 4139 - DNA, 741 bp, Panicum virgatum
acactcgctagctagctaagctgctatataaattaaattaaagctagcagcgcgcggcaagtagtactgatcgatcggcatcgccggccggagatcgacatgacgatgatgaagaagcagcagcaagctgtggtgctgctgctgctgctgctggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatctgtatctatacatacatgcatacatacatacatacatatatatgatcgctcgctcgctcgctcgatcttagtcgtctacgtgtggcttgctgctgttcatccagccgctcgctacgtgtgtgtgtatatagacacacacacgcgacggataaataaaagatgcatgggttgcctccgggccgctccctatatagctactttgttgtgtattactagtatcaatcaatcctactttctgatgtcttcactacatgtgaaaagctgataatcttatagatgtacctactccatgtaataattttgttgcatta

SEQ ID NO: 4140 - DNA, 3215 bp, Oryza sativa
ctcctcctccccaccccgcatcactcgccgccgctcctaaacccctcgaagagaaccccctcctcccctcgcgccaccgccgcccgcatccgcgccgtcaccgggagggagagcagcagcggcggaagcaggagcagctcgcgcgagagagggaggaagccatgggaggcggcaggaagcgcgggcgcacgcagcgccgccacttcaagcaggggcgggagaacgtctggaagcacaacccgcagcgccccccggcggctggcggcgaaggagccgaaggaggcgctgccgaggggcgcgaagggaacccctcgtggcagcccttcgccaccgagaacccagccttcgaggactactacaaggcacagcaaattattccggagggagagtgggacgacttcatgaacatgctccggaaaccgctgccagccactttcaggattaatgcgagctgtcaattttatcaagatatttgctcacagttagaaaatgacttcaggaagtcattggaaactgaggttagtgatgagcatgaagaagatgctattcggcctttgccttggtaccctggcaatcttgcatggcatttgaatttttctcgaatgcagctgaggagaaaccaggcacttgagggttttcatgaattcttgaagcgagagaatgaagttggcaatataactaggcaagaggctgtcagcatggttcctcctttgtttctgaatgtgcaacctgatcatcatattcttgacatgtgcgctgctccaggatcaaagaccttccagttacttgagatgatccatcagtctacaaagcctggaatgcttccaaatgcccttgtggtagctaatgatgttgatgtgcaaagatgcaatcttcttattcatcagacaaagagaatgtgcacagccaacttgattgtgacgaatcatgaagcacagaactttcctggctgtaatcttgcaaagtttagttcagaaacatgcacggatgagtccaaactgcagaggttggaatttgatcgtgtattgtgtgatgtgccttgtagtggtgatggaactgtgcgtaaagctcctgatatgtggagaaagtggaatgctggtatggggaatggactccatcgtctccaagtagaaattgcaatgcgcggtattggtttgcttaaagtgggtggaaggattgtttactcaacatgttcaatgaatcctgttgaaaatgaagcagttgtcgcggagattctacggagatgtggggattctgttgaacttcttgatgtttctaatgagctacctgaattagtcaggcgtcctggacttagcacctggaaggtacgggatagagggtcttggtttggcactcacgaagatgtccctcgctacagaaagaacgtgatatcaccaagcatgtttccttcagggaagggcaccatggatagccatgtggctattggcagtgttgagatcaacacagatgtaattgatgctgatatgaaagattcaacaaacatggtagagggagaacaagaaacgaaaacagcatctgatgatgtcaataatggtggtgatcccaatactgaagagacgagcaaacttgagtctaatgaagttccaaacgactctgataaaaagtcaaattctacgtctatccgcacagaacattcaaatttccctctgcatcgctgcatgagaattgttccgcatgatcaaaacagtggggcattttttattgcagtccttcagaaaatctcccctattaatgggaaccaagaggcagaacttataaaaggcgagcacaatatttcaaaggatagggctgagaaacttgagaaaggtctcggatcagataaggtgccacataaagaaaataccgtgcagcagcaaggagttgatgatggtaatgttatggatgaacagcaaaatggagatgtggataatgaaacatcaaatggtaaaagctcagaggaagctaaagtaattgttaatgaggcagaaaatgatcaagcaggaccaagagataggaggaggaagccacagaaccaaggaaggtggagaggggttgatccagtgatatttttcaaagatgaagctacaataagaagtatagtatctttctatggtatcaaggatacatttccgcttgagggtcaccttgtgactaggaatcctgatgctggccatgttaaaagaatatactacgtgtcaaaatcagtgcaagaagttttggagctcaatgtaaaagttggtgagcggcttaagattacctcacttggcctaaagatatttgaaagacagtcatcaaaggatggctcaccatgcacatttaggttgtcttcagagggtttaccactgctgcttccatacatcaccaaacagattctctacgcttctgcaattgacttccagcaccttttacaatacagaactattaaatttcctgattttgtggatgcaaaattcggtgaagaagcttcagctttgttgcctggttgctgtgttgtagtactttgggaagggcatcagaacatagattccatcgccatggatccttctgcaatcgccattgtttgctggaaagggaagaccaatttgtgcgtcatggtttctcccctggatgggaaggagctgcttgagaggatttgtttacgttatgggctcaaaatccccaaagcggatgatgtaaaacccagcatgaagattgatggatcagacgagcagcctgatctcagcactgaggcagttgatccagaagctgtgcccgaaagcaaagcatctgacatggagattgcagatgctaaagaggtggagtaatcctgctgaatgctgatgctatccaaggccacatattatagctggatacaacatcgccccatcatttgcctaccggtattagttgagcgatgagccgccatttttcattgattctggcatttacgccgttttcctgtttgatttatcatattctgtttctgaagaatgggtgaatgaactcgcccattagtgaaagggcaccacgttgctctaaagcccatctgtccatgtcatctggtaatcgtgcacgtattgccccctccatacttccggctggctcatccacctgtaacctatcagtatcagcttatttttcttcgaagagaatgtattacagggagtcttaacctgaactcttgaacctgataaattttgatatgacaatatttcagacacatcctcttgactaaa

SEQ ID NO: 4141 - DNA, 849 bp, Saccharum officinarum
ccgacgggaagcctgctgccgagtgccgacccaggcctcccctccctttccttctataaatcccggtcctccccagctggctctgcagcgatccaatccagcctcgccgtctcaccccagcattgccttccattctcttccacctccatctcgccgccgcccgaatccccctcaatcccccatggggtcgcaggccatcgaggcgcaccgcgcgggcgcggaggtgtacagcggcgcggcgctgtgcgcggagaagtcgacggagctgctgtccgaggtgcacctcccgctgggcctgctgccgctggccgacatggaggaggtgggctacaaccgcgccacgggcttcgtgtggctgcgccagaagaaggcgctcacgcacacgttccgccagatcggccgccaggtctcgtacgccgccgaggtcaccgccttcgtcgaggaccggaggatgaagcgcatgaccggggtcaagaccaaggagctcctcatctgggtcaccctctccgacatgttcatcgacaaggacgacgaggccaagatcaccttcaagacgcccaccggcctcggcaggaccttccccgtctccgccttcgccaaggaaggcgccggcgcagacgccggcgccgcggcggccaagcccaaggacgcccccgcccccgtcgccgccggtaaggctgctgccagcaagtgaggtggcgccggcggcgtccggagcttttacttgtggttgtactctccgtactgtagtagccgtaattgctaataaagacctgttctgtttcctgaataatgatggtttgtacttgtacgcctgctacctgcttaaaaaatttagtgtgttttatg

SEQ ID NO: 4142 - DNA, 814 bp, Setaria italica
ccgacctccagcattccccgccacctcgccggaatccccagcccgcccagactcgcctgatctcgcccggcctcgatccaaatccacccatggggtcgcaggccatcgaggagcaccgcgcgggggcggaggtgtaccacggcgcggcgctgtgcgcggagaaatccacggagctgctctcggaggtgcacctcccgctgggcctgctcccgctcgccgacatggaggaggtcggctacaaccggtccacgggcttcgtctggctccgccagaagaaggccctcacccacaccttcaagcagatcgggcgccaggtctcgtacgcgtccgaggtcaccgccttcgtcgaggaccgacggatgaagcgcatgacgggggtcaagaccaaggagctcctcatctgggtcaccctctccgacatgttcctcgacaaggacgacccctccaagatcaccttcaagacccccaccgggctcggcaggacataccccgcctccgccttcgccaaggagggtggcgacgacggcggcaagcccgtgggcaaggaggcacccgccgcggcagccaacgggggcaacgaggccgccgccgccgtcagcggtaagtgaggtggcgccgtcgagtggagtggagtgcttttatcgtggttaactgcctgctttttactactactgctggccgtaattgctatgctatacgactgttcttctgaataatgaagtctgtactgctgcttgcttaatttatgtgttctatttatttatgaatgaaatggtaatcaatcgtgtgaaccttgcaattgtgttacgacgtg

SEQ ID NO: 4143 - DNA, 859 bp, Pennisetum glaucum
gcgccgtggtacacctccgcgccggcgccgtgctcctcgatgacccacaaccacaaccccagcgttcgccgccacacctcgccggaatcccccagcccgcccggcccgctcgtactcgcctcctcatcccacacccggcggcctcgatccaatccaaacccatggggtcgcaggccatcgaggagcaccgcgccggcgcggaggtgtaccacggcgcggcgctctgcgccgagaagtccacccagctgctctcggaggtgcacctcccgctcggcctcctcccgctcgccgacatggaggaggtcgggtacaaccggtccacgggcttcgtctggctccgccagaagaaggcactcacccacaccttcaagcagatcgggcgccaggtctcgtacgccgccgaggtcaccgccttcgtcgaggaccgccggatgaagcgcatgaccggggtcaagaccaaggagctcctcatctgggtcaccctctccgacatgttcctcgacaaggacgaccattccaagatcaccttcaagacacccaccgggctcggcaggacgtaccctgtcagcgccttcgagaaggaggaaggggagggtggcggcgacaaggaggagcccgccgtcgccaaggaggcaccggccgcagcagcagccaactaggccgccgccgccgtcagcggtaagtgaggtggcgccgtcgagtgcgtttatcgtggttaaaactgcctgcttttttacttctactgctgctcctggctgtaattgctgtgctatatacgactgttcttctaccgaataatgcagcagcaggctgctgctgcttgcttattaatgctttctatttatttctgaatgaaatg

SEQ ID NO: 4144 - DNA, 1332 bp, Zea mays
cgcttgatctaggtctcgtctagacgaaaagactcatcttctctggtactctggttgcggcagaacggtcggatctcccccaccgatggccgcctcccagtcagccacgctcctccttctcgccgtcgtcctcgccgccgtcgcaccaggcccctccagcgcgcgccacgtcatcaatttcgccccttcccgcgccgtcaaccccgcgtccctcgcttgggaccctacggcgcagcacttcgtcgtcgcaggcggcggtgatgccgtcctttgcgtctccgacgctggggtcaccgagtcgatcgtctcctctggcgcctcctccgtcgccgtcgacgaccgccgacgccgcctgctcgtcgcttccccgggatccgtctccgccttcgacctccggtccccgcgcccgcaccgcctcatcctctccacgccggtcccggaccccgcccctccgggcggcatcgctgttgacccgcacacagggaacgcgttcctcaccgtgggcgcccgaatctacaagctgtccgtagagggcgacctcgccacgctcgccaccgcgccggcgctcggctcggagcccctagcctcgctcaccgcgcacgtgagccgaggcttcctgctcgtgggccagcccggcacgggcagcatcctccgcgtcgacatggaggacggcgccacgaggaccgtgtcctgcgccctcacgcccccgacgccgatggccgtggcggtccggaccgatggggcggtggcggtgggcggggccgcggggctgcgcctcgtcgtgagcaacgacgggtgggcgtcgtgcggggtgcgggacgaggctgcgcccgcgcccgacggtctcgtggccgcggtggcggtgcgggagcggcgacgggtgtacgcgctggtggaggcggaggcggtgaacggggttaacaagtggcagatcgaggaggcctcgtggaaatcggagtcggagggggagatggtggtggtgctcgtctttgtcggcgtcgcccttgccatcttcatgttctggaggttccagatgcggcagctggccggcaacatgaacaagaagatcagatagtagtaacaacgcaatgtctccttccttctttatgcaagtgcgtttgtcatgctgccgtagttggtgtagctagatacttgtggattaggcacgttacttgtatctatatatttatgagatcttagttggatagttcttgataagtgaaggcaaaaatcaggagaaccattgctcctcgttagccactgtacctgcaaatttacacaaatatcgtaccttacaggtttgttcttacggcgaattgcacttgattcagt

SEQ ID NO: 4145 - DNA, 2045 bp, Zea mays
tttgtaatcctttttttcgatgcaaatattttgagtggcattattgtgaagcacaatgtttagagttctaaatatacaattatctcttatttgtcagagtatatctaaatatacaattatcttttatttatcagagtatattagacaatttttgatatggttgatttagaatggattggatgaccttccttatctccaaaccatattcctaatatattaatcccaaaaactcaatacaatacatcccaccctgcacgtattaaacacaatatatctcctttctacactattttcgttttgccctcgccgcgggttgtatactataggctcgagatctctatacgctctagacgaaatcgtcttcgtcttcctccaattgcagacgaacagtgggatatccccttaccaatggccttccaccccgccacgctgttcctcctccttgtcctcgccgccgtcgcgccgatcccctccaacgcgcgccacatcattactttcgccccctcacgcgcggtcaatcccgcgtccctcgcttgggaccctacggcgcagcactttgtcgtcgccggcggcggcgatgccgtcctttccgtctcagacgctggggtaaccgaatcgatcgtctcctctggcgcctcttgcgtcgccgtcgacgaccggcgacgccgcctcctcgtcgcttccccgggatccgtctccgcgttcgatctccgctccccgcggccgcaccgcctcatcctctcgacgcctgttgcggaccccgcccctccgggcggcatcgctgtggacccgcacaccgggaacgccttcctcactgtgggcgctcgaatctacaagctatccgtagagggcgagctcgccacgctcgcatccgcgccggcgctcggctccgtgcccctagcctcgctcaccgcacacgtgagccgaggcttcctgctcgtgggccagcccagctcgggcagcgtcctccgcgtggacatggaggacggcgccacgaggaccgtgtcctgcgccctcacgccgaccgccgtggcggtccggaccgatggggcggtggcggtgggcggggccgcggggctgcgcctcgtcgtgagcaacgacgggtgggcttcgtgcggggtgcgggacgaggccgcgcccgcgcccgacggccccgtggccgcggtggcggtgcgggagcggcgacgggtgtacgcgctggttggggcggcggcgatggacgggggcaacaagtggcggatcgaggaggcctcgtggaaatcggagtcggaaggggagatggtggtggtgctcgtcttcgttggcgttgccctcaccatcttcatgttctggaggttccagatgcggcagctcgccggcaacatgaacaagaagatcagatagtagtaccaaatgcataacttgccttgtagtcaattgcttttctcatgccgtagttggtgtagcctcctgtggattagacacgttacttatattctatgtatgatatgaattatgagtcgtttgtaatatccgctgaaaatttgtgtatttctgcttgagccaaatttgtgtatttctgcttgagccgtacgagatgaaattttcatatacggtttgaagaacgtcttgcaattcaggcaattgcggatgatataactagtaaatatattcctcctcatgtcaacatattttattgtttagggagaattacacttacaagtcgttaccggttttgctatgactttttacgaccgaccgttacagaggttttttcctccgttcaatattataatgatggaggccaactttggttggttaatctgatcggttcatcgatggtcagcaagtatgatgattctaatgatgatcttgcacgtatttcgtgtgtatctcacaggtaaaccccgtgaattaacttgggtcacgagcgtggttttagttgtattgactgcatcatttggtgtaactggttattctttgccttgggatcaaattggttattgggcagtcaaaattgttacatgtgtatccgaagctattccggtaatagggtccctttaggc

SEQ ID NO: 4146 - DNA, 1275 bp, Panicum virgatum
  misc_feature (833)..(833): n is a, c, g, or t
  misc_feature (877)..(877): n is a, c, g, or t
  misc_feature (885)..(885): n is a, c, g, or t
caaattgtcttctcccaaatctccggttccggccgatcgaacgaatctcgccaccatggccgcctcccacctacccacgctcctcctcgtcctcgtcctcgccgccgtcgcgccgttaccctccagcgcgcgccacatcatcaccttcgccccggcccgcggcgtcggccccgcgtccctcgcatgggaccccacggcgcagcacttcgtcgtcgccggcggcggcgacgccatcctctccgtctccgacgccggggtcaccgagtcgatcatctcctccggcgcctcagccgtcgccgtcgacgaccgccgccgccgcctactcgtggcgtccccggggtccgtctccgccttcgacctccgctccccgcgcccgcaccgcctcatcctctccaccccggttccggacaccgccccgccgggcggcatcgccgtggacccgcacacgggtagcgccttcctcaccgtgggcgcccgaatctacaagctgtccctcgacggcgacctcgcccgctctcctcgcgccggcgctcgggtccgagcccctggcctcgctcaccgcgcacgtgagccgcgggttcctgctcgtgggccagcccagcacgggcagcctcctccgcgtcgacatggaggacggcgccacgaggaccgtgtcgggcgtcctcacgccacccacgccggtcgccgttgcggtccggaccgacggggcggtcgcggtgggcggggccgcggggctgcgcctcatcgtgagcaacgacgggtgggcgtcgtgcggggtgcgggacgaggcgctgcccgcgcccgacggccccgtggccgcggtggccgtgcgngagcggcggcgggtgtacgcgctggtggaggcggggaccacggncggggggnaggagtggcggatcgaggaggcggcgtggaaatcggagtcggaaggggagatggtggtggggctcgtcttcgttggcgtcgccttagccatcttcatgttctggaggttccagatgcgccagctcgccagcaacatgaacaagaagatcagatagtaacaatgcaaagcctccttgctttgtttttgaagaatctgtaatcatttgcttttgttatgcattagttggtagattggtccaggtagatacttgtgagttaggcacttcacttatctgtgatctttcttggttagttcttggtctaagttgagacaaaattcaggagcaccaatgcgaattgtacttgcaaatttacgcattgtaatagaaaaagccgcaccacagttttgtt

SEQ ID NO: 4147 - DNA, 2392 bp, Sorghum bicolor
aaaacccttgcggcggctacctttcccccacccccctctcgcctcgcggccgccgcaggcgaaccccccctcgtcgcctcgcgccgtgctgtccaccgccgaatcctccccaggtcagaggaggggtgggtatctgttgtttcagctgagttatcgggggactggttgtgggcggagatgttggtgctcttcgagacccccgcggggttcgccctgttcaaggtactcgacgaggggaagctcgacaaagtcgaggatctatggaaggagttcacgacgtcggattcagcgagaaaggtggttgagctgaaggctttcaacaagtttgagaacacatctgatgccctatccgcggcaaccctgattattgatagcaagcctagcaagggtctgcgcaagttcttgcagaaacattgtgagggtgaaacattggcagttgctgattctaagcttggaaatgctataaaagaaaagctgaaaattgactgccttcacaatagtgctgtgatggagctgatgagagggctgagaaatcagctcaccgagcttataactgggttgggtgcacaagaccttggtccaatgagcttgggattgtcccacagcttgtctaggtataagctgaagttcagtcccgagaaggttgataccatgatcattcaagccattggattattggatgatcttgacaaggagcttaacacttacgccatgagagttcgtgaatggtatggctggcactttccagaactcaccaaaatagttacagataatatacagtatgccaaagttgtgaagatgatgggcaacagaactaatgcagtcgaccttgacttttctgagatattgtcagatgaagagatagaaacacagctaaaggaggcagcagtaatatccatgggaacagaagttagtgaccttgacttgtcaaatatcaaagagctatgtgatcaagtgttggccctttctgagtacagagcccagctgtatgactatttaaaaagcaggatgaacaccatagcaccaaatctgacagcactggtgggcgaattagttggtgctcgccttattgcgcatggtggaagtttgctaaatttggctaagcagcctggtagcacaattcagatactcggtgcagagaaggctttattcagagctctaaagacaaagcattctacaccaaagtatggcctcatctaccatgcatccttaattgggaaggcttctcaaaagcacaagggaaaaatctctcgttctcttgctgcaaaaactgctctggccatccgatatgatgcccttggtgatggtgaggacaactccattggcactgagagtcgactcaagcttgagacacggcttcaagttcttgagaatagagaacttgggaaatctgctggttctataaaggggaagcccaagatagaagtgtatgaaaaggaccggaagaagggtgctggggctttaacaactcctgctaagacatacaaccctgcagctgatctggtacttaccgaagaaacaccaaagaagtccgaattggcttcaaagaagaggaaacatcatgaggtgaaaactgaaccatcagcagtgcctgcagaggaagcaattcaagaggatggtgaccaggaggatcggaagaagaagaagaaaaagaagtccaaggaaagcgaggaggctcctgctgttgaaggtgatggtgagaagaaaaagaaaaagaagtccaaggaggcccaggaagagcctgccgtggctgctgcctcagaaggtgagaagaagaagaagaaaaagaagtctgatgccgatggtgaggatgttgcaatgcaaaccgaagagtctggtaagaaagataagaagaaaaagaagaaaaagcatgctgatgatgagtgaggcattcaccggtagagaatgtacgggtaccaaaggctgggccgtagctgttctgtaaaatggttatcacggaggttagaaaccatattgagatcagcttctttttttggggggggacccggcttgtattcaagtacttgcttgatctggaggatgatggaatttaaattttgatgttgcaacttcataaattagtatgatgattgttcatggtaactgtgcagctgagagacctttcatgctgacctgaacgtgttttcgtaattcctagtgtaatgttgtagagatgcaacatgcaaatcttttatgtacccctgcagtcctggggaggtctaatgcctgctcaaaactggcagacacaaatacagtggctgataatttagcaaaaaagcaaggttttgattctttgttcttgcatgttctattgtgagtcttggacccattctagaaactatactgttcagatggctcggaaaactttcaatgggggtttccccatctatat

SEQ ID NO: 4148 - DNA, 2022 bp, Pennisetum glaucum
gcggcgggcggcggctatactcccctttccccacccgtcccctctcgcctctccggccgccgccgcaggcgaaaacccttttctgctgccctcaccagtcaccaccgccggatctccgcaggttacggtgataatcgcggtttactgattctaggaggatatgttggtgctattcgagacccccgcggggttcgccctcttcaaggtgcttgacgaggggaagctcgacaaggtcgaggatctgtggaaggagttcacgacatccgactcggcgagaaaggtggttgagcttaaggctttcaacaagtttgagaacacatctgatgctctgtctgccgcaaccctgattattgatagcaagcctagcaaaggtctgcgcaagttcttacagaagcactgtgagggtgaaacattaggtgttgctgattccaagcttggaaatgctataaaggaaaagctgaaaattgactgcattcacaatagtgctgtgatggaactgatgagagggctgaggaatcagctcactgagcttataactgggctgggagcacaagaacttggtccgatgagcttgggactgtcccacagcctgtctaggtataagctgaagttcagtcctgagaaggttgataccatgatcattcaggccattggcttattggatgatcttgacaaagagcttaacacttatgctatgagggtgcgtgaatggtatggttggcactttcctgagctcactaaaatagtcacagataacatacagtatgcaaaagttgtgaagatgatgggcaacagagctaatgcagtcaatcttgatttctctgagatactgtcagatgaagaggtagaagcacagataaaggaggcagcagtaatatccatgggaacggaagttaatgaccttgacctgttaaatatcagagagctatgtgatcaagtgttggctctttctgagtacagaggccaactgtttgactatttaaaaagcaggatgaacactattgcacccaatctgaccgcactggtgggtgaattagttggtgcccgccttatcgcgcatggtggcagtttggtaaatttagccaagcagcccggtagcacaatccagatactcggtgcagagaaggctttgttcagagctctaaagacgaagcattctacacctaagtatggcctcatctaccatgcatctttaattggcaaggcatctcaaaagcacaagggaaagatctctcgttctcttgctgcaaaaactgctctggccatccggtgtgatgcccttggtgatggtgaggacaactctattggtgttgagagtcgactcaagcttgagacacggcttcaagttctcgagaacaaagaatttgggaaatctgccggttccacaaaggggaagcccaagatagaagtgtatgagaaggatcgaaagaagggagctggggctttaattactcctgctaagacatacaaccctgctgctgatgtcgtactaggacaatctactgaagaaacaccaaagaagtcagatgtggcttcaaagaagaggaaacatcacgatgcagaggttgcaccgacaacagaacctgcagtggaagcaatccaggaggatggtgaccatgagaggaagaaaaagaagaagaagaaggacaaggagaccgaggtgactccagcggccaatgctgatggtgagaagaaaaagaaaaagaagtccaaggagagcgaggagcctgctgtggctgctgcagaaggtgagaagaaaaagaagaaatcagatgctgatggtgaggatgttgcaatgcagactgaagagtctggtaagaaagacaaaaagaaaaagaagaagaagcatgccgatgatgagtgagacattcagagcccagggttgggacttgctgttctgtaaaatggataatgccggctagtaaccttgttgagaatagtttttttttgaacttggttttcaatgtacttgcccgatctggacgattgatgaaatttccaattttgccgccgcagtctcaa

SEQ ID NO: 4149 - DNA, 2132 bp, Panicum virgatum
gcggcggctacctctcctttccccacccgcccgccccctctccgtctcgccggccgacgcaggccaaacccctcttcgcctcgccctctccaacgcccaatctcccccaggtcaagggcgggggcttatttggtttgtttcagcggagatagtcgggtgctaccgagatgttggtgctgttcgagacccccgcggggttcgccctcttcaaggtgctcgacgaggggaagctcgacaaggtcgatgatctatggaaggagttcacgacatcggactcggcaagaagggtggttgagctgaaggctttcaacaagtttgagaacacatctgatgctctctctgctgcgaccctaattattgatagcaagccaagcaagggtctgcgcaagttcttgcagaagcactgcgagggtgaaacattagctgttgctgattctaagcttggaaatgctataaaggaaaagctgaaaattgactgtgtgcacaacagtgctgtgatggagctgatgagagggctgagaaatcagctcactgagcttataactgggttgggtgcacaagaccttggtccgatgagcttgggactgtcccacagcctgtctaggtacaagctgaagttcagtcctgagaaggttgataccatgatcattcaggccattggcttattggatgatcttgacaaagagcttaacacttatgccatgagggtccgtgaatggtatggttggcactttccagagctcactaaaatagtcacagataatatacagtatgcaaaagttgtgaagatgatgggtaacagagctaatgcagtcaagattgatttctctgagatactgtcagatgaagaggtagaaacacagctaaaggaggcagcagtaatatccatgggaactgaagttagcgaccttgacttgttaaatatcagagagctatgcgatcaagtgttggctctttctgagtatagagcgcagctgtatgactatctaaaaagtaggatgaacactattgcgccaaatctgaccgcactggtgggtgaattagttggtgctcgtcttattgcgcatggtggcagtttgctaaatttagccaagcaacctggcagcacaattcagatacttggtgcagagaaaggctttattcagagctctaaagacgaagcattctacacctaagtacggcctcatctaccatgcatccttaattggcaaggcttctcaaaagcacaagggaaagatctctcgttctctcgccgcgaaaactgctcttgccatccggtatgatgcccttggtgatggtgaggacaactctattggcacggagagtcgactcaagcttgagacccggcttcaagttcttgagaaaacagaatttgggaaatctgccggttccgcaaagggaaagcccaagatagaagcgtatgaaaaggacaggaagaagggtgctggggcattaattactcctgctaagacatacaacgctgctgcggatgttgtactaggacaatccactgaagagacaccaaagaagtcagaattggcttcgaagaagaggaaacatcatgatgcggaggctgcactgccaacaaagcctgcggcagaagcaaacgaggatggtgaccaggaaaggaagaaaaagaagaagaagaagtccaaggaaactgagactcctgcggctgatgctgatggtgagaagaaaaagaaaaagaagtctaaggagagcgaggaggagcctgctgtggccactgcagaaggcgagaagaagaagaaaaagaagaaatctggtgcggatggtgaggatgttgcgatgcaaaccgaggagtccggcaagaaagataagaagaaaaagaagaaaaagcacgctgatgatgagtgaggtattttattggtaagggagagccaagaagacgaaggttgggactccctgttttgtagaatggatattacaaaggctagtaaccatgttgagattagtttttttttggaacctagcgtgtattcaagtacttgccagatcaagacgattgatgaaaaattgaacctttgcggtcgcagccacataaatcaccgttactgttcaccctttctgaacagaggttgctaactaagcagctgagagatcctttcatgctc

SEQ ID NO: 4150 - DNA, 2230 bp, Oryza sativa
aacccttgcggcgccggctctctccctctcccctctcccccgcctcgccgcagccgaactcctcgcgctaaaccctcgccgcggcggcggcggcggcggtgccatctcccctccatccccgtctcaccgcagccgggaacgtacgcttcgcgctttcctctcccgtcgtcgaatcgaatcgacccaagtagttgcgggacacgggcggtgagagagatgctggtgctgttcgagacgcccgcggggttcgccctcttcaaggtgctcgacgaggggaagctcgacaaggtcgaggatttatggaaggagttcacgacgtctgactcggcgagaaaggtggttgagctgaaggctttcaacaagtttgagaacacatctgatgccctttctgctgcaaccctcattattgacagcaagcctaccaagggtttgcgcaagttcttgcagaagcactgtgagggtgaaacattagctgtggctgactctaaacttggaaatgctataaaggagaagctgaaaattgactgccttcataatagtgctgtgatggagctcatgagagggttaagaaaccagctcactgaacttatctctggtttgggtgcacaagaccttggtccaatgagccttggcttgtcccacagtttgtctagatataagctgaagttcagtcctgaaaaggttgatactatgatcattcaggccattggcttattggatgatcttgacaaggagcttaacacttatgccatgagggttcgtgaatggtatgggtggcactttccagagctcactaaaattgtagctgataacatacagtacgcaaaagttgtgaagatgatgggtgatcggactaacgcagaaagccttgatttctctgagatactttcagatgatgaggttgaagcacagctaaaagaggcggcagtaatatccatgggaacagaagttagtgaacttgacttgctaaatatcagggagctgtgtgatcaggtgttggctctttctgagtacagagcccagctgtttgattatctgagaagcaggatgaacactatcgcaccaaatttgactgcacttgttggcgaattggttggtgctcgacttattgcacatggcggcagtttggtaaatctggccaagcagcctggcagcacaattcagatacttggtgcagagaaggctttgttcagagctctaaagacaaagcatgctacgccaaagtatggtctcatctaccatgcatccttaattggtcaagcagctccaaagcacaaggggaagatttctcgttctcttgctgcaaaaactgctcttgccattcggtatgatgcccttggtgatggtgaagataactccattggtcttgagagtcgagtcaagcttgagacacggcttcgggttcttgagggtaaagaacttggcaggtctgcaggttctactaagggaaagcccaagatagaagtgtatgaaaaggaccggaagaagggtgctggggctttaatcactcctgccaagacatacaatcctgcggctgatctggtacttggacaatccactgaagaaacaccaaagaagcctgaaggtgcttcaaagaagaggaaacatcaagaggcggagcctgcaggtgcagaggaaaccattcaagaggatggtgaccaagagggtcagaagaaaaagaagaaaaaaaagtccaaagatagcgaggattctcctgtggccgatgctgatggcggcaagaaaaagaaaaagaagtccaaggagagcgaggagccacctgtagccaccgctgaaggtgagaagaaggagaagaagaaaaagaagaaatctgattcacaagatgctaaggatgttgccatggaaaccgaagcgtctggtaagaaagacaaaaagaaaaagaagaaaaagcatggtgatgaatgagggatacactggagaaagacaatcttgggtagcattgggttgaaaactcgctgttctgtaaaatggaacatgccgggtctgttccatgcctgttagccatagtataggcaccactgttgagacttgagacttgtttactagtggaactgtattgaagcacctagtagtactaaattttggaatagggaaacatgtcgtgcttgctcgttctatgtgaactgaaatttttggtccttttggccgggagggtcttgttcgtgcaatattgcaatggctgttaaggtctttcaggttcttacttccctac

SEQ ID NO: 4151 - DNA, 2152 bp, Oryza sativa
aaaaccctctcgccgccggcaccccctctcccgccgcatcccacaacacctcgctctaaaccctcgcggcggcggcggcggcggcggcgcctactccccctccccaccatctcgccgcagccggaccttcgcctcgcgctctcctccccccatcgtcgattcgcgtccaatcgagccaaggtgtaggtgttctcgtgcggtgagagagatgctggtgctgttcgagacgcccgcggggttcgccctcttcaaggtgctcgacgaagggaagctcgacaaggtcgaggatttatggaaggagttcacgacgtctgactcggcgagaaaggtggtcgagctgaaggctttcaacaagtttgagaacacctccgatgccctttcagctgcaaccctcattattgacagcaagcctaccaagggtttgcgcaaattcttgcagaagcactgtgagggtgaaacgttagctgtagctgactctaaacttggaaatgctataaaggagaagctgaaaattgattgccttcataacagtgctgtgatggagctcatgagagggttaaggaaccagctcactgaacttatatctggtttgggtgcacaagaccttggtccaatgagccttggattgtcccacagcctgtctagatataagctgaagttcagtcctgaaaaggttgatactatgatcattcaggccattggattattggatgatcttgataaggagctcaacacttacgccatgagggttcgtgaatggtatgggtggcacttcccagagctcactaaaattgtagctgataacatacagtacgcaaaagttgtgaagatgatgggtgatcggactaacgcagaaagccttgatttctctgagatactctcagatgatgaggttgaagcacagttaaaagaggcggcagtaatatccatgggaacagaagttagtgaacttgatttgctaaatatcagggagctgtgtgatcaggtgttggctctttctgagtacagagcccagctgtttgattatctgagaagcaggatgaacactatcgcaccaaatttgactgcacttgtgggcgaattggttggtgctcgacttattgcacacggtggcagtttggtaaatctggccaagcagccgggcagcacaattcagatacttggtgcagagaaggctttgttcagagctctcaagacaaaacatgctacgccgaagtatggtctcatttaccatgcatccctaattggtcaagcagctccaaagcacaagggaaagatttctcgttctcttgcagcaaaaactgctcttgccattcggtatgatgcccttggtgatggtgaagacaactccattggtctagagagtcgagtcaagcttgagacgcggcttcgtgttctcgagggtaaagaacttggcaggtctgcaggttccactaaaggaaagcccaagatagaagtgtatgaaaaggaccggaagaagggtgctggggctttaatcactcctgctaagacatacaatcctgcggctgatctggtacttggacaatccactgaagaaactccaaagaagcctgaaggtgcttcgaagaagaggaaacatcaagagacggagcctgcaccagcagagaagaccactaaagaggatggtgaccaagaaggtgaaaagaaaaagaagaaaaagaagtccaaagagagcgaggaatctcctgcggccgatgctgacggtggcaagaaaaagaaaaagacgtccaaggagagcgaggaacctccagtggccactacagaaggtgagaagaaggagaagaagaaaaagaagaaatctgattcacaagatgccgaggatgttgccatggaaaccgaggagtctggcaagaaagagaagaagaaaaagaagaaacaccatagcgatgaatgaaggatacactggagaaggacatgttatcttgagtagcatagggttgaagaatcgctgctctgtaaaatgcaacattccgagtttttccatgccggttagttgtaggataggcatcaagtttggacttgttactcatggatcttgtattcaattgcctactgaattttggaattggagagcatatgatgcttttgctcattctatgtgaactaaagtttcttgtccttttggctggcc

SEQ ID NO: 4152 - DNA, 2099 bp, Brachypodium distachyon
gccttctcttcttctccccctcctcacgcggcggctccttttcttcccctccgcgctgtcctcctcctctcgccgccgccagccgccgaaacaggtggggaggagatgttggtgctgttcgagacgcccgcggggttcgccctcttcaaggtgctggacgaggggaagctcagcaaagtcgaggacctgtggaaggattttgcctcgtcggacaaggcgagaaaggtggttgagctgaaggctttcaacaagtttgagaatacctctgatgctctctcagcagctactttgctaattgatagcaagcctagcaagggtctgcgtaagttcctgcagaagcactgcgatggcgaaacgttggctgttgctgactcaaaacttgggaatgctatcaaagaaaagctgaaaattgattgccgtcatgattctgctgtgatggaactgatgagagggttgagaagtcagctcactgaacttatgtctggactggcagaacatgatctaggtccaatgagcctaggattgtcccacagtttgtctaggtataagctgaagttcagccctgaaaaggttgacactatgatcattcaggccattggcttgctggatgatcttgacaaggagcttaatacttatgccatgagggtccgtgaatggtatggttggcactttccagagctcaccaaaattgttgcagataatattcattacgcgaaagctgtgaagatgatgggcaatcgtgttaatgcagttaaccttgatttctctgagatactacctgaagaagttgaagcggagctaaaggaggcagctgtaatttccatgggtacagaagttaatgatctcgacctactaaacattagggagctgtgtgatcaagttctggctctttctgagtacagagcccagctctatgactatctaaaaagtaggatgaataccattgctcccaatttgactgcacttgttggtgaacttgttggcgctcgccttattgcacatggtggtagtttgatgaatttggcgaagcagcctggcagcacaattcagatactgggggctgagaaggccttattcagagctctgaagacaaagcatgctacaccaaagtacggtctcatctatcatgcatcattaataggacaggcggctccaaagcacaaggggaagatctctcgttcacttgctgcaaagactgcacttgccatacgatatgatgcccttgctgatggtgatgataactccatgggtcttgaaagcaggatcaagcttgaaacacgccttcgagtccttgagggtaaagaacttgggaggtctgcgggttctgcaaaaggaaagcccaagatagaagcatatgaaaaggacaggaagggtgctggagctttaataacacctgctaaaacttacaacccagcatcagatcttgtgctcggaaaatccaccgaagaaacaccaaagaagtcagaagtcgcttcaaagaagaggaagcacgaagaagcagaacccacaaaggaggcaactgaagcggatggcgagcaggagaaagagaaatccaagaaaaagaagaagaaatccaaggacagtgaggagtcaccagctgctgatgcggatggcggtgagaagaaaaagaaaaagaagaacaaggaaagtgaggaagcccctttagctgatgcagatggcgagaagaagaaaaagaagaagaaatcggacgcccaggatgttcctatggaaaccgacgagtccagcaagaaggagaaaaagaagaagaagaagcatgctgacgagtgagctggcagtgccgaaagaatggctcaaatttgtggtgtaatgatgtactatcatctgaaagttttgagtagcgacgattcgagactccatatgcctgtagaatggaatttcgcgttaggattagtggcagtgaatctacattttcatacttggaagtcctcagttgtcacgggtaacaagtacaatgctgaatcttatgttcctctcatctatatcacctgctatggttccacctgtgaagtagtatgtgtcagtaattacaatctgttatgttcttgatcgccagttatctagttgtcatccaattcagt

SEQ ID NO: 4153 - DNA, 1992 bp, Triticum aestivum
ccctcccccctcgccgccgccgccgccaccgctcgtcttccctcctatacacaggtgcggaggaggagatgttggtgctcttcgagacgcccgcggggttcgccctcttcaaggtgctggacgaggggaagctcagcagcgtcgaggatctgtggaaggactttgcctcgtcggacaaagcaagaaaggtggttgagctgaaggctttcaacaagtttgaaaacacctcggatgctctttcagcggctactttgctaattgatagcaagcccagcaagggtctgcgcaagttcctgcagaagcactgtgatggtgaaacattggctgttgctgattctaaacttgggaatgccatcaaagaaaagctgcaaattgattgccttcacaactctgctgttatggaactgatgagagggctgaggaaccagctcactgaacttatgtctggactagctgagcatgatctaggtccaatgagcctaggattgtcccacagcttgtctaggtataaactcaagttcagccctgaaaaggttgatactatgatcattcaggccattggcttgttggacgatcttgacaaggagcttaacacttacgctatgagggtccgtgaatggtacggttggcactttccggagctcacaaaaattgttgcagataacatccattacgcgaaagctgtgaagatgatgggcaatcgtgttaatgcagttaaccttgacttctctgagatactgccagaagaggtggaagcagagctgaaggaagcagctgtaatttccatgggaacagaagtcaatgatcttgacctctcaaacatcagggaactgtgtgatcaagtcctggctctttctgagtacagagcccagctctatgactatctaaaaagtaggatgaataccattgctcccaacttgactgcacttgttggtgaacttgttggcgctcgccttattgcacatggtggtagtttgatgaatctggcgaagcagcctggcagcacgattcagattctgggggcagagaaggccttattcagagctctgaagacaaagcatgctacaccaaagtatggtctcatctatcatgcatcattaattggacaggcggctccgaagcacaagggaaagatctctcgttcgcttgctgctaagagtgcacttgccataagatatgatgcccttgctgacggtgacgataactccatgggtcttgaaagcaggatcaagcttgaaacacggcttcgagttcttgagggtaaagaacttgggaggtctgctggttccacgaaaggaaagcccaagatagaagcgtatgaaaaggaccggaagggtggtggtgctctgatcactcccgctaaaacttacaactcagcagcagatctagtgcttggacaaaccactgaagaaacgccaaagaagtcagaagttgcttcaaagaagaggaagcaccaagaggaagaacctactgcggaggcagctgaagaggacggcgagcaggagaaagagaagtccaagaagaagaagaagaaatccaaggacatggaggagattccagcagctgtcaccgacgctagtgagaacaagaaaaaaaagaagagcaaggagaccgaggagacccctgcagccaacaccgacggcgagaagaaaaaaaagaagaagaaatcagacgccgaggacgcccccatggagatcgacgtgtccgctaagaaggacaagaagaagaagaagaagcacgctgatgagtgagcgccacggagatatggcggaaatttgtggtgtaatgctgtagtatcatcatatgaaagttttgggacttgccgttcatgtagaatggaatgccacattaggattagcagcgacgaaccctacaattcgaaacttgcaagtggtgagcagtcactttaagaggcccaatgctgtgctctcatctataacatctgctagtatgttcattctgtcgagtagtaatatatttatctgttgttaa

SEQ ID NO: 4154 - DNA, 1955 bp, Triticum aestivum
cctcctatacacaggtgcggaggaggagatgttggtgctcttcgagacgcccgcggggttcgccctcttcaaggtgctggacgaggggaagctcagcagcgtcgaggatctgtggaaggactttgcctcgtcggacaaagcaaggaaggtggttgagctgaaggctttcaacaagtttgaaaatacttctgatgctctttcagccgcaactttgctgattgatagcaagcccagcaagggtctgcgcaagttcctgcagaagcactgtgatggtgaaacattggctgttgctgattccaaacttgggaatgccatcaaagaaaagctgcaaattgattgccttcacaactctgctgttatggaactgatgagagggctgaggaaccagctcactgaacttatgtctggactagctgagcatgatctaggtccaatgagcctaggattgtcccacagcttgtctaggtataaactcaagttcagccctgaaaaggttgatactatgatcattcaggccattggcttgttggatgatcttgacaaggagcttaacacttacgctatgagggtccgtgaatggtacggttggcactttccggagctcacaaaaattgttgcagataacatccattatgcgaaagctgtgaagatgatgggcaatcgtgttaatgcagttaaccttgacttctctgagatacttccagaagaagtggaagcagagctgaaggaggcagctgtaatttccatgggaacagaagtcaatgatcttgacctctcaaacattagggaactgtgtgatcaagtcctggctctttctgagtacagagcccagctctatgactatctaaaaagtagaatgaataccattgctcccaacttgactgcacttgttggtgaacttgttggcgctcgccttatttcccatggtggtagtttgatgaatctggcgaagcagcctggcagcacgattcagattctgggggcagagaaggccttattcagagctctgaagacaaagcatgctacaccaaagtatggtctcatctatcatgcatcattaattggacaggcggctcccaagcacaagggaaagatctctcgttcgcttgctgctaagagtgcacttgccataagatatgacgcccttgctgacggtgacgataactccatgggtcttgaaagcaggatcaagcttgaaacacggctccgagttcttgagggtaaagaacttgggaggtctgctggttctacgaaaggaaagcccaagatagaagcgtatgaaaaggaccggaagggtggtggtgctctgatcactcccgctaaaacttacaactcagcagcagatcttgtgcttggacaaaccactgaagaaacgccaaagaagtcagaagttgcttcaaagaagaggaagcaccaagaggaagaacctactgcggaggcagctgaagaggatggcgagcaggagaaagagaagtccaagaagaagaagaagaaatccaaggacatcgaggagacccccgcagccgtcaccgacgctagcgagaagaagaagaaaaagaagagcaaggaggccgaggagacccctgcagccgacgccgatggcgagaagaagaaaaaaaagaagaaattggacgctgaggatgcacccatggagatcgacgtgtctgccaagaaggagaagaagaaaaagaagaagcacgctgatgagtgagcggcacggagatacggcggaaatttgtggtgtaatgctgtactatcatctttgtctgaaagttttgggatttgccgttcatgtagaatggaatgccacattaggattagcagcgacgaaccctacaattcgaaacttgcaagtggtgagcagacactttaagaggcccaatgctgtgctctcatctataacatctgctagtatgttcattctgtcgagtagtaaaaaatttatctgttgttaa

SEQ ID NO: 4155 - DNA, 1790 bp, Avena sativa
gcttcttcttccctccccacgcggcggctccttcctttttcccttcccctctctcccctcgccgccgccagctccctcctccaccgcttgccttccgaaacaggtgaggaggagatgttggtgctcttcgagacgcccgcgggcttcgccctcttcaaggtgctggacgaggggaagctcagcaaagtcgaggatctgtggaaggatttcgcctcgtcggacaaagcgagaaaggtggttgagctcaaggctttcaacaagtttgagaatacttctgatgctctttcagcggcaaccttgctgattgatagcaagcctagcaagggcctgcgcaagttcctgtcgaagcactgcgatggtgaaacattggctgttgctgattctaagcttgggaatgctatcaaagagaagctgaaaattgattgccttcacaacagtgctgttatggagctgatgagagggctgaggaatcagctcactgagcttatgtctggactagctgaacatgatctaggtccgatgagcttagggttgtcccacagcttgtctaggtacaagttgaagttcagccctgaaaaggttgatactatgatcattcaggccattggcttgttggatgatcttgacaaggagctcaacacttacgctatgagggttcgtgaatggtatggctggcacttcccagaactcacaaaaattgttgcagataatatccattacgcgaaagctgtgaagttgatgggcaatcgtgttaatgcagtcaacattgatttctctgagatactagaagaggatgtggaagcagagctgaaggaggcagctgtaatttccatgggaacggaagttaatgatcttgacctatcgaacatcagagagctgtgtgatcaagttctatctctttctgagtacagagctcagctctacgactatctaaagagtaggatgaataccattgctcccaacttgactgcacttgttggtgaacttgttggagctcgccttattgctcatggtggtagtttgatgaacctggcgaagcagcctggcagcacaattcagatactgggggcagagaaggccttgttcagagctctgaagacaaagcatgctacaccaaagtatggtctcatctatcacgcatcactaattggacaggcggctccaaagcacaagggaaagatctctcgttcgcttgctgctaagactgcacttgccataagatatgatgcccttgctgatggtgacgataactccatgggtcttgagagcaggatcaagcttgaaacaaggcttcgagttcttgagggtaaagaattagggaagtcagcgggttccactaaaggaaagcccaagatagaagcatacgagaaggaccggaagggtgctggagctttaatcacacccgctaaaacttacaacccagcagcagatctagtgctctccactgaagaaacgccaaagaagtccgaagtggcttcaaagaagaggaagcacgaagatgccgagcctacaaaggagacagtggcagaggacggagagcaggagaaggagaagtcaaagaagaagaagaagaaatccaaggacgccgaggagtctcccgcagtcgaagccgacagcggcgagaagaaaaagaagaagaagagcaaggagagcgaggaggttcctcctccttcagccgacgcagatggcgagaagaagaaaaagaagaagaaatcggacacggaggatgccgccgcccccatggaaaccgacgcgtctgccaagaaggataaaaagaagaagaagaagca

SEQ ID NO: 4156 - DNA, 2042 bp, Hordeum vulgare
ggagatgttggtgctcttcgagacgcccgcggggttcgccctcttcaaggtgctggacgaggggaagctcagcagcgtcgaggatctgtggaaggacttcgcgtcgtcggacaaagcaagaaaggtggttgagctgaaggctttcaacaagtttgaaaatacctccgatgctctttcagctgcaactttgctaattgatagcaagcccagcaaaggtctgcgcaagttcctgcagaagcactgtgatggtgaaacattggctgttgccgattctaaacttgggaatgctatcaaagaaaagctgaaaattgattgccttcacaacagtgctgtcatggagctgatgagagggctgaggaaccagcttactgaacttatgtctggactagctgaacatgatctaggtccaatgagcctaggattgtcccacagcttgtctaggtataagctgaagttcagccctgaaaaggttgatactatgatcattcaggcaattggcttgttggatgatcttgacaaggagcttaacacttatgctatgagggtccgtgaatggtacggttggcactttcccgagctcacgaaaattgttgcagataatatccattatgctaaagctgtgaagatgatgggcaatcgtgttaatgcagtgaaccttgacttctctgagatactaccagaagaagtggaagcagagctgaaggaggcagctgtaatttccatgggaacagaagtcaatgagcttgacctctcgaacatcagggaactgtgtgatcaagtcctggctctttctgagtacagagcccagctctatgactatctaaaaagtaggatgaataccattgctcctaacttgactgcacttgttggtgaacttgttggcgctcgccttattgcacatggtggtagtttgatgaatctggccaagcaacctggcagcacgattcagattctgggggcagagaaggcgttgttcagagctctgaagacaaagcatgctacaccgaagtatggtctcatctatcatgcttcattaattggacaggcggctcctaagcacaagggaaagatctctcgttcacttgctgctaagtctgcacttgccataagatatgatgcccttgctgacggtgatgataactccatgggtcttgaaagcaggatcaagcttgaaacacggcttcgggttcttgagggtaaagatcttgggaggtctgctggttccacaaaaggaaagcccaagattgaagcgtatgaaaaggaccggaagggtggtggtgctttgatcactcccgctaaaacttacaacccagcagcagatctagtggtcgggcaaacaactgaagaaacaccaaagaaggaggtggcttcaaagaagaggaagcaccaagaggaagaacctaccgtggaggcagctgaaaaggatggtgagcaggagaaagagaagtccaagaagaagaagaagaaatccaaggacaccgaggagactcccgcagctgatgctgatgctagcgagaagaaaaagaagaagaagagcaaggaagccgaggagacccctgcagctgacgcggacggcgagaagaagaaaaagaagaagaaatcagacgccgaggacacccccatggagactgacgtgtctgccaagaagaagaaaaagaagaagcatgctgacgagtgagcagcacggagatatggcgggaatttgtggtgtattgctgtactatgatcgtctgaaagttttgggacttgccattcgtgtagaatggaatgccacattaggactagcagcgacgaaccctacaattcaaaacttgcaagtggtgagcagtcactttaagaggcccagtgctgtgctctcatctataacatctgctgtgttcattctgtttagtagtaatatatttatctcttgttaattgcaaagtttgttcatcatccagtcattagattacacttgctgtgtaggatgggaacaacactttgctctacagtcattttagttgttgagcttaactttgacactattttttgttattgcatgc

SEQ ID NO: 4157 - DNA, 2064 bp, Hordeum vulgare
tcctccgatacaggtcaggaggaggagatgttggtgctcttcgagacgcccgcggggttcgccctcttcaaggtgctggacgaggggaagctcagcagcgtcgaggatctgtggaaggacttcgcgtcgtcggacaaagcaagaaaggtggttgagctgaaggctttcaacaagtttgaaaatacctccgatgctctttcagctgcaactttgctaattgatagcaagcccagcaaaggtctgcgcaagttcctgcagaagcactgtgatggtgaaacattggctgttgccgattctaaacttgggaatgctatcaaagaaaagctgaaaattgattgccttcacaacagtgctgtcatggagctgatgagagggctgaggaaccagcttactgaacttatgtctggactagctgaacatgatctaggtccaatgagcctaggattgtcccacagcttgtctaggtataagctgaagttcagccctgaaaaggttgatactatgatcattcaggcaattggcttgttggatgatcttgacaaggagcttaacacttatgctatgagggtccgtgaatggtacggttggcactttcccgagctcacgaaaattgttgcagataatatccattatgctaaagctgtgaagatgatgggcaatcgtgttaatgcagtgaaccttgacttctctgagatactaccagaagaagtggaagcagagctgaaggaggcagctgtaatttccatgggaacagaagtcaatgagcttgacctctcgaacatcagggaactgtgtgatcaagtcctggctctttctgagtacagagcccagctctatgactatctaaaaagtaggatgaataccattgctcctaacttgactgcacttgttggtgaacttgttggcgctcgccttattgcacatggtggtagtttgatgaatctggccaagcaacctggcagcacgattcagattctgggggcagagaaggcgttgttcagagctctgaagacaaagcatgctacaccgaagtatggtctcatctatcatgcttcattaattggacaggcggctcctaagcacaagggaaagatctctcgttcacttgctgctaagtctgcacttgccataagatatgatgcccttgctgacggtgatgataactccatgggtcttgaaagcaggatcaagcttgaaacacggcttcgggttcttgagggtaaagatcttgggaggtctgctggttccacaaaaggaaagcccaagattgaagcgtatgaaaaggaccggaagggtggtggtgctttgatcactcccgctaaaacttacaacccagcagcagatctagtggtcgggcaaacaactgaagaaacaccaaagaaggaggtggcttcaaagaagaggaagcaccaagaggaagaacctaccgtggaggcagctgaaaaggatggtgagcaggagaaagagaagtccaagaagaagaagaagaaatccaaggacaccgaggagactcccgcagctgatgctgatgctagcgagaagaaaaagaagaagaagagcaaggaagccgaggagacccctgcagctgacgcggacggcgagaagaagaaaaagaagaagaaatcagacgccgaggacacccccatggagactgacgtgtctgccaagaagaagaaaaagaagaagcacgctgacgagtgagcagcacggagatatggcgggaatttgtggtgtattgctgtactatgatcgtctgaaagttttgggacttgccattcgtgtagaatggaatgccacattaggactagcagcgacgaaccctacaattcaaaacttgcaagtggtgagcagtcactttaagaggcccagtgctgtgctctcatctataacatctgctgtgttcattctgtttagtagtaatatatttatctcttgttaattgcaaagtttgttcatcatccagtcattagattacacttgctgtgtaggatgggaacaacactttgctctacagtcattttagttgttgagcttaactttgacactattttttgttattgcatg

SEQ ID NO: 4158 - DNA, 2031 bp, Triticum aestivum
gcgcgccgcctcctttcctctcttcccctcccccctcgccgccgccgccgccagcgcctcctccaccacagctcgtcctcctatacacaggtgcggaggaggagatgttggtgctcttcgagacgcccgcggggttcgccctcttcaaggtgctggacgaggggaagctcagcagcgtcgaggatctgtggaaggactttgcctcgtcggacaaagcaagaaaggtggttgagctgaaggctttcaacaagtttgaaaatacttctgatgctctttcagccgcaactttgctaattgatagcaagcccagcaagggtctgcgcaagttcctgcagaagcactgtgatggtgaaacattggctgttgctgattctaaacttgggaatgccatcaaagaaaagctgcaaattgattgccttcacaactctgctgttatggaactgatgagagggctgaggaaccagctcactgaacttatgtctggactagctgagcatgatctaggtccaatgagcctaggattgtcccacagcttgtctaggtataaactcaagttcagccctgaaaaggttgatactatgatcattcaggccattggcttgttggatgatcttgacaaggagcttaacacttacgctatgagggtccgtgaatggtacggttggcactttccggagctcacaaaaattgttgcagataacatccattacgcgaaagctgtgaagatgatgggcaatcgtgttaatgcagttaaccttgacttctctgagatactgccagaagaggtggaagcagagctgaaggaggcagctgtaatttccatgggaacagaagtcaatgatcttgacctctcaaacatcagggaactgtgtgatcaagtcctggctctttctgagtacagagcccagctctatgactatctaaaaagtaggatgaataccattgctcccaacttgactgcacttgttggtgaacttgttggtgctcgccttatttcccatggtggtagtttgatgaatctggcgaagcagcctggcagcacgattcagattctgggggcagagaaggccttattcagagctctgaagacaaagcatgccacaccaaagtatggtctcatctatcatgcatcattaattggacaggcggctccgaagcacaagggaaagatctctcgctcgcttgctgctaagagtgcacttgccataagatatgatgcccttgctgacggtgacgataactccatgggtcttgaaagcaggatcaagcttgaaacacggcttcgagttcttgagggtaaggaacttgggaggtctgctggttccacgaaaggaaagcccaagatagaagcgtatgaaaaggaccggaagggtggtggtgctctgatcactcccgctaaaacttacaactcagcagcagatctagtgcttggacaaaccactgaagaaacgccaaagaagtcagaagttgcttcaaagaagaggaagcaccaagaggaagaacctactgcggaggcagctgaacaggacggcgagcaggagaaagagaagtccaagaagaagaagaagaaatccaaggacatcgaggagactccagcagccgtcaccgacgctagcgagaagaagaagaaaaagaagagcaaggaggccgaggacacccctgcagccaacaccgacggtgagaagaagaaaaagaagaagaaatcagacgctgaggacgcccccatggaggttgacgtgtctgccaagaaggagaagaagaaaaagaagaagcacgctgacgagtgagcggcatggagatacgccggaaatttgtggtgtaatgctgtactatcatcgttgtctgaaagttttgggacttgccgttcatgtagaatggaatgccacattaggattagcagcgacgaaccctacaattcgaaacttgcaagtggtgagcagtcactttaagaggcccaatgctgtgctctcatctataacatctgccagtatgttcattctgtcgagtagtaatatatttatctgttgttaa

SEQ ID NO: 4159 - DNA, 653 bp, Saccharum officinarum
ccgccacagatctcgccattccaacagagttggatcaagcgagccgcgtagtgtttagtgcgagagagagagaggggggaagggagccatgacggagctgttcgacacggccgtgaccagcctcctccacctgccggaggtgctggaccgcctcgccgccgcggacggcgaccggcgctcgggcgggcaccacgcggcgcaccaccacgggcacgcccgcgtccacgggctcggcggcggcgcgccggtggacatcatggagacccccggcgagtacacgttcgtgctcgacgtgcccggtctctccaagtccgacatccaggtgacgctggaggaggaccgtgtgctggtgatgaagggtggcaacgggaagcggaagcgcgaggaagaggaggaaggcgaggggtgccggtacatccggctggagcgcggcgcggcgccgcggtcgttcgcgcgcaagttccggctgccggaggacgcggacacgggcggcgtcgcggcgcgctgcgagaacggcgtgctcaccgtcaccgtcaagaagctgccgccgccggataagacgaccaagtccgtgcaggtcatcatcgcctagaactccgcagtcggtcggcgctggcagtgtagcagagtagcagtagaaccgtacgtacgta

SEQ ID NO: 4160 - DNA, 1003 bp, Zea mays
ctcccggtccttctggacgcgacagcacaccacctctacgaagcatctcgaactctcggtgccgctcaatttgtacccccaatccccttccacacaccgcctcgccacatcgcagagccagagcaagggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggacgcgtccacgggctcggcggcggcggcggagcgccggtggacatcgtggagagcccccgcgagtacgccttcgtgctcgacgtgcccggcctctccaagtcagacatccaggtgacgctggaggaggaccgggtgctggtgatgaagggcggcagcgggaagcggaagcgcgatgaggaggaggacatgaacggcgaagggtgccgatacatccggttggagcgcggcgcggcgccgcggtcgttcgtgcgcaagttccggctgccggaggatgcggacacgggcggcgttgcggcgcgctgcgagaacggtgtgctcaccgtcaccgtcaagaagctgccgccgccggagaagaaggccaagaccgtgcaggtcaccatcgcctagaagtcggcagtcggcactcggcagagtagcagcagtagaattgtagcgcgtacgtagtggcctgtcgtgttgggaggagtgctcttttgtttacgtttgtgctgctgatgagccggtgtgtgtgtgtaacagaccgtgcttcttttctgaacaagaattattcaatcgtgtctctggtgaagctgtgcatttgtgcaaggagttcttgtggcctctcactgggatattattacaaggaagtgagtaacaaagaaattacatgcccaggaataacagtcgagagagaatgttggt

SEQ ID NO: 4161 - DNA, 859 bp, Panicum virgatum
cgcagaacgcacggcaggagcgcgctagggagaaccagcagatctctcgccactcacagtcctcgatcgagtctcagcagggtcgagagcgggagggaggaaggaaggaagccatgacggagctgttcgacacggccgtgaccagcctcctccaccttccggaggtgctcgaccgcctcgccgccgcggacggcgaccgccgctctggcggccaccacggcgcgcaccatcacgggcacgcgcgcgtccacggccttggagccggcgccggcggcgcgccggtggacatcgtggagacccccggcgaatacaccttcctgctcgacgtccccggcctctccaagtcggacatccaggtgacgctggaggaggaccgggtgctggtgatgaagggcggcagcagcagcaacagcaacaacaacaacggaaagcggaagcgcgaggaggaggaggaggagggcgaggggtgccgctacatccgcctggagcggcgcgcgtcgccgcggtcgttcgtgcgcaagttccggcttccggaggacgcggacgcgggcggcatcgcggcgcgctgcgagaacggggtgctcaccgtcaccgtgaagaagcagccgccgccggagaagaagaccaagtccgtgcaggtcaccatcgcctgagctcacccagccgagggagcgagtgagcagtcggtcagcagtggcagtctatcagtaggagtgtactacgtagaaggttgggtgctctgtttgtgttcgatgcagagtagggagtatggctgttcgtcttttgtgatgtcgctgtgttctaatgtcattagttggtactatcggtgaactcgcaagagattccagaatttccactc

SEQ ID NO: 4162 - DNA, 840 bp, Cenchrus ciliaris
  misc_feature (98)..(98): n is a, c, g, or t
  misc_feature (314)..(318): n is a, c, g, or t
  misc_feature (321)..(322): n is a, c, g, or t
ccgaatcgaagaagaacccacagcagatctatcgccactcatcgcaatcgatcagagtcacatcgttgagcgagggagggagtgagcgaggagagtgnggagccatgacggagctgttcgacacggccgtgaccagcctcctccacctgccggaggtgctcgaccggctcgccgccgcggacggcgaccgccgctcgggcggacaccacggcgcgcaccaccacggccacgctcgcgtccacgggctcggcggcggaggcggcggcgcgccggtggacatcgtggagactcccggcgagtacagcttcctgctnnnnnttnncggcctctccaagtccgacatccaggtgacgctggaggaggaggaccgggtgctggtgatgaagggtggcaacaacggcgggaagcggaagcgcgacgaggaggaggaggacggcgaggggtgccgctacatccggctggagcgtcgcgcggcgccgcggtcgttcgtgcgcaagttccggctgccggaggacgcggacacgggcggcatcgcggcgcgctgcgagaacggcgtgctcaccgtcaccgtcaagaagcagccgccgccggagaagacgaccaagtccgtgcaggtcaccatcgcctgagcgcgccccgcccgcgcgagggagtgtgcaggcggtcaccagtggcagcctagcagtagggagtagtagaaagttggatgctctgtgtgtgttccgctctggagtactcgtaggcctgttcgttgccgagttggtagtgttcgtcttctgtggttggaggtcgctgtgttgaacgaaggatccgaatgttatcatttaaagctgcaagaga

SEQ ID NO: 4163 - DNA, 1080 bp, Panicum virgatum
cagaacgcaaagcagcataggaagaaccagcagagctctcgccacccataatcctccatcgagttgcagcgagctgcagcagcgtccagcgaggagggagtaaggaaggaagccatgacggagctgttcgacacggccgtgaccagcctcctccacctgccggaggttctcgaccgcctcgccgcagcggacggcgaccgccgctccggcggccaccacggcgcgcaccaccacggccggcacgcgcgcgtccacggccttggcaccggcgccggcggcgcgccggtggacatcgtggagactcccggcgagtacaccttcctgctcgacgtccccggtctctccaagtccgacatccaggtgacgctggaggaggaccgggtgctggtgatgaagggcggcggcggcggcagcagcaacaacaacaacgggaagcggaagcgcgaggaggaggagggcgaggggtgccgctacatctgcctggagcggcgcgcgtcgccgcggtcgttcgtgcgcaagttccggctgccggaggacgcggacgtgggcggcatcgcggcgcgctgcgagaacggggtgctcaccgtcaccgtgaagaagcagccgccgccggagaagaagaccaagtccgtgcaggtcaccatcgcctgagctcccccagacgagggaagcgagtgagcagtcggtcaggggtggcagtctatccgtaggagtgtagtctacgtagaaggttgggtgctctgtttgtgttcgatgcagagcagggagtgtggctgttcgtctttcgtgatgtctctgtggaatggaacgagtattctaatgtcatcagttgctactatcggtgaactcgcgagagattccagtatttccagtcagtcaactagtttaactggggcgcaccggtgcgccagtttgagctggttcagtagatactgtgtggtagtattagcgtaagttatattttataaatttaaaaatttatgaaaggttatagaaaattatttgggaataatatgatttttatttttttgtactgtatgaaattttgaatattattttgggtatcgaaatctttttttg

SEQ ID NO: 4164 - DNA, 885 bp, Oryza sativa
gccattgctgcagtagcaagaaggagagcgagagagcaaagcccaagttggtagccatgacggagctgttcgacaccgccgtgaccagcctcctccacctgccggaggtgctcgaccgcctcggcgccgccgccggggaccgccgctcggcgggcgaccacgcgcaccacgccgcgcatggacacggccagcaccgcatcagtggaatcggtggtggcgcgccagtggacatcatggagacccccggcgagtacgcgttcgtgctcgacgtccctggcctctccaagtccgacatccaggtgacgctggaggaggacagggtgctggtgatgaagagcagcaatggcgccgggaacgggaagcggaagcgggaggaggaggaaggggagtgcaagtacatccgcctcgagcgccgcgcgtcgccgagggcgttcgcgcgcaagttccgcctcccggaggacgcggacaccggcggcatctcggcgcgatgcgagaacggggtgctcacggtcaccgtcaagaagcggccgccgccggagaagaagaccaagtccgtccaggtcaccatcgcctgaatcatagcgtagtgctcgggtaatggcagcgtggcggtagtagaagctggaaatggttgccgagaatggttggagcagtagaatgtgtttgtgctctgttcgtgtttcggtagtacaagttgtcgctgatctgctatgtataaacgctggtgtgaccgtgaagatgaagactacggaagtagctgttcttttgtgtaggatcaagcaaattatgtcaaatctcgttcgtgaacgattccaaatcgatgcattatgttatgatctctgtcttatatgaatcctacagctacaattcttcgtttcctcaatc

SEQ ID NO: 4165 - DNA, 2235 bp, Sorghum bicolor
tatgcaaaacataaacatcttcaggtggatcctccacccgccaagctcgcagaaaatgaagaagtcacagaggacatcatattagcggcattgaggcgagcactcgctcaacattcaagtctgcaagcggatgatgggtgctggccagcagactatagtggtcttttgttcattatgcctctcctggtattcgctttatataccactggatcactcaatactgtcctatctaaagaacaccaacgcgagatacgtcgctatatttacaatcatcaggcatatggtggttggggtaaacaagtgttggggccgagcaccatgtttggctcatgcttgaactatgttgcattaagacttattggtgaagattgcacgaatgttgcattgaccaatggacgtgagtggattttgtctcatggaagtgcaactgcaattccacaatggggaaagatatggttctcggtgatgggtttgtatgattggtctggaaacaatccagtaattcccgagttatggcttctcccatactttctgccaattcatccaggacgattttggatactttgccgtatggtgtatctgcctatggcttatctgtttggtaaaaagtttgtgggagaagttacaccaactatattggaattaaggagtgagctctattctgtgccatacagtgaggttgattggaaaaaagctcgtgatacatgtgccaaggtggaccttatatatccaaggacaatggcacaaaatcttgtatggacattccttaataaggttatagagccaatgctgaattggtggccagtaaataagttaagggatatagcattgcaaaacatcatggaacatatccactatgaagatgaaactagcaaatacatatgtatatgtccgataaacaaggcactagatatgatttgttgttgggcagaaaatccaaattcagatgcgttcaaacaacatcttccaaggatatatgatatgctatggcttgctgaagatggaatgaaggcacaggtctacgatggttgtacaacatgggagactgctttcattgttcaagccttttgctcgacaggtcttgttaatgagattagttcaacacttcgtaaagctcatgaattcattaaatgttcacagataagtgaaaaccatttggactacaaatcttactaccggcatgcatcaaaaggttcatggacactttcaacagcagataatgggtgttcaatatctgactgtactgccgaggcgttgaaggcattgctattgttatcaaagatctctcccgatcttgtgggggaacccataaaaggagaaagtctgtatgatgcagttgattgcttactttcttttgtgaacaatgatggaagcttctctgcatacgagtgtaagagaaccacacctttgttggaggttctcaacccttctgagagctttcggaatattattgttgattatccatgtgttgaatgcacatcatctgtgctacaagctctgattatgtttagagacctggatcatgtgtaccgcaaagaagagataggaaattgcattgaaagggcgtccaggtttattgagaaggaacaacgaaaagatggctcctggtttggcagctggggtatatgtttcacttatgggactttctttgcgataaaagggctagctctttcaggaagaacttatgaaaatagtgatgccatcaggaaagcttgtagctttttgttgtcaaagcagctacatacaggtggatggggagaaacttatctttctagtgaaactgcggaatatgtggaggctagtagacctcatgcagtgaacactgcttgggcaatgttaaccttagtttatggtgggcaggtggaacgtgatccaacaccgttatataaagctgcaaaagagttgatcaatatgcaactagattctggagactttccccaacaagaacacgttgggtgcttcaatagttccatattcttcaattacggaaattaccgcaacttgtacccgatatgggctcttggggaatttcgtcgtcggcttcttgaaaggaagaagtgaaactaatatacatgatgcccaggctatttaaactataatgttcagtacagttatatatgttagtaactgtgctcagcgtgactatatattatgatagtgaaaattgatgcccgtcctgcacatgatgtgtccttcctattgttggattgggatacaaatcaaacaccagcaagg

SEQ ID NO: 4166 - DNA, 2061 bp, Zea mays
actcccatggcatccgccgtcctgtgtgcccccgccacgcacctgcaagcgatcccacctggccaccagagtccagagacacagatacctaggtcccgagagcacgcaaccccgttcacaatcgcagccagccaccattatataaccccacgcctcccacctcccgctcggattccattccacctgtacggctgtaccccaccgccaccacccacggcacgctgcgcgcccaagcaaaccagggagcgcggccgaccgaccagccagacctgcgcaatcgaaaccgatcgactcccctattattggtccccatccccatggggcggcggctgagcgcgaccgccgccgccgcggcggcgtcggcggagccgctcctcccgccggcgctgaagcgcggggtgctgatcgagcggtgcgcgtcgcacgccgacgacgagctgcagtggttccgctcctgcctgcggtgggtgtgcatggaccactcgggcccgggccaggccgcgctgtcctggctcctcttcctcgtcctcgccgccatcgtcccggccgccgcgcacttcctcctcgccttccgcgcctcgcgccgccccttctcggccgtcgtgcagctctcgctctcggccgcctccgccgcgggcttcctctgcctctcctcctccttccgccgcgtcggcctccgccgcctgctccacctcgacaagctccgcagcaagagcgaccgcgtccgggccagctacacggcgcgcctcgccttctccttccgcctcctcgcctccctcgtcgcgccgtgcttcgccgccgaggccgcctacaaggcctggtggtacgccacctccgccgaccgcgtccccttcttcgccaacgacgtcctcagcgacgtcctcgtctgctccctcgagatggcctcctggatgtaccgcagcgccatctacctcctcacctgcgtcctcttccgcctcatctgccacctccaggggctcaggctcgaggacttcgccggctccctgctcgaggaagtcgaggagggccgggccggcgtcgatgccgtgctaagagagcacctcgacattcgcaagcagctcaaggtcatcagccatcgcttccgtaagttcatcgtcgctgcgctgctcatcgccacggccagccagttcgcctccgtgctcctcaccacgcgacgcgactctgtcgacgacctcctcaacaccggcgagctcgcgctgtgttcagttgtgctcatgtccgggctcatcataatcctgagcagcgccgccaagatcacccaccaggcgcaggccctcaccggtcacaccaccaagtggcatgcctgctgcaccatcgagcccgtgctggaggaaggggagcccgggtccaaccagaactccatgatcgaccaagaacccgagagtgacagtgacacagaggacagcgaggagaccggcgacgaagatctcctggagaacaccaagattcatatgccgcacgcgcatgtcatctccttccagaagagacaggcactagtgacatacttggaaaacaacagagccgggatcaccgtgttcggtttcacgctggaccgttcgtacctgcacacgatatttatgctcgagtggactctgttcctgtggctgctcggtaagaccatcggcttctcgtgaagaagacggcgatgaaaagaagagaggtggcctgtgtccaacgtccggatggtcgtttttgagaggtttcgcatgtcgcggttgccctttttggggatggatttggatgtgctttgtttttcggtcatcgtggaagggctttttttcgcgtgagcctggctgttggcacgggagcgttgcgcgtgtacacctcaacgcctgtgtatgatagcgattttgtatgatgtgtgtgtataaattgtgaaccgtaattgtccttgtaaatgagcgttgtacagtcgtacactggtaatgctgttttttacaatctcgttgtaagccaacatgttgtagcgagaatttagattgtaaagataaagattcttgtttttttaaatcttgggagggtatgaaattagttcaagat

SEQ ID NO: 4167 - DNA, 1800 bp, Pennisetum glaucum
cgccccccacccccacccggcgctaacaaccaaccaacccatggggcgtcggccgaccgcggccaacgccgcggcggtggcgtcggcggagcccctcctcccgtcggcgctgaagcgcggggtggcgatggagcggtgcgcgtcgcgggccgacgacgagctccagtggttccgctcctgcctccgctgggtgtgcatggaccactcgggcccgttccagtccgcgctctcatggctcctcttcctcgccctcaccgtcctcgtcccggccgccgcccacttcctcctcgccttccgcgcctcccgccgccccttctccgccgtcgtccagctctcgctctccgccgcctccgccgccggcttcctctgcctctcctcctccttccgccgcatcggcctccgccgcctcctctacctcgacaagctccgcaccaagagcgaccgcgtccggatccactacaccgcgcgcctcgccttctccttccgcctcctcgcctcactcgtcgccccctgcttcgccgccgaggcggcgtacaaggcctggtggtacgccacctccgccgaccgcgtccccttcttcgccaacgacgtcctcagcgacgtcctcgcctgctccctcgagatggcgtcctggatgtaccgcagcgccgtctacctactcacctgcgtgctcttccgcctcatctgccacctccaggggctccgcctcgaggacttcgcggggtcgctgctcgaggacgtcgaggagggacgcgtcggcgtcgacagcgtcctcagggagcacctcgacatccgcaagcagctcaaggtcatcagccaccgcttccgcaagttcatcgtcgccgcgctgctcatcgccaccgccagccagttcgcggccgtgctcctcaccacgcggcacgactccgtcgacgacctcttcaacaccggcgagctcgcgctatgttcagtcgtgctcatgtcggggctcatcataatactgagcagcgccgcgaagatcacgcaccaggcgcaggcgctcaccggccacaccaccaagtggcacgcctgctgcaccatcgcgcccgttgaggacgaggaaggggagcccgggtccaaccagaactccatgatcgagcaggacccctcgagtgacagcgacacggagtccggcgactacaccggcgacgacgaggaccttctggagaacaccaagatccatctgccgcacgtgcacgtcatctccttccaaaagaggcaggcgctagtgacatacctggagaacaacagagccgggatcacggtgttcgggttcacgctggaccggtcgtacctgcacacgatattcatgctggagtggacgctcttcctatggctgctcggcaagacgatcggcttctcttgaaggggggaaataaaggaagagtggaagactacggggtggaagaaggtgcagagatgtccacgtcgtccaggtggtcgttcattcttggaagctgaaacgagttttggggtgcaattcttttttgggtgatcgatgagctgggcatttgttcgatcgttgtgaaatggggaagggcttttgttgtggatgtttgtacagtagcgatttgtatggcgttttgtaaattgcgtgtcggttgcccgtgccaccgccaccctgccatgtaaatgcgggttgtagagtagagtatctggggtttgcaggattgcagttggctatttttgctgtgcgcgccatgggtcatgggtgcaggtttgcagcttggcattgcaggttttacattcacgtgttgtgaagcgttaaataatttcttacga

SEQ ID NO: 4168 - DNA, 1439 bp, Setaria italica
accaccacccgcgccacgccacgcacaagcgaaacagagcccgaccagagcagcgccgcgcgatcctcctcagcaggcccgcagccatggggcggcggccgagcgcttccaacgccgcggcggtggcgtcggcggagcctctgctcccgtcggcgctgaagcgtggcgtgatggagcggtgcgcgtcgcgccccgacgacgagctccattggttccgctcctgcctgcgctgggtgtgcatggaccactcgggcccgtgccagtccgcgctctcctggctcctcttcctcgccctgtccgtcgtcgtcccggccgccgcccacttcctcctcgctttccgcgcctcccgccgccccatctccgcggtcgtccagctctccctctccgccgcctcggccgcgggcttcctctgcctctcctcctccttccgccgcatcggcctccgccgcctgctctacctcgacaagctccgcaccaagagcgaccgcgtccggttccactacacggcgcgcctggccttctccttccgcctcctcgcgtccctcgtcgcgccatgcttcgtcgccgaggccgcgtacaaggcctggtggtacgccacctccgccgaccgcgtccccttcttcgccaacgacgtcctcagcgacgtcctcgcgtgctccctcgagatggcgtcgtggatgtaccgcagcgcggtctacctcctcacctgcgtcctcttccgcctcatctgccacctccaggggctccggctcgaggacttcgcggggtccctgctcgaggacggaggggcgcaccggcgtcgccagcgtcctcagggagcacctcgacatccgcaggcagctcaaggtcatcagccacaggttcaggaagttcatcgtcgccgccctgctcatcaccaccgccagccagttcgcatccgtgctcctcaccacgcgacgtgactccgtcgacaacctcctcaccaccggcgagctcgcgctatgttcagtcgtgctcatgtccgggctcatcataatcctgaacagtgccgcgaagatcacccaccaggcgcaggctctcaccggccacaccaccaagtggcacgcctgctgcaccatcgcgcccgtccaggacgaggaaggggagcccgggtccaaccagaactccatgatcgagcaggacccctcgagtgacagcgacacggagtccgacgagtacaccggcgacgacgaggacctgctggagaacaccaagatccatctgccgcacgcgcacgtcatctccttccagaagaggcaggcgctagtgacatacctggagaacaacagagccgggatcactgtgttcggcttcacgctggaccggtcgtacctgcacacgatattcatgctcgagtggacgctgttcctgtggttgctcggcaagacaatcggcttctcttgaaggggaaaggaagaaga

SEQ ID NO: 4169 - DNA, 1964 bp, Oryza sativa
ctcgtctttctctctcctccacctggacgccattggactccaccaccacccaagggaggcagagcgcgcgcgcggcgcgacgcggcgcggcgcggcgagggcgagagcgagatcaagctagttcagtggttcggccgaccgattcgatggggaggcggtcgagcgcgtcgtctgcggcggcgggggagccgctgctgccggcggcggcgtcggcgaaggggggtgggggagggggaggtcgggcgtcgatgctgcagcggtgcgtgtcgcgggcggacgacgagctgcagtggttccggtcgtgcctccggtgggtgtgcatggaccactcgggcccctggggcgccgcgctgtcgtggctgctcttcctcctcctcgccgtcgccgtccccgccgcggcgcacttcctcctcgcgttccgggcgtcccgcaggccgttctccgccgtcgtgcaggtctcgctatcggcggcgtccgcggcggggttcctctgcctctcctcctccttccgccgcatcggcctccgccgcctcctctacctcgacaagctccgcaccaagagcgaccgcgtcaggctcaactacaccgcgcgcctctccttctccttccgcctcctcgcctccctcgtcgcgccgtgcttcgccgcggaggccgcctacaaggtgtggtggtacgccacctccggcgaccgcgtccccttcttcggcaacgacgtgctcagcaacgcggtcgcctgctccgtcgagatggcggcgtggatgtaccgcagcgccatctacctcctcacctgcgtcctcttccgcctcatctgccaccttcaggggctccgcctcgaggacttcgccgggacgctgctcgtcgaggtggaggaagggagggccggcgtcgagcgcgtgctccgggagcacctcgacatccgcaagcagctcaaggtcatcagccaccgcttccgcaagttcatcgtcgcctccctcctcatcgccaccgccagccagttcgcctccctcctcctcaccacccgccacgactccgtcgacgatctcctcaacaccagcgagctcgcgctgtgttcagtggtgctcatgtcagggctgatcataatcctgagcagcgcggcgaagatcacgcaccaggcgcaggcgctgaccgggcagacgacgaaatggcacgcctgctgtaccatcgagccggtgccggacgaggaggcggagcccgggtcgaaccacagctcgatgctcgaggtggagcccgtcagcgacagcgacggcgagtccagcgaggagaccggcgacgaggacctgctcgagaacaccaagatcatgctgccccaagcacacgtcatctccttccagaaaagacaggctctagtgacctatctggagaacaacagagcggggatcacggtgttcgggttcacgctggacaggtcctacctgcacacgatattcatgctcgagtggacgctcttcctgtggctgctgggcaagacgatcggtttctcgtgaaagcgaggtaaaaaaaaaagttttcctgcatacaacaagttcaggttgttctggaacacatgtatgtttggttggttggtgggttgcaattttgcggatgcgtggctgtgcagttggatcctcgtgagtggagtcatttttgggtgctcacgatagtagcgtgcgcatgtatgtgtatacgcatgtatgtgtatacgtacgtatgtattgatgtttgtataaaaactggtgttagcggtgtacagattttgagtccattgcttcgttcgcgctaacaccaccttagtaaatgagcgatatatgtagagcgttaggacttgtatgtacttttgctgctttagtttgcggttgtgcacgcgtgcggcttcctgttgctaacgtgcaggctttatcatccggttttgtaatttgtatagccgatgaaagttgcagagcaaattttatttacagttcagtttc

SEQ ID NO: 4170 - DNA, 1836 bp, Avena sativa
catctgtgaaagcctttatattaagatcccctctctctttctctctcctccacttgtgctccaccgccaccaccagaatatcgccacgcgcagagagttcgctcgtgtgaagcaggacaaacccgtgcgattcgtccacgatcgatccggcatggggcggcggtctaacgcctcgccggcggagcctctgctgccggagatgctgaagggcgggggccggggcgcgatgctgcagcgtaccatgtcgcgggcggacgacgagctgcagtggttccgctcctgcctccggtgggtgtgcatggaccactctgccccgggcggcgccgcgctatcatggctcctcttcatcctcctcgccgtcgtcgtcccggccatcgcgcacttcctcctggccttccgcccctcgcgccgccccttcgacgccgtggtccagctctcgctctccgccgcgtcgggggccagcttcctctgcctctcctcctccttccgccgcatcggcctccgccgcctgctctacctcgacaagctgcagaccaagagcgaccgcgtgagggtcaactacacggcgcgcctcgccttctccttccgcctcctcgcgtccctcgtcgcgccctgcttcgccgccgaggccgcctacaaggcctggtggtacgccacctccgccgaccgcgtccccttcttcgccaacgacgtcctcagcgacgtcctcgcatactccctcgagatggcctcctggatgtaccgcagcgccatctacctcctcacctgcgtcctcttccgcctcatctgccacctccagggcctccgcctcgaggacttcgcggggtccctgctcgtcgaggtggaggagggcaggatgggggtggagcgcgtcctcaaggagcacctcgacatccggaagcagctcaaggtcatcagccaccgcttccgcaggttcatcgtcgccgcgctgctcatcgccaccgccagccagttcgcgtccgtgctcctcaccacgcgacgcgactccatcgacgacgtcctccacaccggagagctcgcgctgtgttcggttgtgctcatgtccgggctgaccataatcctgagcagcgccgccaagatcacccaccaggcgcaggccctcacgggccagaccaccaagtggcacgcctgctgcaccatcgagccagtcccggataacgagcttgaccccggatccaaccagaactccatgacggaagagtacgccgccgagaccgagagcgactgcgagtccagcgaggagaccggggacgaggacatgctggagaacaccaggttcatgcagcctcactcgcacgtgatctccttccagaagcgacaggcactagtgacctacctggagaacaacaaagccgggatcaccgtgttcgggttcacgctggaccggtcgtacctccacacgatattcatgctcgagtggacgctcttcttgtggctgctggggaagacaatcggtttctcgtgaagactgaagaccagggaatgcatgtatacattttgtggctgctctccaggtggttaggtttggcttggttgcatttttccgggtgtgcattttgctctgtgtttgtgcacgtgagttgtatcgcactgtatttatgctagcgatgtgtgcgatgatgtgtaaattatgggttgattgttcgtgacaccccgcggtacaaaggtgtatgtaaaattatagatgagtgttgtagaaaaaaaggctttttttgggtgtgtgcagcttggtttttggaggtttataatctcgggttgtaaaccaacaatagttgtagacaagactttgaatcgtaaagtctctttccttttcat

SEQ ID NO: 4171 - DNA, 1658 bp, Setaria italica
ggattactcaaaactattcggaatatccagagatactccacttgcatatatgggattgttccgtgttaaacctcacacaaacaagatcacatttccttgcgcacgtccagtacaggtgtgtgtgtagagtataagaataacatagtatctaccgcccagtgcaatatatcaccagctatatcatccacgagacgagcccgactcatgaacgcatttatggtgtacgtgtacgtgtacgtgacgttttactagttgtgttacgccattgacacaccgtaccgctagagctcggcggtgagtccttcgacctcgagctggaacttctccatggcgtccttgggcaggcagatgggcaccacggtgccctcctccccctttccgttcttggcccgcgagaagtagttggtgacgccggggagcggcccttcgcctcccttggccggcccgccgtagacggcctccccccatccgaagtcgacgctcttgaacccggcgtggctcacgtccgacacgatgtacgtcctcgacagcgcgaacagcggccgcccctcgagcaccatcaggtccgccaccgacagcaggtagtcgtacgtcaccgccgacttggccttcttcaccagctccagcgcgtacccgaggtccttcccgcagagctccccggcggtggtcgccgccacggagtaggcgaacgcgttcccgtagaagccctcggggagcgggatctcggggcggccgcgcgcgttcacgatgaaggacagccgcacctcgtcgccgggcgcgtacccgagcgccgccgcgcggctgcgccagatgcaggccgcgacgagctcgaaccgggagcaccgcatgcccggcggcgcgcgctggcgcagccccgcgatctcccgcgtcccgaagaagaaggggacgcgcgccatgtcggcggggggcgtcgacagcatcctgtccggcccgcccgccggctcccggtactcgaggtgcgggtacgacggcgccatgaacaactccctgccccacgccggcgcgaccgacggcgccgcggcgccgcacgcgagctcgcagacggccttctcgaactgcatcccgcccggcgcgtccacgacgcagtggcagaaccgctgcccgaagatgaagccgccgcacctgagccgcgtcacctggatgtagagcaggggccggtcgacgacgggctcgacgccggcgatgctggtgctctcgaggatgaagcgctcgaagcacgggaacggcgggctctgcacgtccccgaagtcgtcggcggtgaggtcggcgtcggcctccgcgaacatgacgccctgcgcggcgcagtcgaccacgagcttcctccctccctcctcgcggagccgccccgcgagcgggtagtaggggacgagcgccctggccagcgcgtcccggatgacccgcgccgggtcctgcccggccttggctgggttagcgcggtacaggtggatgcccgagctgtagaaccgcatgccctccccgtcgtcgatgtccgacagcggcttcgtctcccgcggcgtcggctccgccggcgacaccagcaccggctccccgcgccgcaccgtgaacgccggaagcaacgacgccattgttgcttactgatcgatcaaatgcaactgcaagtgcgagctctggtgttc

SEQ ID NO: 4172 - DNA, 1738 bp, Zea mays
cgcaccgcactcactcagctcggctcagctctctgagtcactctgaccacgtacgtacgagcgaacaaggcaatggcatcgtcgctcccggcgttcacggtgcggcgcggggacccggtgctggtggcgccggcggggccgacgccgcgggagacgaagccgctgtcggacatcgacgacgccgagggcatgcgcttctacagctccgggatccacctgtaccgcgccaacccggccaaggccgggcaggacccggccagggtcatccgcgacgcgctggcccgggcgctcgtcccctactaccctctcgccggccgcctccgcgaggtggaaggaaggaagctcgtggtggactgcgccgcgcagggcgtcatgttcgcggaagccgacgccgacggcctcaccgccgccgacttcggggacgtgcagagcccgccgttcccgtgcttcgagcagttcatcctggagagcaccaccgtggccggcgtcgagcccgtggtcgaccgccccctgctgtacgtccaggtcacgcgcctcaggtgcggcgggttcatcttcggccagcgcttctgccactgcgtcgtggacgccccgggcggcatgcagttcgagaaggccgtgtgcgaggtcgcgtgcggcgcggccgcgccgtccgtggcgccggcctggggcagggagatgttcatggcgcgcgacccgccgcggcccgcgtacccgcacctcgagtaccgcgagcccgcgggcgggcccgcagaccggatgctgtgcaccgcgcccgccgacatggcgcgcgtccccttcttcttcgggcccagggagatcgcggggctgcggcagcgcgccccgcccggcgcgcgctgctcccgcttcgagctcgtcgccgcgtgcatctggcgcagccgcaccgccgcgctcgggtacgcggcggaccaggaggtgcgcctgtccttcatcgtcaacgcgcgcggccggcccgacatcccgctccccgagggcttctacgggaacgccttcgcctactccgtcgcggcggccaccgcgggggagctctgcgccggggacctaggcttcgcgctcgacctggtgaggaaggccaagacggcggtcacctacgactacctgctgtccgtggcggacctcatggtgctcacgggccgcccgctgttcgcggtgtcgaggacgtacatcgtgtcggacgtcagccacgccgggttcaagagcgtcgacttcggctggggcgaggccgtctacggcgggccggccaagggcggcgaagggccgctcctcggcgtcaccaactacttctcgagggcaaagaatggcaagggggaggagggcaccgtcgtgcccatctgcctgcccaaggacgccatggagaagtttcagctcgaggtggaaggcctcaccgccgagctctagccgaccgagccgcatgcatatgcatgtgtacggtgtacgcatgcacggcaccgaataaacagtagcccaccaggatacatcacaataacgatgtacaaacgtacgtagatagtaaaacgtcatgagcacggacaccatatatacgtaatacgtgtgctgttttcctactgtacactgccgtacctactcgacaaaatacgatggtggtgtgcacacatgttttgtgtaaggtaactctgtaaacgattcatatactacttgcaggtttgtaatattgtcattccctcccgccttcaagttgcaaagctagacccttgta

SEQ ID NO: 4173 - DNA, 1464 bp, Saccharum officinarum
cagcccattccactgatcacgtactcaccacagcgccgcacacaaacacagctcgtccgagccctctgatcacatcacgtatacgtgatggcaatggcatcgtcgctgccggcgttcacggtgcggcgcggggacccggtgctggtggcgccgtcggcgccgacgccgcgggagacgaagccactctcggacatcgacgactccgagggcatgcggttctacagctccgggatccacctgtaccgcgccaacccagccaaggcggggcaggacccggccagggtcatccgcgaggcgctggcgcaggcgctcgtcccctactacccgctcgccggccgcctccgcgaggtggaagggaggaagctcgtcgtcgactgcaccgggcagggcatcctgttcgccgaggccgacgccgacctcaccgccgacgacttcggggacgtgcagagcccgccgttcccgtgcttcgagcagttcatcctcgagagcaccaccgtcgccggcgtcgagcccgtcgtcgaccgcccgctgctctacgtccaggtcacgcgcctcaagtgcggcgggttcatcttcggccagcgcttctgccactgcatcgtggacgcgcctggcgggatgcagttcgagaaggccgtgtgcgagatggcgtgcggcgccgccgcgccatccgtggagccggcctggggcagggagatgttcatggcgcgcaaccccccgcgcccggcctacccgcacatcgagtaccgcgagcccgcgggcggcgttggcgtcgaccggatgctgaccactcccgccgccgacatggcgcgcgtccccttcttcttcggggcccgggagatcgcggggctgcgccagcgcgcgccacccggcatgcgctgctcccggttcgagctcgtcgccgcgtgcatctggcgcagtcgcaccgccgcgcttggatacgcgcccgacgaggaggtgcgcctgtcgttcatcgtgaacgcgcgcgggcggcccgacatcccgctccccgagggcttctacgggaacgccttcgcctactccgtcgcggcaaccaccgccggggagctctgcggcggggacctcgggttcacactggagctcgtgaagaaggccaagtccgcggtgacctacgactacctgctgtcggtggcggacctgatggtgctcacgggacggccgctgttcgaggtgtccagaacgtacatcgtgtcggacgtcagccacgccgggttcaagagcgtcgactttggctggggtgaagccgtctacggcgggccggccaagggcggcgacaggccgctccccggcgtcaccaactacttctcgagggctaacaacggcaaggggggagaaggcaccgtcgtgcccatttgcctgcccaaggatgccctggagaagttccagcctcgagggggaaggccttaacggcgagcttttaccgatagagcgccgcgcaccaac

SEQ ID NO: 4174 - DNA, 1654 bp, Oryza sativa
tccacgaacacactactacgaccacctttcatcccaacgcacatacgcacctacgcatcactcaatcgatcaacaatggcgtcgtctccactgccggcgttcacggtgcggcgaggcgagccggtgctggtgacaccggcggcgccgacgccgcgggaggtgaaggcgctgtccgacatcgacgacggcgagggcatgcggttctacagctcgggcatccacctgtaccgcaacaacccggccaagaaggggcaggacccggccatggtgatccgggaggcgctggccagggcgctcgtcccgtactaccccctcgccggccgcctccgcgaggaggccggccggaagctcgtcgtcgagtgcgccggccagggcgtcatgttcgccgaggccgatgccgacctcaccgccgacgacttcggcgacgtgcagagcccgccgttcccttgcttcgagcggttcatcctcgagagcaccaccgtcgccggcgtcgagccggtggtcggccgcccgctgctctacatccaggtgacgaggctgcggtgcggcggcttcatcttcgggcagaggttctgccactgcgtggtggacgcgccgggcgggatgcagttcgagaaggccgtgtgcgagctcgcgcgcggcgccgccgcgccgtcggtgtcgccgtcgtgggggagggagatgttcatggcgagggacccgccgcggccgtcgtacccgcacctcgagtaccgcgagccggcgggcggcgcggaccggctgctggcgacgccgccggaggacatggtgcgcgtgcccttcttcttcgggccgcgcgagatcgccgggctgcgccagcacgcgccggcgagcgtccgcggcgcatgctcccggttcgagctcgtcgcggcgtgcatctggcgcagccgcacggcggcgctcgggtacgcccccggcgaggaggtgcggctctccttcatcgtgaacgcccggggccgcgccgacgtgccgctcccggaggggttctacgggaacgcgttcgcctactccgttgcggcgacgaccgccggcgagctctgcggcggcgacctcgggtacgcgctggggctggtgaagaaggccaagtcggcggtgacgtacgagtacctgcagtcggtggcggacctgatggtggtcgccgggcggccgctgttcgcgctgtcgcggacgtacatcgtctccgacgtgagccacgccgggttcaagagcgtcgacttcgggtggggggaggccgtctacggcggtccggcgaagggcggcgaagggccgctcctcggcgtcaccaactacttctcgaggtccaagaatggcaagggcgagcagagcgtcgtcgtgcccatctgcttgcccaaggacgccatggacaagttccagctcgaggtccaagctctcaccgccgagctcagctagaccattgaaacgcagcatgtgtgttctactgttacttttttttttttttgcccaagtgtgttctactgctcttgttttttcttggttcagaatgtacttatacctgtcggtgtctgataaaaattgcactgactatgtactactaatgacgatgtcctatcgtgttcaaaaaatatactctgtctgtcccaaaatataaatatttttagtataatgataaattaaa

SEQ ID NO: 4175 - DNA, 1712 bp, Brachypodium distachyon
acggcaccacacgtacacttccacatcttacgtacaaattcacctgctagctctccttgagttccatcgctgcgctagctatccaatggcgtcctcactcctcccggcgttcacggtgcggcgaggcgagccggtgctggtctccccgtcggcgccgacgccgcgggagacgaagccgctgtccgacatcgacgacggcgagggcatgcggttctacagctccggcatccacctgtaccgtgccaaccctgacaagcggggccaggacccggccgccgtgatccgggaggcgcttgctaaggcgctcgtcctttactacccgctcgccggccgcctgaaggaggaggccggcaggaagctcgtggtggagtgcggcgcgcagggcgtcatgttcgtggaggccgaggccgacctgaccgccgccgacttcggcgacgtgcagagcccccccttcccttgcttcgagcagttcatcctcgagagcaccaccgtcgccggcgtcgagcccgtcatcgaccgccctctgctctacattcaggtgacgaggctcaagtgtgggggcttcatcttcgggcagcggttctgccactgcgtggtggacgcgccggggggcatgcagttcgagaaggcgatctgcgagctggcgcgcggggcagccacgccgtcaatcaccccgtcctggggcagggagatgttcatggcacgccaacaacaacaaccctcctacccgcacctggagtacagcgagccgtcgggcggcgggccagagccagaccggatgctaacaacccccgcaagcgacatgtcccgcgtgcccttcttcttcgggcccaacgagatcgcggggctccggcaacgcgcgccgccgcacatgcgaggcgccacgtcccggttcgagctcgtggccgcctgcgtctggctctgccgcacggcggcgctcgggtacggcgcggacgaggaggtccggctctcgttcatcgtgaacgcccgtggccgcaaggacgtgccgttgcccgaagggttctacgggaacgcgttcgcgtactccgtggcggcggccacggccggcgagctgtgcgctggcgggatgggcttcgcgctggagctggtgaagaaggccaagtctgccgtgacttacgattacttgttgtccgtggcggacctgatggtgagcaggggcaggccgctatttgccttgacgaggacgtacatagtctcggatgtgagccatgccgggttcaagagcgtggatttcgggtggggcgagcctttgtatggtgggccggcgaaaggtggggaaggcccgcttcctggcgtgacgaattatttctccaggtcgaagaatgggaagggggaggagggcaccgtggtgcctgtatgtctgcccaaggatgccatggagaagtttcagcttgaggtccagggactcaccgcccagcagctctaggcgcgcgcatgcatgaacgaacgtcccaaacgctataccacatacttatgttctctcacgtcgtacgtgccgggcgtaattccatgggtgctattctgttttctgatcactgattaagtttttcttttgctcgttaaacttatctgtgtgtgtggtttgtacaagtacgaacggtatagtgtacgcatgttctatatatccgtgcaatttgtatgcaattgatataaccgaataagatatgaaaggttgtgcggctgcatgagta

SEQ ID NO: 4176 - DNA, 407 bp, Helianthus annuus
gctcttccgatctgaaggattgatcgagatctcggagttttaagttgtggaaactgcggttgcggctctggttgcaagtgcggtaacggctgtggtgggtgcaagatgtacccagaaatggtctcaggtgagagtactaacaatgagacacttattcttggtgttgcacctactgaaactggaatagagaccaccggaggcgtggcaacagcggctgagaacgaaggatgcaaatgcaacccttgcacatgtaatccatgcacctgcaaatcagttatgggcatgccaactatggagtgtcatcggtcatatgtaactctactaaaactagctaaacatccttggataccatgactatggagtttcatcagttatggaaagtatcaaagctgtttgtttgttctagt

SEQ ID NO: 4177 - DNA, 403 bp, Parthenium argentatum
caaacaaaaaaaactgctttttgttgctttgatactttctccttaactaaataaaataaatctgtgatttatctcttgatcttctttcaagcaacaatgtcttcttcttgctgtggtgaaaactgtggttgcggctccggttgcaagtgtggtaacggctgtggcgggtgcaagatgtacccagacgtctctggtgagagcaccacgaccgagacacttattcttggtgttgcacctactaagactggagtagagacccatgaaggcgtggcggcggctgagaacggaggatgcaaatgcaacccatgcacatgtaatccatgcacctgcaagtgagttatgggcatccatgctagctaaggttgtttagctagttagttacatatataactagtatttgtag

SEQ ID NO: 4178 - protein, 131 aa, Nicotiana tabacum
MLHVARAISEKSPGSNMEKYKIFAALAKVSVEIDDTDYSLIACFKALAVLEHLLECDHHHIINLNLQVRFAFELESMIGDAKAISLFKSRIENLKRASEDLLADNGDDASFTEVGSEKSFPAKEIRFLTDT

SEQ ID NO: 4179 - protein, 123 aa, Saccharum officinarum
MRTQALFFLTFALLAVLAQSSNRHHHHHHSHVQSRGQGGGGGGELASRGKAAARAWPCCDSCGGCTKSEPRRCQCLDAVPRGCHPACRDCVKSSLSADPPVYQCMDRVPNFCQRRCTAPAAAH

SEQ ID NO: 4180 - protein, 127 aa, Saccharum officinarum
MRTQVLFFLTFALLAVLAQSSNRHHHHHHHSHVQSRGQGAGGEGGGGKLASRGKAAARAWPCCDSCGGCTKSEPRRCQCLDAVPRGCHPACRDCVKSSLSADPPVYQCMDRVSNFCQRRCTAPAAAH

SEQ ID NO: 4181 - protein, 128 aa, Zea mays
MRTQALFFLALALLGAVLAQSSNRHHHHYHHAHVQSKGQGAGGGGGELASRAKAAARAWPCCDSCGGCTRSEPPRCQCLDAAPRGCHPACRDCVKSSLSADPPVYQCMDRVPNFCQRRCTAAAAAAAH

SEQ ID NO: 4182 - protein, 123 aa, Panicum virgatum
MRTQVFFLTFALLAVLGQSSNRHHHHHHHSHVQSKGHGGGGGGGELASRGKAAARAWPCCDNCGGCTKSNPAQCRCLDAAPRGCHPACRDCVKSSLSADPPVYQCMDRVPNFCSRRCSAAAAH

SEQ ID NO: 4183 - protein, 121 aa, Setaria italica
MRTQVFFLTFALLAVLAQSSNRHHHHSHVQSKGHGGGGGGGGELASRGKAAARAWPCCDNCGGCTKSIPPLCQCLDAVPRGCHPACQDCIKSSLSADPPVYQCMDRVPNFCDRRCTAAAAH

SEQ ID NO: 4184 - protein, 124 aa, Panicum virgatum
MRTQVFFLTFALLAVLGQSSNRHHHHHHSHVQSKGHGGGGGGGELASRGKAAARAWPCCDNCGGCTKSNPAQCRCLDAAPRGCHPACRDCVKSSLSADPPVYQCMDRVPNFCSRRCSAAAAAAH

SEQ ID NO: 4185 - protein, 127 aa, Zea mays
MRSQALFFLTIALLTVLARSSNRHHHHHSHVQSRGQGAASGGGGGGELASRGKAAARAWPCCDSCGGCTRSEPRLCRCLDAAPRGCHPACRDCVKSSLSADPPVYQCMDRVPDFCLRRCTAPAAAAR

SEQ ID NO: 4186 - protein, 371 aa, Solanum phureja
MEKNEVMKMKSSESQVMDGSDIMKLVGNEAVFSNFVDHKFQELDIDKDGKLSVKELQPAVADIGVALGLPPQGSSPESDHIYSEVLQEFTHGKQEKVSKTEFKEVLSDILLGMAAGLKRDPIVLLRMDGEDLLEFVKSPAFEPEMLSLYSELELPDGSLKDYIIKAFEKLTVDQGMPPASDSWVMSNVVEPVVESCIGASNDQPVTQETFLAEFKKVAESAAQRLKEQPVIVAHSENTFDGSGIKRLLSNKFELDKTLDSALKTIPRDRHGKMSKEYLRVALDVLAPSAGLPPIGAVDQMDKVIQEVCKMLDADDGKMVKEEEFKKLLTEILGSMMLQLEGNPVSVSTNSVVHEPLASSSTLLQPPSISEM

SEQ ID NO: 4187 - protein, 355 aa, Solanum tuberosum
MDGSDIMKLVGNEAVFSNFVDHKFQELDIDKDGKLSVKELQPAVADIGVALGLPPQGSSPESDHIYSEVLQEFTHGKQEKVSKTEFKEVLSDILLGMAAGLKRDPIVLLRMDGEDLLEFVKSPAFEPEMLSLYSELELPDGSLKDYIIKAFEKLTVDQGMPPASDSWVMSNVVEPVVESCIGASNDQPVTQETFLAEFKKVAESAAQRLKEQPVIVAHSENTFDGSGIKRLLSNKFELDKTLDSALKTIPRDRHGKMSKEYLRVALDVLAPSAGLPPIGAVDQMDKVIQEVCKMLDADDGKMVKEEEFKKLLTEILGSMMLQLEGNPVSVSTNSVVHEPLASSSTLLQPPSISEM

SEQ ID NO: 4188 - protein, 361 aa, Nicotiana tabacum
MEKNEVMDGSDIMKLVGNEAVFSNFVDHKFEELDIDQDGKLSVKELQPAVADIGVALGLPAQGSSPESDHIYSEVLQEFTHGKQEKVSKTEFKEVLSDILLGMAAGLKRDPIVLLRMDGEDLVEFVKSPAFEPEILSIFSEIELPDGSLKDHIIKAFEKLTVDQGMPPASDSWVMSNVVEPVVESCIGASNEQPVSQETFLAEFKKVAESAAQRLKEQPVIVAHSENTFDGSGIRRLLSNKFELDKALDSAAKTVPKDRHGKMSKEYLRVALDLLAPSAGLPPIGAVDQMDKIIIEACKMLDADDGKMVKEEEFKKLLTEVLGSMMLQLEGNPVSVATNSVVHEPLASASTLLQPPSNSEM

SEQ ID NO: 4189 - protein, 355 aa, Petunia hybrida
MDGSDIMKLVGNEAVFSNFVDHKFEELDIDKDGKLSVKELQPAVADIGVALGLPAQGSSPDSDHIYSEVLQEFTHGKQEKVSKTEFKEVLSDILLGMAAGLKRDPIVLLRMDGEELLEFVKGPSFEPEMLSLFSEIQLPDGMSLKDYIIKAFEKLTVDQGMPPASDSWVMSNVVEPVVESCIGESQQPVSQETFLAEFKKIAESAAQRLKEQPVIVAHTENTFDGSGIRRLLSNKFELDKTLESAVKIVPRDRHGKMSKEYLRVALDLLAPSAGLPPIGAVDQMDKVITESCKMMDADDGKMVKEEEFKKLLTEILGSLMLQLEGNPVSVSTNSVVHEPLASASTLLQPPSNSEM

SEQ ID NO: 4190 - protein, 80 aa, Solanum phureja
MKNTSKSSKITPKSGQDARKDRRSATGVSGSPKKGGHGGKFTWAGDGSYSSKKEAADVVVVVDANDPNFDEPEENPIDES

SEQ ID NO: 4191 - protein, 73 aa, Solanum tuberosum
SSKITPKSGQDARKDRRSATGVSGSPKKGGHGGKFTWAGDGSYSSKKEEADVVVVDANDPNFDEPEENPIDES

SEQ ID NO: 4192 - protein, 82 aa, Solanum phureja
KKSLKNTSKRSKIIPKSSQDVRKDRRSDPEISGSLKKGGHGGKFTWAGDGSYSSKKEEADVVVVNANDPNFDEPEENPIDES

SEQ ID NO: 4193 - protein, 353 aa, Solanum phureja
MPPNPRVDRAFRSMKALGISGEKVKPVLKNLLRLYNKNWDLIEAENYRVLADAIFDDDEAKDAESKKSTEDTEQEALVQDEPEPPLKRQRLKNQSSQPNESLESQLQNQSPSVFDSPQSMGNESQPGSRPSLDRNKGKQPMFSDSLVPQEGLPSSQPSDVDKSLPVPRRAGSTSGSGIPVSPTKDAIANHTFIKPKDEPITDDLPRLEVPVAIIRPGSSSKGKSSVASSSKGRQDDSNASATVVEADTNDGNPPSPGVANGKPETNTVKPSSALEIASSQSGEVKIILNYGSVLGRSDFHLPTLDAVVKLMDDKCLKEYKELDPNFSVMKIMTDICQCFWEMSSESTNKSSDE

SEQ ID NO: 4194 - protein, 235 aa, Unknown
  Sequence found in Organisms: Solanum tuberosum, Solanum phureja
MATPSVQQIRPASLDSTSEPPALFDGTTRLYISYICPFAQRAWITRNFKGLQDKIELVPIDLQNRPVWYKEKVYPQNKVPSLEHKNKVIGESLDLVKYIDSNFEGPSLLPDDPEKQKFAEELIAYSDTFLKEIYGNFKGDIEKHAGPQFDYLEKALDKFDDGPFFLGQFSQADIVYAPFVERFQIFLKEVFDYDITSGRPKLAKWIEELNKLDSYIQTKADPKEVVDLYKKKYLA

SEQ ID NO: 4195 - protein, 235 aa, Solanum melongena
MATSSVEEIRPASLDSTSEPPPLFDGTTRLYISYVCPFAQRAWIIRNVKGLQDKIKLVPIDLQNRPDWYKEKVYPQNKVPSLEHNNKVIGESLDLIKYIDSNFEGLSLLPDDPEKQKFAEELIAYSNTFLKEIYGSFKGDIEKQAGSQFDYLEKALDKFEDGPFFLGQFSQADIAYAPFIERFQIFLKEVFNYDITSGRPKLAKWIEEVNKLDGYIQTKADPKAVVDSYKKRFLA

SEQ ID NO: 4196 - protein, 235 aa, Capsicum annuum
MATPSVQEIRPSSLLSTSEPPSLFDGTTRLYISYICPFAQRAWITRNVKGLQDKIELVPIDLQNRPAWYKEKVYPQNKVPALEHNNKVIGESLDLIKYIDSNFEGPSLLPDDPEKQKFAEELVAYTDTFLKEIYGSFKGDVEKQAGPQFDYLEKALEKFDNGPFFLGQFSQADIAYASFIERFQIFLQEVFNYDITSGRPKLAKWIEELNKIDGYIQTKADPKKVVEIYKSRFMA

SEQ ID NO: 4197 - protein, 287 aa, Solanum phureja
MSDNRSQRRRVGESSESGIYNERILILVFASMNWDIRTLCQTASVNRKLRAVARRILWRELCVYRAPQMITALTDGSPSGRIGGGWQAMAKLMFFCNGCQSTRHFQVRESPSGHFVKTSRFSKTSGRSFLVKKCRSDLLYVSDPCEHPTGSDDLGLFRGVFWGFMKSRTRASLIRRRVELEEGAKCPFCRARVWSMTAARLIPKSAARRLGSMETGLEYFVCVNGHLYGACWLVPLSSDEGEEKDGDDEDEAEDSSEEADQRFDGGGYFHRGNQIVINGCLNYGLTS

SEQ ID NO: 4198 - protein, 284 aa, Solanum tuberosum
VNNRSQRRRVGESSESGIYNERILILVFASMNWDIRTLCQTASVNRKLRAVARRILWRELCVYRAPQMITALTDGSPSGRIGGGWQAMAKLMFFCNGCQSTRHFQVRESASGHFVKTSRFSKTSGRSFLVKKCRSDLLYVSDPCEHPTGSDDLGLFRGVFWGFMKSRTRASLIRRRVELEEGAKCPFCRARVWSMTAARLIPKSAARRLGSMETGLEYFVCVNGHLYGACWLVPLSSDEGEEKDGDDEDEDSSEEADQRFDGGGYFHRGNQIVINGCLNYGLTS

SEQ ID NO: 4199 - protein, 117 aa, Pseudoroegneria spicata
  misc_feature (85)..(85): Xaa can be any naturally occurring amino acid
  misc_feature (115)..(115): Xaa can be any naturally occurring amino acid
MQAAKDKVKDGASAAKAKTKITQAKAAEKAEAATARSHAERELAHERGKAKVAAAKMELHQDKALHREEAIEHRIHKHGGHGHHXHKHGVGIVAAPPPATGAGAYYPPPAAGGHXTN

SEQ ID NO: 4200 - protein, 120 aa, Festuca arundinacea
MQAAKEKVKDGVSAVKAKTKITRAKAEEKAEAATARSHAERELAHERGKAKVAAAKMELHQDKALHREEAIEHRIHKHGATGCLGGHGHARHNKHGVVAAPAPPPGAGAYYPPAAGAGHY

SEQ ID NO: 4201 - protein, 217 aa, Gossypium hirsutum
MAGGACIGRQRATPFVLSSSPLFFRVRSLHSHSHPLLRFTSFPNPKTGFKYQIRAIQEVTADTVKSQKGKEDDEQSSPQNWKIKMLYDGDCPLCMREVDMLRERNKQYGTIKFVDISSDDYSPEENQGLDYGRIHAILSDGTVVTDVEAFRKLYEQVGLGWVYAITKYEPIATIADSIYGVWAKYRLQITGRPPLEEVLETRRKKKADICNDNNCKI

SEQ ID NO: 4202 - protein, 170 aa, Arnica chamissonis
MKEIAGNPLHLKSLNHISLVCRSVEESIDFYTNVLGFVPIRRPGSFDFDGAWLFNYAIGIHLLQSENPNNMPKKNEINPKDNHISFQCESMGAVEKKLKEMGIAYKRQRVEEGGIYVDQLFFHDPDGFMIEICNCDNLPVIPIAGEVVRSCSRLNLDIISQKQIQTFVQL

SEQ ID NO: 4203 - protein, 170 aa, Artemisia annua
MKDTAGNPLHLKSLNHISVVCKSVEESIDFYTNVLGFFPIRRPGSFDFDGAWLFNYGIGIHLLQSEKPDNMTKKLEINPKDNHISFQCESMGAVEKKLKEMGITYKRQRVEEGGIYVDQLFFHDPDGFMIEICNCDNLPVIPLAGEMVRSCSRLNLDIISQKQIQTFVQL

SEQ ID NO: 4204 - protein, 171 aa, Helianthus annuus
MKEVAGNPLQLKSINHISLVCRSVEESIDFYTNVLGFVPIRRPGSFDFDGAWLFNFGIGIHLLQSENPENMSKKSEINPKDNHISFQCESMGTVEKKLKEMEIVYKRQRVEEGGIYVDQLFFHDPDGFMIEICNCDNLPVIPIAGEMVRSCSRVNLDIIIPQKQIQTFVQM

SEQ ID NO: 4205 - protein, 170 aa, Parthenium argentatum
MKEVAGNPLQLKSLNHISLVCRSVEESINFYTNVLGFVPIRRPGSFDFDGAWLFNFGIGIHLLQSENPNNMSKKNEINPKDNHISFQCESMGTVEKKLKEMEIVYKRQRVEEGGIYVDQLFFHDPDGFMIEICNCDNLPVIPIAGEMVRSCSRVNLDIIPKKQIQTFVQM

SEQ ID NO: 4206 - protein, 170 aa, Cynara scolymus
MKETAQNPLHLKSLNHISLVCQSVEESIDFYTNVLGFAPIRRPGSFDFSGAWLFNYGIGIHLLKSENPDNIPKKSEINPKDNHISFQCESMGAVEKKLKDMGIDYKRQRVEEGGIYVDQLFFHDPDGFMIEICNCDNLPVIPLAGDMVRSCSRLNLEIISQQQIQTFVQL

SEQ ID NO: 4207 - protein, 172 aa, Carthamus tinctorius
MKETAENPLHLKSLNHISLVCQSVEKSIDFYTNVLGFAPIRRPGSFDFSGAWLFNYGIGIHLLQSENPDHVPKKSEINPKDNHISFQCESMGAVEKKLKDMEINYKRQRVEEGGIYVDQLFFHDPDGFMIEICNCDNLPVIPLAGDMVRSCSRLNLDIISQQQQIQQTFVQL

SEQ ID NO: 4208 - protein, 173 aa, Cichorium intybus
MKEIAGNPLHLKSLNHISLVCRSVEESINFYTNVLGFVPIRRPGSFDFDGAWLFNYGIGIHLLQSENPDNMTKKSEINPKDNHISFQCESMGAVEKKLKEMEIVYKRQRVEEGGIYVDQLFFHDPDGFMIEICNCDNLPVIPLAGEMIRSCSRLNLDIISQQQTTKFCSAVTQ

SEQ ID NO: 4209 - protein, 97 aa, Arnica chamissonis
MKEIAGNPLHLKSINHISLVCRSVEESIDFYTNVLGFVPIRRPGSFDFDGAWLFNYGIGIHLLQSESPNNMPNKTEINPKIIIYLSSVRAWERWRRC

SEQ ID NO: 4210 - protein, 172 aa, Centaurea maculosa
MKETGENPLHLKSLNHISLVCQSVEKSIDFYTNVLGFAPIRGPGSFDFSGAWLFNYGIGIHLLQSENPEDVPKKSEINPKDNHISFQCESMGAVEKKLKDMEINYKRQRVEEGGIYVDQLFFHDPDGFMIEICNCDNLPVIPLAGDMVRSCSRLNLDINISHQQQIQTFVQL

SEQ ID NO: 4211 - protein, 173 aa, Taraxacum officinale
MKEAAGNPLHLKSLNHISLVCRSVEESIDFYTNVLGFFPIRRPGSFDFDGAWLFNYGIGIHLLQAERPDNLPKKREINPKDNHISFQCESMGAVEKKLKEMEIVYKRQRVEEGGIYVDQLFFHDPDGFMVEICNCDNLPVIPLAGEMIRSCSRLNLDILSQKQNTTICSAVTQ

SEQ ID NO: 4212 - protein, 173 aa, Lactuca sativa
MKETAGNPLHLKSLNHISLVCRSIEESINFYTNVLGFIPIRRPGSFDFDGAWLFNYGIGIHLLQSEHPDNMPKKTEINPKDNHISFQCESMGAVEKKLKEMEIVYKRQRVEEGGIYVDQLFFHDPDGFMVEICNCDNLPVISLAGEMIRSCSRINLDIISQQQSPNMCSAVTQ

SEQ ID NO: 4213 - protein, 170 aa, Theobroma cacao
MKENVDNPLHLKSLNHVSLVCRSVEESINFYQNILGFVPIRRPGSFDFNGAWLFGYGIGIHLLQSEDPDNMPKKKKINPKDNHISFQCESMGAVEKKLKEMELEYVRAMVEEGGIYVEQLFFHDPDGFMIEICNCDNLPVIPLAGEMVRSCSRLNLQMLQHQQIQRVVQQ

SEQ ID NO: 4214 - protein, 172 aa, Ricinus communis
MKENTGNPLHLKSLNHISLLCRSVEESIDFYQNVLGFVPIRRPGSFDFDGAWLFGFGIGIHLLQSEDPENMPKKSEINPKDNHISFQCESMGAVEKKLKEMEIKYVRATVEEGGIHVDQLFFHDPDGFMIEICNCDSLPVIPLAGEMARSCSRVNLQMIQHNKQMHQVVQQL

SEQ ID NO: 4215 - protein, 171 aa, Euphorbia esula
MKDNMGNPLHLKSLNHISLVCRSVEESINFYQNVLGFFPIRRPGSFNFDGAWLFGFGIGIHLLQSEDPENLPKKVEINPKDNHISFQCESMGAVEKKLKEMEIKYVRSMVEEGGIHVDQLFFHDPDGFMIEICNCDNLPVIPLAGEMVRTCSRVNLQILQHTQQIQQVVQQ

SEQ ID NO: 4216 - protein, 164 aa, Gerbera hybrid cultivar
PLQLKSLNHISLVCRSIEESIDFYTNVLGFVPVQRPGSFDFNGAWLFSYGIGIHLVQSEDPDNLPKKSAINPKDNHISFQCESMGAVEKKLKEMEIKYKRQRVEEGVICVDQLFFHDPDGFMIEICNCDNLPVVPLAGNMVRSCSRLNLDIMSQQQQRHTIVHL

SEQ ID NO: 4217 - protein, 170 aa, Gossypium hirsutum
MKESMGNPLHLKSLNHISLVCRSVEESMNFYQDILGFAPIRRPGSFDFNGAWLFGYGIGIHLLQSEDPESLPKKKEINPKDNHISFQCESMGAVEKKLKEMELEYVRAIVEEGGIYVEQLFFHDPDGFMIEICNCDNLPVVPLAGEMPRSCSRLNLQHMQRQQIQQVVQQ

SEQ ID NO: 4218 - protein, 170 aa, Glycyrrhiza uralensis
MKESVGNPLHLKSVNHISLICRSVEESMDFYQNVLGFFPIRRPGSFDFDGAWLFGYGIGIHLLQAENPEKLPRKKEINPKDNHISFQCESMGAVEKKLKEMEIDYARATVEEGGIQVDQLFFHDPDGFMIEICNCDSLPVIPLVGEVARSCSRLNLQIMQNQQQIHKMVQ

SEQ ID NO: 4219 - protein, 170 aa, Fragaria vesca
MKETLGNPLHLKSLNHISLICRSVEESIAFYQNVLGFVPIRRPGSFDFDGAWLFGYGIGIHLLQSEEPEKMPKKTEINPKDNHISFQCESMGAVEKKLKEMELKYKRSMVEEGGIHVDQLFFHDPDGFMIEICDCDNLPVIPLAGEMARSCSLVNLPMLQHQQQIRVTQQ

SEQ ID NO: 4220 - protein, 172 aa, Prunus persica
MKETMGNPLHLKSLNHISLICRSVEQSIDFYQNVLGFVPIRRPGSFNFDGAWLFGYGIGIHLLQSEDPESMPKKTEINPKDNHISFQCESMGAVEKKLKEMELKYKRAMVEEGGIHVDQLFFHDPDGFMIEICDCDNLPVIPIAGEIARSCSLVNRPMLQQKQQQQLRLLQQ

SEQ ID NO: 4221 - protein, 92 aa, Unknown
  Sequence found in Organisms: Solanum tuberosum, Solanum phureja
MKQRSNFVAIFLVLFLSELLVTEAVTCSVTELFPCAGAIMSSQPPSSACCIKLREQKPCLCGYLKNPSLKQYVNSPNAQRVAKTCGVSTPSC

SEQ ID NO: 4222 - protein, 70 aa, Triticum aestivum
MVNAIKGLFISCDIPMAQFIVNMNASMPASEKFIVHILDPTHMFIQPNMGDYIKSKMAEFRDQNSYEKPT

SEQ ID NO: 4223 - protein, 70 aa, Avena sativa
MVNAIKGLFVSCDVPMAQFIVNLNASMPASERFIVHILDPTHMFIQPHMGEYIKSKMAEFRDQNSYEKPT

SEQ ID NO: 4224 - protein, 70 aa, Brachypodium distachyon
MVNAIKGLFISCDVPMAQFIVNLNASMPASEKFIVHMLDPTHMFVQPHVGEMIRSKIAEFRDQNSYEKPT

SEQ ID NO: 4225 - protein, 70 aa, Oryza sativa
MVNAIKGLFISCDVPMAQFIVNLNASMPASDKFILHMLDPTHMFVQPHVAEMIRSKISEFRDQNSYEKPT

SEQ ID NO: 4226 - protein, 70 aa, Saccharum officinarum
MVNAIKGLFISCDVPMAQFIVNLNASMPASDRFIVHMLDPTHMFVQPHVAEMIRSKIAEFRDQNSYEKPQ

SEQ ID NO: 4227 - protein, 70 aa, Unknown
  Sequence found in Organisms: Citrus sinensis, Citrus clementina, Citrus sinensis
MVNAIKGLFISCDIPMAQFIINMNASMPQSQKFIIHILDSTHLFVQPNMAEMIRSAIAEFRDQNSYEKPA

SEQ ID NO: 4228 - protein, 70 aa, Citrus sinensis
MVNAIKGLFISCDIPMAQFIINMNASMPQSQKFIIHILDNTHLFVQPNMAEMIRSAIAEFRDQNSYEKPA

SEQ ID NO: 4229 - protein, 71 aa, Cynodon dactylon
MVNAIKGLFISCDIPMAQFIVNLNASMGGGERFIVHMLDPTHMFVQPHVGDFIRSKIAEFRDQNSYEKPQG

SEQ ID NO: 4230 - protein, 70 aa, Oryza sativa
MVNAIKGLFISCDVPMAQFIVNLNASMPASDKFILHMLDPTHMFVQPHVAEMIRGKISEFRDQNSYEKPT

SEQ ID NO: 4231 - protein, 70 aa, Panicum virgatum
MVNAIKGLFISCDIPMAQFIVNLNASMPASERFIVHMLDPTHMFVQPHVAEMIRSKIGEFRDQNSYEKPQ

SEQ ID NO: 4232 - protein, 927 aa, Brachypodium distachyon
MNVFAGVGAGAKEGGPARGGGGVLLELTPHKMALCHLVQVFAPSGQQAQAGPPFPFESVAHHNRLGLFLFSLTRSCEDFLEPPLDELLRQLKAVDDLANGWLCDQLTTTLTGLNSPDDLFNFFDKLRGVLTSPDGANVEDEFLDPNSQLGVFLRCCILAFNSMTFEGVCHLLANLVVYCSSADTSYDLAEDEDFNSEMEMSDLMDADIGVSAGMFDKYSQGYATESHMGESSSSLIHAPTTLHNFDEANIFKADDNPTCLRSRWQLEAYLNQQADILEKDPSSVPLNSFNATMTQLQTLAPELHRSQFFWFISYPCSICQVQFLQYLNAVSHDDYVASLDNLHRYFDYSAGMQGLFSRSLSQFQDVIVGKYESALLCLGNLHCHFGHPKKALEAFTEAVRVSQMNNDDSCLAYILGAISNLLSKIGISNAVGIIGSPYSLGNNIGLGTPLSIQQQLLVLLKRSLKRADMLKLTSLLSFNHISLAKFNLKHVQRPLVSFGPNASTKLRTCPADVFKNLRLSSHVLSDFGTDGLSTSNDNGSFSTSWLRNLSAASSSWCSSSTKSRKLLTNDFDNFHFHAQPSPIPTSVLQLAGSTYLMRATAWEHYGSAPMVRMNALVYATCFADAASSSELSLAYVKLIQQQAVFKGYSAAFCALKLTEEKFPSSTNSNIQLLRMQLLHERALHRGHLRVAQQICDEFGVLSSSVSGVDIELKTEASLRRARTLLAAKQFSQAAIVAHTLFSTCYKYNMQVENASVLLLLAEIHKKSDNAVLGLPYALASQSFCKSFNLDLLEASATLTLAELWLALGPSHVKRALSLVYQSLPMILGHGGLELRARAQIVLAKCHLTDPEFTVSEDPCAVLDPLNQAAEDLQVLEYHEMAAEAYYLKAMTYNHLGKEVEREEAAACFKEHVTALENPHNEDVSLAY

SEQ ID NO: 4233 - protein, 947 aa, Oryza sativa
MNVFAGVGGGAAGKEAGTVGGGALLELTPHKLALCHLVQVFAPPPQAGVSAPALPFPFESVAHHNRLGLFLFALTRSCEDFREPPLEELLRQLKAVDALVNGWLCEQLTSTLSALTSPDDLFNFFDKLRGVLSAPEGANVEDEFLDPNSQLGVFLRCCILSFNTMTFEGVCHLLANLVEYCNSADTSYDLAEDEDFNSEMEMSNFMDTNMHVRDGVFDKYNQGYAPRSHMVDSSSSLVHAPASLHDFEEANMFKADDNLGPTCLRSRWQLEAYLNQQADILEKDPSSVPLNSFNATMSQLQKLAPELHRNCEEFLVTMVYFDLYSTCQVQFLQYLNALTHDDYVAALDNLHRYFDYSAGMQGLFSRTASPFQDIIVGKYESALLCLGNLHCYFGHPKKALEAFTEAVRVSQMNNDDSCLAYILGAISNLLSKIGMSSTVGTIGSPYSLGNNIGLGTPLSIQQQLLVLLKRSLKRADTLKLTSLLSFDHLSLAKFDLKHVQRPLVSFGPNASTKLRTCPADVCKNLRLSSRVLTDFGTDGLSASNDNGSFSTSWLRNLSAASNSWCSSSKKSGKLLTNDFDNFHFHAQPSPIPASVLQLAGSAYLLRATAWEHYGSAPMVRMNSLVYATCFADAASSSELSLAYVKLIQHLATFKGYSAAFSALKLAEEKFPLSANSHIQLLKMQLLHERALHRGHLKVAQQICDEFAVLSSSVSGVDIELKTEARLRHARTLLAAKQFSQAANVANSLFSTCYKYNMQVENASVLLLLAEIQKNSDNAVLGLPYALASQSFCKSFNLDLLEASATLTLTELWLALGSTHAKRALSLVCQSLPMILGHGGLELRARAHIVLAKCYLSDPKFSEKPVPLCPFIMAVSEDPSAVLDPLNQAAEDLEVLEYHEMAAEAYYLKAMVYNNLGKLDEREEAAASFKEHTLALENPYNEEDSLAC

SEQ ID NO: 4234 - protein, 602 aa, Brachypodium distachyon
MGSWWSPASVEPRSVQLLLLGVALVAASFYAGTLFQSSASPALILPPPGSRSRDSSNPQDAPEFANRVIVTYRTTPISVPDHGLDVCPLEYNEYVPCHDAAYVSKLSNLDRTRHEDLEDICPPQEKRLFCLVPPPNDYKIPIRWPTSRDYVWRSNVNHSRLSEVKGGQNWVHEHGKLWWFPGGGTHFKHGALEYIERLGNMTTNSTGDLSSAGVVQVLDVGCGVASFSAYLLSLDIHTMSFAPKDGHENQIQFALERGIGAMISVLATKQLPYPGNSFEMVHCSRCRVDWHENDGILLKEVDRLLRPNGYFVYSAPPAYRKDKDFPVIWEKLINITTAMCWKLIAKHVQTAIWLKPEDESCRQKNADTKLLNICDPNVSSSSSWKAPLLNCVRFNKDQSKMQKLPPRPDRLTFYSRNLEMIGVTPEKFENNNQFWWDQVRKYWSLLGVEKTSIRNVMDMSANYGGFAMALSNDPVWIMNIVPHTTVNTLPVIYDRGLIGSYHDWCEPFSTYPRSYDLLHAFHLFSHYQDRTDGCSMEDIMLEIDRIIRPQGFIIIRDDDTTHSRIIDLAPKFLWDVTTHSLENEENRPEQVLICRKKFWAIV

SEQ ID NO: 4235 - protein, 607 aa, Oryza sativa
MGRWWPPTSAAAATAEPRSVQLLLLGVALVAASFYAGTVFRSPSAPALLLPPSASRSPDPSRTPGAPKFTNRVSLSYRTKPISVPDYGVDVCPLKYNEYIPCHDASYISQLKKLDRSRHEDLESICPPQEKRLFCLVPPPNDYKIPIRWPTSRDYVWRSNVNHSRLAEVKGGQNWVHEKGKLWWFPGGGTHFKHGASEYIERLGNMTTNSTGDLRSAGVVQVLDVGCGVASFSAYLLPLDIHTMSFAPKDGHENQIQFALERGIGAMISVLATKQLPYPENAFEMVHCSRCRVDWHENDGILLKEVDRLLRPNGYFVYSAPPAYRKDKDFPVIWEKLMNITTSMCWKLIAKHVQTAIWIKPEDQSCRQKNADTKLLNICDSYDNSPPSWKIPLMNCVRLNKDQSNMQKLPSRPDRLSFYSRSLEMIGVTPEKFAKNNKFWRDQVSMYWSFLGVEKTSIRNVMDMNANIGGFAVALSNDPVWIMNVVPHTMSNTLPVIYDRGLIGSYHDWCEPFSTYPRTYDLLHAFHIFSHYQSRKEDCSLEDIMLEMDRIIRPEGFIIIRDENAILSGINDLAPKFLWDVTTHMLENEESKPEKVLVCRKKFWSIV

SEQ ID NO: 4236 - protein, 606 aa, Sorghum bicolor
MGRWWSPASAAVEPRSVQLLLLGVALVAASFYAGTLFGSSASPALVLPASRSRSPDSFSAEVADVPMFTNRVSRKYRAKPVAVPDHGVDVCPLEYNEYVPCHDASYIRSLKNLDRSRHEDLESICPPREKQLFCLVPPPNDYKIPIRWPTSRDYVWRSNVNHSHLAEVKGGQNWVHEKGKLWWFPGGGTHFKHGASEYIERLGNMTTNNTGDLRSAGVVQVLDVGCGVASFSAYLLPLDIQTMSFAPKDGHENQIQFALERGIGAMISVLATKQLPYPESSFEMVHCSRCRVDWHENDGILLKEVDRLLRPNGYFVYSAPPAYRKDKDFPVIWEKLVNITTTMCWKLIAKHVQTAIWVKPEDESCRQKKADMKLLNICESNDNVSPSWKIPLMNCVKLNKDKSNIQKLPSRSDRLSFYFKSLEMIGVAPERFEKNNQFWKNQVHKYWSFLGVEKTSIRNVMDMNANYGGFAAALSSDPVWIMNIVPHTMTNTLPVIYDRGLLGSYHDWCEPFSTYPRSYDLLHAFHLFSHYEGGKEDCSLEDIMLEMDRIIRPQGFVIIRDENHTLSRIIDLAPKFLWDVTAHMLENEDSGTDQVLFCRKKFWAIV

SEQ ID NO: 4237 - protein, 606 aa, Zea mays
MRRWWSPALAAVEPRSVQLLLLGVALVAASFYAGTLFGSSASPALVLPPSRPRSPDSFRAKVTDVPVFTNRVSRTYRAKSVTVPDHGVDVCPLEYNEYVPCHDGAYISSLKSLDTSRHEDLESICPPWEKRLFCLVPPPNDYKIPIRWPTSRDYVWRSNVNHSHLAEVKGGQNWVHEKGKLWWFPGGGTHFKHGASEYIERLGNMMTNSTGDLRSAGVVQVLDVGCGVASFSAYLLPLDIRTMSFAPKDGHENQIQFALERGIGAMISVLATKQLPYPENSFEMVHCSRCRVDWHENDGILLKEVDRLLRPNGYFVYSAPPAYRKDKDFPVIWEKLVNITTTMCWKLIAKHVQTAIWVKPEDESCRQKNVDMNLLSICESNDNISPSWKIPLMNCVKLNKDKSNIQKLPSRSDRLSFYSKSLEIIGVAPERFEKNNQFWKNQVHKYWSFLHVEKTSIRNVMDMNANYGGFAAALSSDPVWIMNIVPYTMMNTLPVIYDRGLLGSYHDWCEPFSTYPRSYDLLHAFHLFSHYKRRKEDCLLEDIMLEMDRIIRPQGFIIIRDENDTLSRIINLAPKFLWDVTTHMLENEESGTDQVLFCRKKFWAIV

SEQ ID NO: 4238 - protein, 595 aa, Pennisetum glaucum
VEPRSVQLLLLGVALVAASFYAGTLFGPSASPELVLPPSRPQSPDSSRSKVADARMFTNRVSLTYRTKPVRVPDHGVDVCPLECNEYVPCHDMAYISSLKNLDRSRHEDLESICPPQEKRLFCLVPPPNDYKIPIKWPTSRDYVWRSNVNHSHLAEVKGGQNWVHEKGKLWWFPGGGTHFKHGASEYIERLGNMTTNSTGDLRSAGVVQVLDVGCGVASFSAYLLPLDIQTMSFAPKDGHENQIQFAVERGIGAMISVLATKQLPYPGNSFEMVHCSRCRVDWHENDGILLKEVDRLLRPNGYFVYSAPPAYRKDKDFPVIWEKLVNITTAMCWKLIAKHVQTAIWVKPEDESCRQKNADMKLLNICESNDIVSPSWKIPLLNCVRLNKVKSEIKTFPSRPDRLSFYFKSLEMIGVTPAKFEKNNEFWKNQVHKYWSFLDVEKTSVRNVMDMNANYGGFAAALSNDPVWIMNVVPYTMSNTLPIIYDRGLLGSYHDWCEPFSTYPRSYDLLHASHLFSHYEGRNEDCLLEDIMLEMDRIIRPQGFIIIRDEKNTLSRIIDLAPKFLWDVSTHMLENEENGTEQVLICRKKFWAIV

SEQ ID NO: 4239 - protein, 2348 aa, Brachypodium distachyon
MAAAPPPPGTSGVAPPPPPPAGAPPPAGQPLTPAELEAQLVEKARKWHQLNSKRYGDKRKFGFVEAQKEDMPPEHVRKIIRDHGDMSSKKYRHDKRVYLGALKFVPHAVYKLLENMPMPWEQVRHVKILYHITGAITFVNEIPWVVEPIYLAQWGSMWIMMRREKRDRRHFKRMRFPPFDDEEPPLDYADNLLDVEPLEAIQLELDPEEDGAVYKWFYDHKPLVKTKLINGPSYRKWHLSLPIMATLYRLAGQLLSDLIDRNYFYLFDMESFFTAKALNMCIPGGPKFEPLYRDMEKGDEDWNEFNDINKLIIRQPLRTEYRIAFPHLYNNRPRKVKLCVYHTPMIMYIKTEDPDLPAFYYDPLINPITSTNKIDRRDRKATEEEDEEDFCLPTGVEPLLKETPLYTDTTAAGISLLFAPKPFNMRSGRTRRAEDIPLVSEWFKEHCPPAYPVKVRVSYQKLLKCYVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLLVYKWCQGLNNLQDIWDTSDGQCVVMLQTKFEKFFEKIDLTLLNRLLRLVLDHNIADYVTAKNNVVLSYKDMSHTNSYGLIRGLQFASFVVQYYGLVLDLLLLGLTRASEIAGPPQMPNEFLTYTDAKVETRHPIRLYSRYIDKVHIMFRFTHEEARDLIQRYLTEHPDPNNENMVGYNNKKCWPRDARMRLMKHDVNLGRSVFWDMKNRLPRSITTLEWENSFVSVYSKDNPNLLFSMSGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHRWQMSKPSLVSESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPTLNDEQWLKVECALRDLILSDYAKKNNVNTSALTQSEIRDIILGAEIAPPSQQRQQIAEIEKQSRETTQLTAVTTRTTNVHGDELIITTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMVPDNAPWNYNFMGVKHDPLMKYSMKLGTPRDFYHEDHRPTHFLEFSNIDEGEVAEGDREDTFS

SEQ ID NO: 4240 - protein, 1431 aa, Hordeum vulgare
IPVYEIEPLEKITDAYLDQYLWYEGDKRHLFPNWVKPADSEPPPLLVYKWCQGINNLQDIWDTSDGQCVVMLQTKFEKFFEKIDLTLLNRLLRLVLDHNIADYVTAKNNVVLSYKDMSHTNSYGLIRGLQFASFIVQYYGLVLDLLLLGLTRASEIAGPPQMPNEFLTYTDTKVETRHPIRLYSRYIDKVHIMFRFTHEEARDLIQRYLTEHPDPNNENMVGYNNKKCWPRDARMRLMKHDVNLGRSVFWDMKNRLPRSITTLEWENGFVSVYSKDNPNLLFSMSGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADVLLFAAHRWQMSKPSLVSESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSRETNQVTAQTTRTVNVHGDELIVTTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHAKILENNKQWDGEKCIILTCSFTPGSCSLTAYKLTPSGYEWARGNKDNGSNPQGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 4241 - protein, 979 aa, Hordeum vulgare
MSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADVLLFAAHRWQMSKPSLVSESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSRETNQVTAQTTRTVNVHGDELIVTTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHAKILENNKQWDGEKCIILTCSFTPGSCSLTAYKLTPSGYEWARGNKDNGSNPQGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 4242 - protein, 709 aa, Triticum aestivum
ADVLLFAAHRWQMSKPSLVSESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSRETNQVTAQTTRTVNVHGDELIVTTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHAKILENNKQWDGEKCIILTCSFTPGSCSLTAYKLTPSGYEWARGNKDNGSNPQGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 4243 - protein, 1380 aa, Triticum aestivum
DTSNNLQDIWDTSDGQCVVMLQTKFEKFFEKIDLTLLNRLLRLVLDHNIADYVTAKNNVVLSYKDMSHTNSYGLIRGLQFASFIVQYYGLVLDLLLLGLTRASEIAGPPQMPNEFLTYTDTKVETRHPIRLYSRYIDKVHIMFRFTHEEARDLIQRYLTEHPDPNNENMVGYNNKKCWPRDARMRLMKHDVNLGRSVFWDMKNRLPRSITTLEWENGFVSVYSKDNPNLLFSMSGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADVLLFAAHRWQMSKPSLVSESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSRETNQVTAQTTRTVNVHGDELIVTTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPSNLPEHEFLADLEPLGWMHTQPNEAPQLSPQDLTSHAKILENNKQWDGEKCIILTCSFTPGSCSLTAYKLTPSGYEWARGNKDNGSNPQGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 4244 - protein, 490 aa, Avena sativa
AALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPTLTDEQWLKVECALRDLILSDYAKKNNVNTSALTQSEIRDIILGAEIAPPSQQRQQIAEIEKQSRETTQLTAVTTRTTNVHGDELIITTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPSNLPEHEFLADLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMVPDNAPWNYNFMGVKHDPQMKYSMKLGTPRDFYHEDHRPTHFLEFSNIDEGEVAEGDREDTFS

SEQ ID NO: 4245 - protein, 1029 aa, Panicum virgatum
MPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHRWQMSKPSLVSESKDLFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPTLNDEQWLKVECALRDLILSDYAKKNNVNTSALTQSEIRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPANLPEHEFLNDLEPLGWMHTQPNEAPQLSPQDLTSHAKILESNKQWDGEKCIILTCSFTPGSCSLTAYKLTPSGYEWGRSNKDNGSNPHGYLPTHYEKVQMLLSDRFLGFYMVPDNTPWNFNFMGVKHDPLMKYNMKLGMPRDFYHEDHRPTHFLEFSNIEEGEVAEGDREDTFS

SEQ ID NO: 4246 - protein, 1746 aa, Setaria italica
MYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLLVYKWCQGINNLQDVWDTSDGQCVVMLQTKFEKFFEKIDLTLLNRLLRLVLDHNIADYVTAKNNVVLSYKDMSHTNSYGLIRGLQFASFVVQYYGLVLDLLILGLTRASELAGPPQMPNEFLTYADTKIETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFKHGKIPTLKISLIQIFRAHLWQKIHESVVMDLCQVLDQELDALEIETVQKETIHPRKSYKMNSSCADILLFAAHRWQMSKPSLVSESKDLFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPTLNDEQWLKVECALRDLILSDYAKKNNVNTSALTQSEIRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICVADLRTQIAGFLYGLSPQDNPQVKEIRCIAIPPQHGTHQMVTLPANLPEHEFLNDLEPLGWMHTQPNEAPQLSPQDLTSHAKILEGNKQWDGEKCIILTCSFTPGSCSLTAYKLTPSGYEWGRSNKDNGSNPHGYLPTHYEKVQMLLSDRFLGFYMVPDNVPWNFNFMGVKHDPLMKYNMKLGMPRDFYHEDHRPTHFLEFSNIEEGEVAEGDREDTFS

SEQ ID NO: 4247 - protein, 2363 aa, Oryza sativa
MWSGGPPPPPPPPMGAAPPPPGTGAPPPPLPAAAAAAGPPGGGKPLTPAELEAQLVEKARKWHQLNSKRYGDKRKFGFVEAQKEDMPPEHVRKIIRDHGDMSSKKYRHDKRVYLGALKFVPHAVYKLLENMPMPWEQVRHVKILYHITGAITFVNEIPWVVEPIYLAQWGTMWIMMRREKRDRRHFKRMRFPPFDDEEPPLDYADNLLDVEPLEAIQLELDEEEDSAVHEWFYDHKPLVKTKLINGPSYRKWHLSLPIMATLYRLAGQLLSDLIDRNYFYLFDMESFFTAKALNMCIPGGPKFEPLYRDMEKGDEDWNEFNDINKLIIRQPLRTEYRIAFPHLYNNRPRKVRLGVYHTPMIMYIKTDDPDLPAFYYDPLINPITSTSKVDRRERRTIEEDEDEDFCLPDGVEPLLKGTELYTDTTAAGISLLFAPKPFNMRSGRTRRAEDIPLVSEWYKEHCPPAYPVKVRVSYQKLLKCYVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLLVYKWCQGINNLQDVWDTSDGQCVVMLQTKFEKFFEKIDLTLLNRLLRLVLDHNIADYVTAKNNVVLSYKDMSHTNSYGLIRGLQFASFVVQYYGLVLDLLLLGLTRASEIAGPPTMPNEFLTYADTKVETRHPIRLYSRYVDKVHIMFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWQMSKPSLVSESKDVFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSFTAFSRIVLILRALHVNNEKAKMLLKPDKTIVTEPHHIWPTLTDEQWLKVECALRDLILSDYAKKNNVNTSALTQSEIRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPANLPEHEFLNDLEPLGWMHTQPNEAPQLSPQDLTSHAKILENNKQWDGEKCIILTCSFTPGSCSLTAYKLTPSGYEWGRSNKDSGSNPHGYLPTHYEKVQMLLSDRFLGFYMVPDNTPWNFNFMGVKHDPLMKYNMKLGTPRDFYHEDHRPTHFLEFSNIDEGEVAEGDREDTFT

SEQ ID NO: 4248 - protein, 1029 aa, Oryza sativa
MPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWQMSKPSLVSESKDVFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSFTAFSRIVLILRALHVNNEKAKMLLKPDKTIVTEPHHIWPTLTDEQWLKVECALRDLILSDYAKKNNVNTSALTQSEIRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPANLPEHEFLNDLEPLGWMHTQPNEAPQLSPQDLTSHAKILENNKQWDGEKCIILTCSFTPGSCSLTAYKLTPSGYEWGRSNKDTGSNPHGYLPTHYEKVQMLLSDRFLGFYMVPDNTPWNFNFMGVKHDPLMKYNMKLGTPRDFYHEDHRPTHFLEFSNIDEGEVAEGDREDTFT

SEQ ID NO: 4249 - protein, 1197 aa, Sorghum bicolor
MRLMKHDVNLGRSVFWDMKNRLPRSITTLEWENSFVSVYSKDNPNLLFSMCGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWTMSKPSLVSESKDLFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPSLNDEQWLKVECALRDLILSDYAKKNNVNTSALTQSEMRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPTNLPEHEFLNDLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMIPDNAPWNFNFMGVKHDPQMKYNMKLGMPRDFYHEDHRPTHFLEFSNIEEGEVAEGDREDTFT

SEQ ID NO: 4250 - protein, 1286 aa, Saccharum officinarum
LILGLTRASEIAGPPQMPNEFLTYADTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSSVSVYSKDNPHLLSSMCGFEVRILPKIRMTHEAFSNTQDGVWDLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWTMSKPSLVSESKDLFDQKASNKYWIDVQLRWGDYDSHDIERYTRAKFMDYTTDNMSIYPSPTGVMIGIDLAYNLHSAFGNWFPGSKPLIQQAINKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPTLNDEQWLKVECALRDLILSDYAKKNNVNTSALTQSEMRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPANLPEHEFLNDLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMIPDNAPWNFNFMGVKHDPQMKYNMKLGMPRDFYHEDHRPTHFLEFSNIEEGEVAEGDREDTFT

SEQ ID NO: 4251 - protein, 2363 aa, Zea mays
MWNGAPPPPPPQMAAAPPPPGTTVPGAGQPPPPPPPAGAPLGGKPLTPAELEAQLVEKARKWHQLNSKRYGDKRKFGFVEAQKEDMPPEHVRKIIRDHGDMSSKKYRHDKRVYLGALKFVPHAVYKLLENMPMPWEQVRHVKILYHITGAITFINEIPWVVEPIYLAQWGTMWIMMRREKRDRRHFKRMRFPPFDDEEPPLDYADNLLDVEPLEAIQLELDEEEDAAVYEWFYDHKPLMKTKLINGPSYRKWHLSLPIMATLYRLAGQLLSDLIDRNYFYLFDMESFFTAKALNMCIPGGPKFEPLYRDMEKGDEDWNEFNDINKLIIRQPLRTEYRIAFPHLYNNRPRKVKLGIYHTPMIMYIKTEDPDLPAFYYDPLINPITSTNKVDRRERKAAEEEDDEDFCLPEDVEPLLKQTELYTDTTAAGISLLFAPKPFNMRSGRTRRAEDIPLVSEWFKEHCPPAYPVKVRVSYQKLLKCYVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLLVYKWCQGINNLLDIWDTSDGQCVVMLQTKFEKFFEKIDLTLLNRLLRLVLDHNIADYVTAKNNVVLSYKDMSHTNSYGLIRGLQFASFVVQYYGLVLDLLILGLTRASEIAGPPQMPNEFLTYADTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMSGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWQMSKPSLVSESKDVFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPSLNDEQWLKVECALRDLILSDYAKKNNVNTSALTQSEMRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAIPPQHGTHQMVTLPSNLPEHEFLNDLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMIPDNTPWNFNFMGVKHDPQMKYNMKLGMPRDFYHEDHRPTHFLEFSNIEEGEVAEGDREDTFT

SEQ ID NO: 4252 - protein, 2263 aa, Zea mays
MTSKKYRHDKRVYLGALKFVPHAVYKLLENMPMPWEQVRHVKILYHITGAITFVNEIPWVVEPIYLAQWGTMWIMMRREKRDRRHFKRMRFPPFDDEEPPLDYADNLLDVEPLEAIQLELDEEEDAAVYEWFYDHKPLMKTKLINGPSYRKWHLSLPIMATLYRLAGQLLSDLIDRNYFYLFDMESFFTAKALNMCIPGGPKFEPLYRDMEKGDEDWNEFNDINKLIIRQPLRTEYRIAFPHLYNNRPRKVKLGIYHTPMIMYIKTEDPDLPAFYYDPLINPITSTNKVDRRERKAAEEEDDEDFCLPEDVEPLLKQTELYTDTTAAGISLLFAPKPFNMRSGRTRRAEDIPLVSEWYKEHCPPAYPVKVRVSYQKLLKCYVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWVKPADSEPPPLLVYKWCQGINNLLDIWDTSDGQCVVMLQTKFEKFFEKIDLTLLNRLLRLVLDHNIADYVTAKNNVVLSYKDMSHTNSYGLIRGLQFASFVVQYYGLVLDLLILGLTRASEIAGPPQMPNEFLTYADTKVETRHPIRLYSRYIDKVHILFRFTHEEARDLIQRYLTEHPDPNNENMVGYNNKKCWPRDARMRLMKHDVNLGRSVFWDMKNRLPRSITTLEWENNFVSVYSKDNPNLLFSMCGFEVRILPKIRMTQEAFSNTKDGVWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWTMSKPSLVSESKDVFDQKASNKYWIDVQLRWGDYDSHDVERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRIVLILRALHVNNEKAKMLLKPDKTIVTEPHHIWPTLNDEQWLKVECALRDLILSDYAKKNNVNTSALTQSEMRDIILGAEIAPPSQQRQQIAEIEKQSRETTQLTAVTTRTTNVHGDELIITTTSPYEQQAFASKTDWRVRAISATNLYLRVNHIYVNSDDIKETGYTYIMPKNILKKFICIADLRTQIAGFLYGLSPQDNPQVKEIRCIAMPPQHGTHQMVTLPANLPEHEFLNDLEPLGWMHTQPNEAPQLSPQDLTSHAKILENNKQWDGEKCIILTCSFTPGSCSLTAYKLTPSGYEWGRSNKDNGSNPHGYLPTHYEKVQMLLSDRFLGFYMVPDNAPWNFNFMGVKHDPQMKYNMKLGMPRDFYHEDHRPTHFLEFSNIEEGEAAEGDREDTFT

SEQ ID NO: 4253 - protein, 565 aa, Pennisetum glaucum
LRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWQMSKPSLVSESKDVFDQKASNKYWVDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFLF

SEQ ID NO: 4254 - protein, 979 aa, Tabernaemontana elegans
MSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHKCPMSKPSLVAESKDVFDQKASNKYWIDVQLRWGDYDSHDIERYTRAKFMDYTTDNMSIYPSPTGVMISIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVSLRDLILSDYAKKNNVNTSALTQSEIRDIILGAEITPPSQQRQQIAEIEKQAKEASQLTAVTTRTTNVHGDELIVTTTSPYEQSTYASKTDWRVRAISATNLYLRVNHIYVNSEDIKETGYTYIMPKNILKKFICIADLRTQIAGYLYGISPPDNPQVKEIRCIAMPPQWGTHQHVNLPSALPEHDFLNDLEPLGWMHTQPNELPQLSPQDLTSHARILENNKQWDGEKCIILTCSFTPGSCSLTAYKLTPSGYEWGRANKDTGSNPHGYLPTHYEKVQMLLSDRFLGFYMIPDNGPWNYNFMGVKHTVSMRYSVKLGTPREFYHEDHRPTHFLEFSNLEEGETAEGDREDTFS

SEQ ID NO: 4255 - protein, 1324 aa, Castanea mollissima
NVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAEPKDVFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLTDDQWMKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICMADLRTQIAGYLYGISPPDNPQVKEIRCIAMPPQWGTHQQVNLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMMPDNGPWNYNFMGVKHAPSMKYGVKLGTPREYYHEDHRPTHFLEFSNLEEGETFAEGDREDTFT

SEQ ID NO: 4256 - protein, 2357 aa, Citrus clementina
MYNNNGNNGGPPLAPPGTSGAVPIPPPPSQPSYTVLTTTPSPQEAEARLEEKARKWMQLNSKRYGDKRKFGFVEAQKEDMPPEHVRKIIRDHGDMSSKKYRHDKRVYLGALKFIPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVRLGIYHTPMVMYIKTEDPDLPAFYYDPLIHPIPSTNKERREKKAYDDEDEDDDFFLPEQVEPLLKDTQLYTDTTAAGISLLFAPRPFNMRSGRMRRAEDIPLVSDWYKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFAPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPHMPNEFITYWDTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDMFDQKASNKYWVDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQISGYLYGISPPDNPQVKEIRCIAMPPQWGTHQQVHLPSALPEHDFLNDLEPLGWMHTQPNELPQLSPQDLTSHARILENNKQWDGEKCIILTCSFTPGSCSLTAYKLTPSGYEWGRVNKDTGSNPHGYLPTHYEKVQMLLSDRFLGFYMVPDNGPWNYNFMGVKHTVSMKYGVKLGTPREYYHEDHRPTHFLEFSNLEEGEMAEGDREDTFS

SEQ ID NO: 4257 - protein, 1746 aa, Citrus sinensis
MYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFAPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPHMPNEFITYWDTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDMFDQKASNKYWVDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQISGYLYGISPPDNPQVKEIRCIAMPPQWGTHQQVHLPSALPEHDFLNDLEPLGWMHTQPNELPQLSPQDLTSHARILENNKQWDGEKCIILTCSFTPGSCSLTAYKLTPSGYEWGRVNKDTGSNPHGYLPTHYEKVQMLLSDRFLGFYMVPDNGPWNYNFMGVKHTVSMKYGVKLGTPREYYHEDHRPTHFLEFSNLEEGEMAEGDREDTFS

SEQ ID NO: 4258 - protein, 2339 aa, Manihot esculenta
MWNNNGEAHIAPPGTGGPPVPPPPVPAQPSYTVLAPQTPPTPAEAEAKLEEKARKWQQLNTKRYSDKRKFGFVETQKEDMPPEHVRKIIRDHGDMSSKKYRHDKRVYLGALKFIPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLEMDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMVMFIKAEDPDLPAFYYDPLIHPITSTNKERREKKAYDDDEDDDFLLPEGVEPFLHDTQLYTDTTAAGISLLFAPRPFNMRSGRMRRAEDIPLVSEWYKEHCPPSYPVKVRVSYQKLLKCFVLNELHHRPPKAQKKKHLFRSLAATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGTAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSALIPVYEIEPLEKITDAYLDQYLWYEGDKRHLFPNWIKPADSEPPPLLVYKWCQGINNLQGIWDTGEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRLHILFRFTHEEARDLIQRYLTEHPDPNNENMVGYQNKKCWPRDARMRLMKHDVNLGRSVFWDMKNLHVFCQAIEPIHMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKEIRCIAMPPQWGTHQQVHLPSALPEHDFLNDLEPLGWMHTQPNELPQLSPQDLTNHARILENNKQWDGEKCIILTCSFTPGSCSLTAYKLTPSGYEWGRVNKDTGSNPHGYLPTHYEKVQMLLSDRFLGFYMVPDNGPWNYNFMGVKHTVSMKYGIKLGTPREYYHEDHRPTHYLEFSNLEEGDVAEGDREDTFT

SEQ ID NO: 4259 - protein, 1268 aa, Quercus alba
PPPLLVYKWCQGINNLQGVWDTSDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAEPKDVFDQKASNKYWIDVQLRWGDYDSHDIERYTRAKFMDYTTDNMSIYPSPTGVMIGIDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLTDDQWMKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICMADLRTQIAGYLYGISPPDNPQVKEIRCIAMPPQWGTHQQVNLPSALPEHDFLNDLEPLGWMHTQPNELPQLSPQDLTSHAKILENNKQWDGEKCII

SEQ ID NO: 4260 - protein, 2262 aa, Theobroma cacao
MSSKKYRHDKRVYLGALKFIPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLEMDEEEDSAVYAWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLGVYHTPMVMYIKTEDPDLPAFYYDPLIHPITTTNKERREKKIYDDEDEDDFVLPEGVEPLLNDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCKQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDKVHILFRFTHDEARDLIQRYLTEHPDPNNENMVGYNNKKCWPRDARMRLMKHDVNLGRSVFWDMKNRLPRSITTLEWENSFVSVYSKDNPNLLFSMCGFEVRILPKTRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDMFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKEIRCIAMPPQWGTHQQVHLPSALPEHDFLNDLEPLGWMHTQPNELPQLSPQDVTSHARILENNKQWDGEKCIILTCSFTPGSCSLTAYKLTPSGYEWGRVNKDTGSNPHGYLPTHYEKVQMLLSDRFLGFYMVPDNGPWNYNFMGVKHTVSMKYGVKLGPPREYYQEDHRPTHYLEFSNLEEGETAEGDREDTFT

SEQ ID NO: 4261 - protein, 830 aa, Podocarpus macrophillus
ASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMSKPSLVAESKDTFDQKSSNKYWIDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPSLSDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIMPKNILKKFICIADLRTQIAGYLYGVSPPDNPQVKEIRCIGMPPQWGTHQQVNLPSALPEHEFLNDLEPLGWMHTQPNELPQLSPQDLTSHARILENNKQWDGEKCIILTCSFTPGSCSLTAYKLTPTGYEWGRLNKDTGSNPHGYLPTHYEKVQMLLSDRFLGFYMIPDNGPWNYNFMGVKHTVSMKYGVKLGTPRDFYNEDHRPTHFLEFSNLEEGEHAEGDNEDVFN

SEQ ID NO: 4262 - protein, 741 aa, Artemisia annua
QVLDQELDALEIETVQKETIHPRKSYKMNSSCADILLFAAHRWPMSKPSLVAESKDIFDQKAINKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKASEPQMVLFNIYDDWLKTISSYTAFSRLILILRALHVNNEKAKMLLKPDKTIVTEPHHIWPSLTDDQWVKVEVALRDLILSDYAKKNNVNTSALTQSEIRDIILGAEITPPSQQRQQIAEIEKQAKEASQLTAVTTRTTNVHGDELIVTTTSPYEQSAFASKTDWRVRAISATNLYLRVNHIYVNSEDIKETGYTYIMPKNILKKFICIADLRTQISGYLYGVSPPDNPQVKEIRCIAMPPQWGTHQQVHLPSALPEHDFLNDLEPLGWMHTQPNELPQLSPQDLTFHARILENNKQWDGEKSIILTCSFTPGSCSLTAYKLTPTGYEWGRANKDNGSNPHGYLPTHYEKVQMLLSDRFLGFYMVPDNGPWNYNFMGVKHTAGMKYGIKLGTPREYYHEDHRPTHFLEFSNLEEGDVAEGDREDTFS

SEQ ID NO: 4263 - protein, 2376 aa, Ricinus communis
MWNNNGEPHIAPPGTGGPSIPPPSVPAQPSYTVLVPQSQTPQTPAEAEALLEEKARKWQQLNTKRYSDKRKFGFVETQKEDMPPEHVRKIIRDHGDMSSKKYRHDKRVYLGALKFIPHAVYKLLENMPMPWEQVRDVKVLYHITGAITFVNEIPWVVEPIYLAQWGSMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLGVYHTPMVMYIKAEDPDLPAFYYDPLIHPITSTNKERREKKSQDDDEDEDFLLPEGVEPLLQDTQLYTDTTAAGISLLFAPRPFNMRSGRMRRAEDIPLVSEWYKEHCPPSYPVKVRVSYQKLLKCFVLNELHHRPPKAQKKKHLFRSLAATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGTAKTVTKQRVESHFDLELRAAVMHDVLDAMPGNTFSCCFSFDVYFVFLLLFFAVSQARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSALIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPNMPNEFITYWDTKVETRHPIRLYSRYIDRVHILFRFTHEEARDLIQRYLTEHPDPNNENMVGYQNKKCWPRDARMRLMKHDVNLGRSVFWDMKNRLPRSITTLEWENSFVSVYSKDNPNLLFSMCGFEVRILPKIRMTQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSIITEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICLADLRTQIAGYLYGISPPDNPQVKEIRCIAMPPQWGTHQQVHLPSALPEHDFLNDLEPLGWMHTQPNELPQLSPQDLTAHARILENNKQWDGEKCIILTCSFTPGSCSLTAYKLTPSGYEWGRVNKDTGSNPHGYLPTHYEKVQMLLSDRFLGFYMVPDNGPWNYNFMGVKHTVSMKYGIKLGTPREYYHEDHRPTHFLEFSNLEEGETAEGDREDTFT

SEQ ID NO: 4264 - protein, 823 aa, Gossypium hirsutum
MKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDMFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKEIRCIAMPPQWGTHQQVHLPSALPEHDFLNDLEPLGWLHTQPNELPQLSPQDVTSHARILENNKQWDGEKCIILTCSFTPGSCSLTAYKLTPSGYEWGRINKDTGSNPHGYLPTHYEKVQMLLSDRFLGFYMIPDNGPWNYNFMGVKHTVSMKYGVKLGTPREYYNEDHRPTHFLEFSNLEEGETAEGDREDTFT

SEQ ID NO: 4265 - protein, 1467 aa, Cucumis sativus
MITHMKHYLVLSVTCSHNVPSKRRVGIEFMDLYSYLIPVYEIEPLEKITDAYLDQYLWYEGDKRHLFPNWIKPADSEPPPLLVYKWCQGINNLQGIWDTSDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTEVETKHPIRLYSRYIDKVHILFRFSHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKPSNKYWIDVQLRWGDYDSHDIERYTRAKFMDYTTDNMSIYPSPTGVMIGIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKEIRCIVMPPQWGTHQQVNLPTALPEHDFLNDLEPLGWMHTQPNELPQLSPQDLTNHAKVLENNKQWDGEKCIILTCSFTPGSCSLTAYKLTPSGYEWGRVNKDTGSNPHGYLPTHYEKVQMLLSDRFFGFYMIPDNGPWNYNFMGVKHTAGMKYGVKLGTPREYYHEDHRPTHFLEFSNLEEGETAEGDREDTFT

SEQ ID NO: 4266 - protein, 687 aa, Vitis vinifera
KDVFDQKASNKYWIDVQLRWGDYDSHDIERYTRAKFMDYTTDNMSIYPSPTGVMIGIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQSAFGSKTDWRVRAISATNLYLRVNHIYVNSEDIKETGYTYIMPKNILKKFICIADLRTQISGYLYGISPPDNPQVKEIRCIAMPPQWGTHQQVHLPSALPEHDFLNDLEPLGWMHTQPNELPQLSPQDLTSHARILENNKQWDGEKCIILTCSFTPGSCSLTAYKLTPTGYEWGRVNKDTGSNPHGYLPTHYEKVQMLLSDRFLGFYMIPDNGPWNYNFMGVKHTVSMKYGIKLGTPREYYHEDHRPTHFLEFSNLEEGEMAEGDREDTFT

SEQ ID NO: 4267 - protein, 1746 aa, Tabernaemontana elegans
MYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQSPNEFITYWDTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHLKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHKWPMSKPSLVAESKDVFDQKASNKYWIDVQLRWGDYDSHDIERYTRAKFMDYTTDNMSIYPSPTGVMIGIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSIVTEPHHIWPSLTDDQWMKVEVSLRDLILSDYAKKNNVNTSALTQSEIRDIILGAEITPPSQQRQQIAEIEKQAKEASQLTAVTTRTTNVHGDELIVTTTSPYEQSTYASKTDWRVRAISATNLYLRVNHIYVNSEDIKETGYTYIMPKNILKKFICIADLRTQIAGYLYGISPPDNPQVKEIRCIAMPPQWGTHQHVNLPSALPEHDFLTDLEPLGWMHTQPNELPQLSPQDLTSHARILENNKQWDGEKCIILTCSFTPGSCSLTAYKLTLSGYEWGRANKDTGSNPHGYLPTHYEKVQMLLSDRFLGFYMIPDNGPWNYNFMGVKHTVSMRYGVKLGTPREFYHEDHRPTHFLEFSNLEEGETAEGDREDTFS

SEQ ID NO: 4268 - protein, 1741 aa, Taxus baccata
YRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRSFKEVGIEFMDLYSYLIPVYEIEPLEKITDAYLDQYLWYEGDKRHLFPNWIKPADSEPPPLLVYKWCQGINNLQDIWDTSEGQCVVMLQTKFEKFFEKIDLTMLNRLLRLVLDHNIADYVTAKNNVVLSYKDMSHTNSYGLIRGLQFASFVVQYYGLVLDLLVLGLTRASEIAGSPQMPNEFITYWDTKVETRHPIRLYSRYIDKVHMLFRFTHEEARDLIQRYLTEHPDPNNENMVGYNNKKCWPRDARMRLMKHDVNLGRSVFWDIKNRLPRSITTLEWENSFVSVYSKDNPNLLFSMCGFEVRILPKIRMTQEAFSNLKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMCKPSLVAESKDVFDQKASNKYWIDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPNLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIIPKNILKKFICIADLRTQIAGYLYGVSPPDNPQVKEIRCISMPPQWGTHQQVHLPLALPEHDFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRFLGFYMVPDNGPWNYNFMGVKHTVSMKYGVKLGAPRDFYHEDHRPTHFLEFSNLEEGEHAEGDTEDVFN

SEQ ID NO: 4269 - protein, 656 aa, Gossypium hirsutum
MKYKKLTNAQRSGLNQIPNRRFTLWWSPTINRANVYVSFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDMFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKKFAVLQCHHSGVLISKFIFHQLFLNMIS

SEQ ID NO: 4270 - protein, 2357 aa, Populus trichocarpa
MWNDTGEQHIAPPGTAGPSIPPPPPSQPSYTVLAPSQTVSNPADAEAKLEEKARKWQQLNTKRYSDKRKFGFVETQKEDMPPEHVRKIIRDHGDMSSKKYRHDKRVYLGALKFIPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMYIKAEDPDLPAFYYDPLIHPITSSNKERREKKTHDDDDDDEDFVMPEGVEPFLEDTQLYTDTTAAGISLLFANRPFNMRSGRMRRAEDIPLVSEWYKEHCPPSYPVKVRVSYQKLLKCFVLNELHHRPPKAQKKKHLFRSLAATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGTAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSSLIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYQNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQSCLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQISGYLYGISPPDNPQVKEIRCIAMPPQWGTHQQVHLPSALPEHDFLNDLEPLGWMHTQPNELPQLSPQDLTAHARVLENNKQWDGEKCIILTCSFTPGSCSLTAYKLTPSGYEWGRVNKDTGSNPHGYLPTHYEKVQMLLSDRFLGFYMIPDNGPWNYNFMGVKHTVSMKYGIKLGTPREYYHEDHRPTHFLEFSNLEEGETAEGDREDTFT

SEQ ID NO: 4271 - protein, 1345 aa, Abies balsamea
MLNRLLRLVLDHNIADYVTAKNNIVLSYKDMSHTNSYGLIRGLQFASFVVQYYGLVLDLLVLGLTRASEIAGPPQMPNEFITYWDTKVETRHPIRLYSRYIDKVHILFRFTHEEARDLIQRYLTEHPDPNNENMVGYNNKKCWPRDARMRLMKHDVNLGRSVFWDIKNRLPRSITTLEWENSFVSVYSKDNPNLLFSMCGFEVRILPKIRMSQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMCKPSLVAESKDVFDQKASNKYWVDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTIVTEPHHIWPSLNDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIMPKNILKKFICIADLRTQISGYIYGISPPDNPQVKEIRCIAMPPQWGTHQQVHLPLALPEHEFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRFLGFYMVPDNGPWNYNFMGVKHTVSMKYGIKLGAPRDFYHEDHRPTHFLEFSNLEEGDHAEGDAEDVFT

SEQ ID NO: 4272 - protein, 823 aa, Cephalotaxus harringtonia
MKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMCKPSLVAESKDVFDQKASNKYWIDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPNLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIIPKNILKKFICIADLRTQISGYLYGVSPPDNPQVKEIRCISMPPQWGTHQQVHLPLALPEHDFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRFLGFYMVPDNGPWNYNFMGVKHTVSMKYGVKLGTPRDFYHEDHRPTHFLEFSNLEEGDHAEGDTEDVFN

SEQ ID NO: 4273 - protein, 1029 aa, Gossypium hirsutum
MPSRFPPVNFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDMFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKEIRCIAMPPQWGTHQQVNLPSALPEHDFLNDLEPLGWLHTQPNELPQLSPQDVTSHSRILENNKQWDGEKCIILTCSFTPGSCSLTAYKLTPSGYEWGRVNKDTGSNPHGYLPTHYEKVQMLLSDRFLGFYMIPDNGPWNYNFMGVKHTVSMKYGVKLGTPKEYYNEEHRPTHFLEFSNLEEGETVEGDREDTFT

SEQ ID NO: 4274 - protein, 864 aa, Distylium racemosum
TDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADVLLFASYKWPMCKPSLVAESKDVFDQKASNKYWIDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPSLSDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIMPKNILKKFICIADLRTQISGYLYGVSPPDNPQVKEIRCIAMPPQWGTHQQVHLPLALPEHDFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRFLGFYMVPDNGPWNYNFMGVKHTVSMKYGVKLGTPRDFYHEDHRPTHFLEFSNLEEGDHAEGDNEDVFT

SEQ ID NO: 4275 - protein, 2069 aa, Eucalyptus grandis
MWNGAGNGQIAPPGTSGPSAIPPPPAPQPSYTVLPSPAEAEARLEEKARKWMQLNSKRYGDKRKFGFVETQKEDMPPEHVRKIIRDHGDMSSKKYRHDKRVYLGALKFVPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDDEEDSAVCTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCIYHTPMVMYIKTEDPDLPAFYYDPLIHPITSINKERREKKAYDDEDEDDFSLPEGVEPLLSDTQLYTDTTAAGISLLFAPRPFNTRSGRMRRAEDIPLVSEWYKEHCPPTYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSVWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTQGPPMCMVMN

SEQ ID NO: 4276 - protein, 1361 aa, Pseudotsuga menziesii
MLQTKFEKFFEKIDLTMLNRLLRLVLDHNIADYVTAKNNIVLSYKDMSHTNSYGLIRGLQFASFVVQYYGLVLDLLVLGLTRASEIAGPPQMPNEFITYWDTKVETRHPIRLYSRYIDKVHILFRFTHEEARDLIQRYLTEHPDPNNENMVGYNNKKCWPRDARMRLMKHDVNLGRSVFWDIKNRLPRSITTLEWENSFVSVYSKDNPNLLFSMCGFEVRILPKIRMSQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMCKPSLVAESKDVFDQKASNKYWVDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTIVTEPHHIWPSLNDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIMPKNILKKFICIADLRTQISGYIYGISPPDNPQVKEIRCIAMPPQWGTHQQVHLPLALPEHEFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRFLGFYMVPDNGPWNYNFMGVKHTVSMKYGIKLGAPRDFYHEDHRPTHFLEFSNLEEGDHAEGDAEDVFT

SEQ ID NO: 4277 - protein, 403 aa, Sciadopitys verticillata
FWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMCKPSLVAESKDVFDQKASNKYWIDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGT

SEQ ID NO: 4278 - protein, 1085 aa, Gossypium hirsutum
MLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGVWDTSEGQCVVMLQTKFEKFFDKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKNS

SEQ ID NO: 4279 - protein, 842 aa, Aristolochia fimbriata
FPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAHRWPMSKPSLVAESKDDVFDQKASNKYWIDVQLRWGDYDSHDIERYTRAKFMDYTTDNMSIYPSPTGVMIGIDLAYNLHSAFGNWFPGSKPLLAKAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPSKSVITEPHHIWPSLNDDQWMRVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGVSPPDNPQVKEIRCIGMPPQWGTHQQVHLPAALPEHEFLNDLEPLGWMHTQPNELPQLSPQDLTSHARILENNKQWDGEKCIILTCSFTPGSCSLTAYKLTPTGYEWGRVNKDTGSNPHGYLPTHYEKVQMLLSDRFLGFYMIPDNGPWNYNFMGVKHTVSMRYGVKLGTPRDYYHEDHRPTHFLEFSNLEEGDIAQGDREDTFS

SEQ ID NO: 4280 - protein, 2360 aa, Arnica chamissonis
MWNNNGVIAPPGTGGGQPLAPPGTGGVGGSIPPPPAAQPSYTVLPSPAEAEARLEEKARKWMQLNSKRYGDKRKFGFVETQKEDMPPEHVRKIIKDHGDMSSKKYRHDKRVYLGALKFVPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDEEEDSAVCTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVRLCVYHTPMIMYIKTEDPDLPAFYYDPLIHPITNKDRRDKKGQEDDDEDDDFSLPDGVEPLLTSTPLYTDTTAAGVSLLFAPRPFNMRSGRMRRAEDIPLVSEWYKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGVWDTGDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPLQMPNEFITFWDTKVETRHPIRLYSRYIDKVHILFRFSHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTKDGIWNLQNEQTKERTAIAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKASEPQMVLFNIYDDWLKSISSYTAFSRLILILRALHVNNEKAKMLLKPDKTIVTEPHHIWPSLSDDQWVKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQISGYLYGVSPPDNPQVKEIRCIAMPPQWGTHQQVHLPSALPEHDFLNDLEPLGWMHTQPNELPQLSPQDLTFHARILENNKQWDGEKSIILTCSFTPGSCSLTAYKLTPTGYEWGRANKDSGSNPHGYLPTHYEKVQMLLSDRFLGFYMVPDNGPWNYNFMGVKHTVSMKYGVKLGTPREYYHEDHRPTHFLEFSNLEEADVAEGDREDTFS

SEQ ID NO: 4281 - protein, 2355 aa, Pinus taeda
MWNPGVAGSSHMAPPGTTPSVPPPSGMQQPQHPSYGPPLNSADAEAMLEEKARKWMQLNAKRYGDKRKFGFVETQKEDMPPEHVRKIIRDHGDMSSKKYRHDKRVYLGALKFVPHAVYKLLENMPMPWEQVRDVKVLYHITGAITFVNEIPWVVEPIYMAQWGTMWIMMRREKRDRRHFKRMRFPPFDDEEPPLDYADNLLDVDPLEPIQLELDEEEDSAVYTWFYDHKPLVKTKLINGPSYRRWQLSLPIMATLHRLAGQLLSDLIDKNYFYLFDMESFFTAKALNMCIPGGPKFEPLYRDMEKGDEDWNEFNDINKLIIRSPLRTEYRIAFPHLYNNRPRKVRLCVYHSPMVMYIKTEDPDLPAFYFDPLIHPISFHKTDRRERKTYEEDDDDDFFVPEGVEPLLHDTPLYTDTTAAGISLLFAPRPFNMRSGRMRRAEDIPLVSDWYKEHCPPTYPVKVRVSYQKLLKCYVLNELHHRPPKAQKKKYLFRSLQATKFFQTTELDWAEAGLQVCRQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQDIWDTSEGQCVVMLQTKFEKFFEKIDLTMLNRLLRLVLDHNIADYVTAKNNIVLSYKDMSHTNSYGLIRGLQFASFVVQYYGLVLDLLVLGLTRASEIAGPPQMPNEFITYWDTKVETRHPIRLYSRYIDKVHILFRFTHEEARDLIQRYLTEHPDPNNENMVGYNNKKCWPRDARMRLMKHDVNLGRSVFWDIKNRLPRSITTLEWENSFVSVYSKDNPNLLFSMCGFEVRILPKIRMSQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMCKPSLVAESKDVFDQKASNKYWIDVQLRWGDYDSHDIERYTRAKFLDYTTDNMSIYPSPTGVMIAIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTIVTEAHHIWPSLNDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIMPKNILKKFICIADLRTQISGYIYGISPPDNPQVKEIRCIAMPPQWGTHQQVHLPLALPEHEFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRYLGFYMVPDNGPWNYNFMGVKHTVSMKYGIKLGAPRDFYHEDHRPTHFLEFSNLEEGDHAEGDAEDVFS

SEQ ID NO: 4282 - protein, 1746 aa, Vinca minor
MYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDAKVETRHPIRLYSRYIDKVHILFRFTHEEARDLIQRYLTEHPDPNNENMVGYNNKKCWPRDARMRLMKHDVNLGRSVFWDMKNRLPRSITTLEWENGFVSVYSKDNPNLLFSMCGFEVRILPKIRMTLEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAINKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTVVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQSTYAAKTDWRVRAISATNLYLRVNHIYVNSEDIKETGYTYIMPKNILKKFICIADLRTQIAGYLYGVSPPDNPQVKEIRCIAMPPQWGTTQLVNLPSTLPEHDFLNDLEPLGWMHTQPNELPQLSPQDLTSHARVLENNRQWDGEKCIILTCSFTPGSCSLTAYKLSPSGYEWGRANKDNGSNPHGYLPTHYEKVQMLLSDRFLGFYMVPDNGPWNYNFMGVKHTISMKYGVKLGTPREFYHEDHRPTHFLEFSNLEEGDTAEGDREDTFT

SEQ ID NO: 4283 - protein, 2079 aa, Vinca minor
MESFFTAKALNMCIPGGPKFEPLYRDMEKGDEDWNEFNDINKLIIRSPLRTEYRIAFPHLYNNRPRKVKLGVYHTPMIMYIKTEDPDLPAFYYDPLIHPITSTNKDKREKKSHEEDADDDFSLPDGVEPLLSDVPLYTDTTAAGISLLFAPRPFNMRSGRMRRAEDIPLVSEWYKEHCPPSYPVKVRVSYQKLLKCFVLNELHHRPPKAQKKKHLFRSLAATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGVWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWVDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLSDDQWMKVEVALRDLILSDYAKKNNVNTSALTQSEIRDIILGAEITPPSQQRQQIAEIEKQAKEASQLTAVTTRTTNVHGDELIVTTTSPYEQSTYAAKTDWRVRAISATNLYLRVNHIYVNSEDIKETGYTYIMPKNILKKFICIADLRTQIAGYLYGVSPPDNPQVKEIRCIAMPPQWGTTQLVNLPSALPEHDFLNDLEPLGWMHTQPNELPQLSPQDLTSHARILENNRQWDGEKCIILTCSFTPGSCSLTAYKLSPSGYEWGRANKDNGSNPHGYLPTHYEKVQMLLSDRFLGFYMVPDNGPWNYNFMGVKHTISMRYGVKLGAPREFYHEDHRPTHFLEFSNLEEGDTAEGDREDTFS

SEQ ID NO: 4284 - protein, 1254 aa, Gossypium hirsutum
MVMYIKTEDPDLPAFYYDPLIHPITATNKERREKKVYDDEDEDDFVLPEGVEPLLSDTQLYTDTTAAGISLLFAPRPFNMRSGRVRRAEDIPLVSDWYKEHCPPSYPVKVRVSYQKLLKCFVLNELHHRPPKAQKKKHLFRSLQATKFFQTTELDWVEAGLQVCKQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSEGQCVVMLQTKFEKFFDKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKNS

SEQ ID NO: 4285 - protein, 2267 aa, Medicago truncatula
DHGDMSSKKFRHDKRVYLGALKFIPHAVYKLLENMPMPWEQVRDVRVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLSDRNYFYLFDMESFFTAKALNMCIPGGPKFEPLYRDMEKGDEDWNEFNDINKLIIRSPLRTEYRIAFPHLYNNRPRKVRLCIYHTPMVMYIKTEDPDLPAFYYDPLIHPITSANKERREKKIYDEEDDDDWVLPDGVEPFLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSVWDTSDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFVDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLSDDQWMKVEVALRDLILSDYAKKNNVNTSALTQSEIRDIILGAEITPPSQQRQQIAEIEKQSHEANQVTAVTTRTTNVHGEELIVTTTSPYEQGAFASKTDWRVRAISATNLYLRVNHIYVNSEDIKETGYTYIMPKNILKKFICIADLRTQISGYLYGISPPDNPQVKEIRCIVMPPQWGTHQQVHLPSALPEHDFLNDLEPLGWMHTQPNELPQLAPQDLTSHAKVLENNKQWDGEKCIILTCSFTPGSCSLTAYKLTPSGYEWGRINKDTGSNPHGYLPTHYEKVQMLLSDRFLGFYMIPDNGPWNYNFMGVRHASGMKYGVKLGTPREYYHEDHRPTHFLEFSNMEEGETITEGDREDTFS

SEQ ID NO: 4286 - protein, 2367 aa, Amsonia hubrichtii
MWSNSANGGNGGNMPPIAPPGTSGIMPPGTSGAGGAGPSGPTPPPPPPPSYTVLPTEAQLEEKARKWMQLNSKRYSDKRKFGFVETQKEDMPPEHVRKIIRDHGDMSSKKYRHDKRVYLGALKFVPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLGVYHTPMVMYIKTEDPDLPAFYYDPLIHPITSTNKDRREKKNYEEDDDDDFSLPEGVEPLLKNVPIYTDTTAAGISLLFAPRPFNMRSGRMRRAEDIPLVSEWYKEHCPPSYPVKVRVSYQKLLKCFVLNELHHRPPKAQKKKHLFRSLAATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMSGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMVLKPDKSVVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQSTYASKTDWRVRAISATNLYLRVNHIYVNSEDIKETGFTYIMPKNILKKFICIADLRTQIAGYLYGISPPDNPQVKEIRCIAMPPQWGTHQQVNLPSALPEHDFLNDLEPLGWMHTQPNELPQLSPQDLTSHARILENNKQWDGEKCIVLTCSFTPGSCSLTAYKLTPSGYEWGRANKDTGSNPHGYLPTHYEKVQMLLSDRFLGFYMIPDNGPWNYNFMGVKHTVSMRYGVKLGTPREYYHEDHRPTHFLEFSNLEEGETAEGDREDTFS

SEQ ID NO: 4287 - protein, 1710 aa, Euphorbia peplus
MWILGTNVEGMAVFLRGIVPLLERWLGNLLARQFEGRHSKGTAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSALIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHIMFRFTHEEARDLIQRYLTEHPDPNNENMVGYQNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSIITEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQGAFGSKTDWRVRAISATNLYLRVNHIYVNSEDIKETGYTYIMPKNILKKFICIADLRTQIAGYLYGISPPDNPQVKEIRCIAMPPQWGTHQQVHLPSALPEHDFLNDLEPLGWMHTQPNELPQLSPQDLTAHARVLENNKQWDGEKCIILTCSFTPGSCSLTAYKLTPSGYEWGRVNKDTGSNPHGYLPTHYEKVQMLLSDRFLGFYMTPDNGPWNYNFMGVKHTVSMKYGIKLGTPREYYHEDHRPTHYLEFSNLEEGDIAEGDREDTFN

SEQ ID NO: 4288 - protein, 105 aa, Pinus pinaster
DFEDSWDRGIPRINTLFQKDRHTLAYDKGWRVRTDFKQYQVLKQNPFWWTHQRHDGKLWNLNNYRTDVIQALGGVEGILEHTLFKGTYSTWKVCSGRRLLGLRSL

SEQ ID NO: 4289 - protein, 859 aa, Actinidia deliciosa
  misc_feature (5)..(5): Xaa can be any naturally occurring amino acid
  misc_feature (12)..(12): Xaa can be any naturally occurring amino acid
ALGGXEGILEHXLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQISGYLYGVSPPDNPQVKEIRCIAMPPQWGTHQQVHLPSALPEHDFLNDLEPLGWMHTQPNELPQLSPQDLTSHARILENNKQWDGERCIILTCSFTPGSCSLTAYKLTPTGYEWGRANKDTGSNPHGYLPTHYEKVQMLLSDRFLGFYMIPDTGPWNYNFMGVKHTVSMKYGIKLGTPREYYHEDHRPTHYLEFSNLEEGETAEADREDTFT

SEQ ID NO: 4290 - protein, 2402 aa, Glycine max
MWNNGQILPPGTSVPPIPPPPAAQPSYTVLPPPPPPPAPMETEADAEARLEEKARKWQQLNSKRYSDKRKFGFVETQKEDMPPEHVRKIIRQLFGFAGVRMLRYNTTTIYGADSLLGLADSLLETMLFRVANREKGSPRLFIFQSNYGIMVTCFSSSCFDRSLLSGFPSLHLIHCTVRDVKVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMFIKAEDPDLPAFYYDPLIHPITSANKERREKRVYEEDDDDDWILPDGVEPLLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALEKLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETKHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVGESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAHEANQVTAVTTKTTNVHGEELIVTTTSPYEQAAFGSKTDWRVRAISATNLYLRVNHIYVNSEDIKETGYTYIMPKNILKKFICIADLRTQISGYMYGVSPPDNPQVKEIRCIVMPPQWGTHQQVHLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMVPDNGPWNYNFMGVRHASGMKYGVKLGTPREYYHEDHRPTHFLEFSNMEEVETAAEGDREDTFS

SEQ ID NO: 4291 - protein, 2267 aa, Glycine max
DHGDMSSKKYRHDKRVYLGALKFIPHAVYKLLENMPMPWEQVRDVKVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMFIKAEDPDLPAFYYDPLIHPITSANKERREKRVYEEDDDDDWILPDGVEPLLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALEKLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETKHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVGESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAHEANQVTAVTTKTTNVHGEELIVTTTSPYEQAAFGSKTDWRVRAISATNLYLRVNHIYVNSEDIKETGYTYIMPKNILKKFICIADLRTQISGYMYGVSPPDNPQVKEIRCIVMPPQWGTHQQVHLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMVPDNGPWNYNFMGVRHASGMKYGVKLGTPREYYHEDHRPTHFLEFSNMEEVETAAEGDREDTFS

SEQ ID NO: 4292 - protein, 1029 aa, Tripterygium wilfordii
MPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKGSNKYWIDVQLRWGDYDSHDIERYTRAKFMDYTTDNMSIYPSPTGVMIGLDLAYNLQSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTVVTEPHHIWPSLTDDQWMKVEVALRDLILSDYAKKNNVNTSALTQSEIRDIILGAEITPPSQQRQQIAEIEKQAKEASQLTAVTTKTTNVHGDELIVTTTSPYEQSAFSSKTDWRVRAISATNLYLRVNHIYVNSEDIKETGYTYIMPKNILKRFICIADLRTQIAGYLYGISPPDNPQVKEIRCIAMVPQWGTHQQVHLPSALPEHDFLNDLEPLGWMHTQPNELPQLSPQDLTSHARVLENNKQWDGEKCIILTCSFTPGSCSLTAYKLTPSGYEWGRLNKDTGSNPHGYLPTHYEKVQMLLSDRFLGFYMVPDNGPWNYNFMGVKHTVSMKYGVKLGTPREYYNEDHRPTHFLEFSNLEEVETAEGDRDDTFT

SEQ ID NO: 4293 - protein, 825 aa, Lotus japonicus
MKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEQQAHEANQATAVTTKTTNVHGEELIVTTTSPYEQAAFGSKTDWRVRAISATNLYLRVNHIYVNSEDIKETGYTYIMPKNILKKFICIADLRTQIAGYLYGISPPDNPQVKEIRCIVMTPQYGTHQQVHLPSALPEHDFLNDLEPLGWMHTQPNELPQLSPQDLTSHAKILENNKQWDGEKCIILTCSFTPGSCSLTAYKLTPSGYEWGRINKDTGSNPHGYLPTHYEKVQMLLSDRFLGFYMIPDNGPWNYNFMGVRHAPSMKYGVKLGTPREYYNEDHRPTHFLEFSNMEEKGETVVEGDREDTFS

SEQ ID NO: 4294 - protein, 2263 aa, Glycine max
MSSKKYRHDKRVYLGALKFIPHAVYKLLENMPMPWEQVRDVRVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMFIKAEDPDLPAFYYDPLIHPITSANKERREKRVYEDDDDDDWILPDGVEPLLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETKHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAHEANQVTAVTTKTTNVHGEELIVTTTSPYEQAAFGSKTDWRVRAISATNLYLRVNHIYVNSEDIKETGYTYIMPKNILKKFICVADLRTQISGYMYGISPPDNPQVKEIRCIVMPPQWGTHQQVHLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMVPDNGPWNYNFMGVRHASGMKYGVKLGTPREYYHEDHRPTHFLEFSNMEEVEITAEGDREDTFS

SEQ ID NO: 4295 - protein, 2293 aa, Glycine max
LFFPNLIMLLLPLFQIVTLFAILYFRDHGDMSSKKYRHDKRVYLGALKFIPHAVYKLLENMPMPWEQVRDVRVLYHISGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMIMFIKAEDPDLPAFYYDPLIHPITSANKERREKRVYEDDDDDDWILPDGVEPLLKDTQLYTDTTAAGISLLFAPRPFNMRSGRMRRAEDIPLVSEWYKEHCPPSYPVKVRVSYQKLLKCFVLNELHHRPPKAQKKKHLFRSLQATKFFQTTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETKHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAHEANQVTAVTTKTTNVHGEELIVTTTSPYEQAAFGSKTDWRVRAISATNLYLRVNHIYVNSEDIKETGYTYIMPKNILKKFICVADLRTQISGYMYGISPPDNPQVKEIRCIVMPPQWGTHQQVHLPSALPEHDFLNDLEPLGWMHTQPNELPQLSPQDLTSHAKILENNKQWDGEKCIILTCSFTPGSCSLTAYKLTPSGYEWGRVNKDTGSNPHGYLPTHYEKVQMLLSDRFLGFYMVPDNGPWNYNFMGVRHASGMKYGVKLGTPREYYHEDHRPTHFLEFSNMEEVEITAEGDREDTFS

SEQ ID NO: 4296 - protein, 1028 aa, Chelidonium majus
MPSRFPPVIFYTPKEIGGLGMLSMGHILIPQSDLRYSQQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAHRWPMSKPSLVAESKDMFDQKASNKYWIDVQLRWGDYDSHDIERYTRAKFMDYTTDNMSIYPSPTGVMIGIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNVVIKGSELQLPFQACLKIEKFGDLILKATEPQMLLFNLYDDWLKSISSYTAFSRLILILRALHVNNEKAKMLLKPDAKIITEPHHIWPSLTDDQWMKVEVALRDLILSDYAKKNNVNTSALTQSEIRDIILGAEITPPSQQRQQIAEIEKQNKEASQLTAVTTRTTNVHGDELIVTTTSPYEQAAFGSKTDWRVRAISATNLYLRVNHIYVNSEDIKETGYTYIMPKNILKKFICVADLRTQIAGYLYGVSPPDNPQVKEIRCIAMPPQWGHISRFISSALPEHDFLNDLEPLGWMHTQPNELPQLSPQDLTSHARILESNKQWDGEKCIVLTCSFTPGSCSLTAYKLTPTGYEWGRVNKDTGSNPHGYLPTHYEKVQMLLSDRFLGFYMVPDNGPWNYNFMGVKHTVSMKYGIKLGTPREYYHEDHRPTHFLEFSNLEDGETAEGDREDTFS

SEQ ID NO: 4297 - protein, 823 aa, Euonymus alatus
MKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLATAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTVVTEPHHIWPSLNDDQWMKVEVALRDLILSDYAKKNNVNTSALTQSEIRDIILGAEITPPSQQRQQIAEIEKQAKEASQLTAVTTKTTNVHGDELIVTTTSPYEQSAFSSKTDWRVRAISATNLYLRVNHIYVNSEDIKETGYTYIMPKNILKKFICIADLRTQIAGYLYGISPPDNPQVKEIRCIAMVPQWGTHQQVHLPSALPEHDFLNDLEPLGWMHTQPNELPQLSPQDLTSHARILENNKQWDGEKCIILTCSFTPGSCSLTAYKLTPGGYEWGRLNKDTGSNPHGYLPTHYEKVQMLLSDRFLGFYMVPDTGPWNYNFMGVKHTVSMKYGVKLGTPREYYNEDHRPTHFLEFSNLEEGDIAEGDRDDTFT

SEQ ID NO: 4298 - protein, 2370 aa, Malus domestica
MWNNGQIAPPGTGGSSIPPPPAAQPSYTVLPSPADAEAKLEEKARKWQQLNSKRYSDKRKFGFVESQKEDMPPEHVRKIIRLVFICSTVMYISLYVFNLVSFDRDHGDMSSKKFRHDKRVYLGALKFVPHAVYKLLENMPMPWEQVRDVKVLYHITGAITFVNEIPWVVEPIYLAQWGSMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMVMYIKTEDPDLPAFYYDPLIHPIPSSNKDRREKKTSDEEEDDIFTLPDVVEPFLNDTQLYTDTTAAGISLLFAPRPFNMRSGRTRRAEDIPLVSEWYKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFTPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMSQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRFSQQTDVGVSHFRSGMSHEGDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAEPKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTVITEPHHIWPSLSDDQWMKVEVALRDLILSDYAKKNNVNTSALTQSEIRDIILGAEITPPSQQRQQIAEIEKQAKEASQLTAVTTRTTNVHGDELIVTTTSPYEQSAFGSKTDWRVRAISATNLYLRVNHIYVNSEDIKETGYTYIMPKNILKKFICIADLRTQIAGYLYGISPPDNPQVKEIRCIAMPPQWGTHQQVHLPSALPDHDFLNDLEPLGWMHTQPNELPQLSPQDLTSHAKILENTKQWDGEKCIILTCSFTPGSCSLTAYKLTPSGYEWGRVNKDTGSNPHGYLPTHYEKVQMLLSDRFLGFYMIPDTGPWNYNFMGVKHTPSMKYGIKLGTPREYYHEDHRPTHYLEFSNLEEGDTVEGDRDDTFT

SEQ ID NO: 4299 - protein, 725 aa, Malus domestica
KETIHPRKSYKMNSSCADILLFAAHRWPMSKPSLVAEPKDVFDQKVSNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTVITEPHHIWPSLSDDQWMKVEVALRDLILSDYAKKNNVNTSALTQSEIRDIILGAEITPPSQQRQQIAEIEKQAKEASQLTAVTTRTTNVHGDELIVTTTSPYEQSAFGSKTDWRVRAISATNLYLRVNHIYVNSEDIKETGYTYIMPKNILKKFICIADLRTQIAGYLYGISPPDNPQVKEIRCIAMPPQWGTHQQVHLPSALPDHDFLNDLEPLGWMHTQPNELPQLSPQDLTSHAKILENTKQWDGEKCIILTCSFTPGSCSLTAYKLTPSGYEWGRVNKDTGSNPHGYLPTHYEKVQMLLSDRFLGFYMIPDTGPWNYNFMGVKHTPSMKYGIKLGTPREYYHEDHRPTHYLEFSNLEEGDTVEGDRDDTFT

SEQ ID NO: 4300 - protein, 1195 aa, Manihot esculenta
MWNNNAEAHIVPPGTGGPSIPPPPAPAQPSYTVLAPQIPPTQAEAEAKLEEKARKWQQLNTKRYSDKRKFGFVETQKEDMPPEHVRKIIRDHGDMSSKKFRHDKRVYLGALKFIPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLEMDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLGVYHTPMVMFIKAEDPDLPAFYYDPLIHPITSTNKERREKKAHDDDEDDDFLLPEGVEPLLQDTQLYTDTTAAGISLLFAPRPFNMRSGRMRRAEDIPLVSEWYKEHCPPTYPVKVRVSYQKLLKCFVLNELHHRPPKAQKKKHLFRSLAATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGTAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSALIPVYEIEPLEKITDAYLDQYLWYEGDKRHLFPNWIKPADSEPPPLLVYKWCQGINNLQGIWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYQNKKCWPRDARMRLMKHDVNLGRSVFWDMKNRLPRSGVGLKFEYFLK

SEQ ID NO: 4301 - protein, 300 aa, Gnetum gnemon
VVQYYGLVLDLLVLGLTRASEIAGPPQMPNEFITYRDTKVETRHPIRLYSRYIDKVHILFRFTHEEARDLIQRYLTEHPDPNNENMVGYNNKKCWPRDARMRLMKHDVNLGRSVFWDIKTRLPRSITTLEWENSFVSVYSKDNPNLLFSMCGFEVRILPKIRMTQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKGNRRIRDVVNGTYFDSSE

SEQ ID NO: 4302 - protein, 823 aa, Zostera marina
MKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAHRWPMSKPSLVAESKDVFDQKASNKYWVDVQLRWGDYDSHDIERYTRAKFMDYTTDNMSIYPSPTGVMIGIDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIFDDWLKSISSYTAFSRLVLILRALHVNNEKAKMLLKPDKTIVTEPHHIWPSLNDDQWMKVEVALRDLILSDYAKKNNVNTSALTQSEIRDIILGAEITPPSQQRQQIAEIEKQAKEASQLTAVTTRTTNIHGDELIVTTTSPYEQSAHLSKTDWRVRAISATNLYLRVNHIYVNSDDIKETGYTYIMPKNILKKFICVADLRTQIAGYLYGLSPQDNPQVKEIRCIVMPPQWGTHQQVHLPSSLPDHDFLNDLEPLGWMHTQPNELPQLSPQDLTSHAKVLENNKQWDGEKCIILTCSFTPGSCSLTAYKLTPTGYEWGRVNKDTGSNPHGYLPTHYEKVQMLLSDRFLGFYMVPDTGPWNYNFMGVKHTQSMRYGVKLSIPRDYYHEDHRPTHFLEFSNLEEANQVDGDREDTFT

SEQ ID NO: 4303 - protein, 2332 aa, Prunus persica
MWNNGQIAPPGTGGSSIPPPPAAQPSYTVLPSPADAEARLEEKARKWQQLNSKRYSDKRKFGFVESQKEDMPPEHVRKIIRLVFFCLIFDAYSFPYLCVYVDRDHGDMSSKKFRHDKRVYLGALKFVPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMVMYIKTEDPDLPAFYYDPLIHPIPSTNKERREKKTFDEEEDDVFGLPEGVGPFLQDTQLYTDTTAAGISLLFAPRPFNMRSGRTRRAEDIPLVSEWYKEHCPPSYPVKVRVSYQKLLKCFVLNELHHRPPKAQKKKHLFRSLQATKFFQTTELDWAEAGLQVSVRNPGLVMLFIFAREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSVWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMSQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAEPKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTVITEPHHIWPSLSDDQWMKVEVALRDLILSDYAKKNNVNTSALTQSEIRDIILGAEITPPSQQRQQIAEIEKQAKEASQLTAVTTRTTNVHGDELIVTTTSPYEQNAFGSKTDWRVRAISATNLYLRVNHIYVNSEDIKETGYTYIMPKNILKKFICIADLRTQIAGYLYGISPPDNPQVKEIRCIAMAPQWGTHQQVHLPSALPEHDFLNDLEPLGWMHTQPNELPQLSPQDLTTHAKILENTKQWDGEKCIILTCSFTPGSCSLTAYKLTPSGYEWGRVNKDTGSNPHGYLPTHYEKVQMLLSDRFLGFYMIPDTGPWNYNFMGVKHTPSMKYGIKLGTPREYYHEDHRPTHYLEFSNLEEGDTVEGDRDDTFT

SEQ ID NO: 4304 - protein, 2350 aa, Solanum lycopersicum
MMPPPPGTSSVQPMMPPGTSGGGASGAGPPLPPPSYTVLPTEAQLEEKARKWMQLNSKRYSDKRKFGFVETQKEDMPPEHVRKIIRDHGDMSSKKYRHDKRVYLGALKFVPHAVYKLLENMPMPWEQVRDVKILYHITGAITFVNEIPWVVEPIYLAQWGTMWIMMRREKRDRRHFKRMRFPPFDDEEPPLDYADNLLDVDPLEPIQLELDEEEDSAVYNWFYDHKPLVKTKLINGPSYRRWHLSLPIMATLHRLAGQLLSDLTDRNYFYLFDMESFFTAKALNMCIPGGPKFEPLYRDMEKGDEDWNEFNDINKLIIRSPLRTEYRIAFPHLYNNRPRKVRLGIYHTPMIMYIKTEDPDLPAFYYDPLIHPIVTKDRREKKVSDDDDDDDFALPEGVEPLLTETPIYTDTTAAGISLLFAPRPFNMRSGRTRRAEDIPLVSDWFKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGVWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYSDSRVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSIITEPHHIWPSLTDDQWMKVEVALRDLILSDYAKKNNVNTSALTVSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQIAGYLYGVSPPDNPQVKEIRCIAMPPQWGTHQQVHLPSGLPEHDFLTDLEPLGWMHTQPNELPQLSPQDVTSHARVLENNKHWDGEKCIILTCSFTPGSCSLTAYKLTPTGYEWGRANKDTGSNPHGYLPTHYEKVQMLLSDRFLGFYMVPDNGPWNYNFMGVKHTVSMKYGVKLGTPREYYNEDHRPTHFLEFSNMEEGDTAEADREDTFT

SEQ ID NO: 4305 - protein, 2395 aa, Solanum lycopersicum
MWNNSNIAPPGTSGGPPPPPSMMQPPMMPPPPGTSSVQPMMPPGTSGGGASGAGPPLPPPSYTVLPTEAQLEEKARKWMQLNSKRYSDKRKFGFVETQKEDMPPEHVRKIIRYLFFAILKLCIFRSYTYYRDHGDMSSKKYRHDKRVYLGALKFVPHAVYKLLENMPMPWEQVRDVKILYHITGAITFVNEIPWVVEPIYLAQWGTMWIMMRREKRDRRHFKRMRFPPFDDEEPPLDYADNLLDVDPLEPIQLELDEEEDSAVYNWFYDHKPLVKTKLINGPSYRRWHLSLPIMATLHRLAGQLLSDLTDRNYFYLFDMESFFTAKALNMCIPGGPKFEPLYRDMEKGDEDWNEFNDINKLIIRSPLRTEYRIAFPHLYNNRPRKVRLGIYHTPMIMYIKTEDPDLPAFYYDPLIHPIVTKDRREKKVSDDDDDDDFALPEGVEPLLTETPIYTDTTAAGISLLFAPRPFNMRSGRTRRAEDIPLVSDWFKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGVWDTSEGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITYSDSRVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSIITEPHHIWPSLTDDQWMKVEVALRDLILSDYAKKNNVNTSALTVSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQIAGYLYGVSPPDNPQVKEIRCIAMPPQWGTHQQVHLPSGLPEHDFLTDLEPLGWMHTQPNELPQLSPQDVTSHARVLENNKHWDGEKCIILTCSFTPGSCSLTAYKLTPTGYEWGRANKDTGSNPHGYLPTHYEKVQMLLSDRFLGFYMVPDNGPWNYNFMGVKHTVSMKYGVKLGTPREYYNEDHRPTHFLEFSNMEEGDTAEADREDTFT

SEQ ID NO: 4306 - protein, 774 aa, Solanum tuberosum
MHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWLVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSVITEPHHIWPSLTDDQWMKVEVALRDLILSDYAKKNNVNTSALTVSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQIAGYLYGVSPPDNPQVKEIRCIAMPPQWGTHQQVHLPSGLPEHDFLTDLEPLGWMHTQPNELPQLSPQDVTSHARVLENNKHWDGEKCIILTCSFTPGSCSLTAYKLTPTGYEWGRANKDTGSNPHGYLPTHYEKVQMLLSDRFLGFYMVPDNGPWNYNFMGVKHTVSMKYGVKLGTPREYYNEDHRPTHFLEFSNMEEGDTAEADREDTFT

SEQ ID NO: 4307 - protein, 585 aa, Selaginella moellendorffii
LQLYSSEPTEPYLSSQNYGELFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQQAFGSKTDWRVRAISATNLYLRVNHIYVNSDDIKEAGYTYIMPKNVLKTFICVADLRTQIAGYLYGLSPPDNPQVKEIRCIVMPPQWGTHQQVHLPAALPEHDYLNDLEPLGWIHTQPNELPQLSPQDVTSHAKILENNKQWEGEKCIILTCSFTPGSCSLTAYKLTPTGYEWGRANKDTGSNPHGYLPTHYEKVQMLLSDRFLGFYMVPDNGPWNYNFMGVKHSTGMKYGVKLANPREYYHEDHRPTHFLEFSNLEEADHVEGDREDAFN

SEQ ID NO: 4308 - protein, 2334 aa, Ceratodon purpureus
MMDAQAPPLPPQQTAAASAADAEARLDEKARKWMQLNTKRYGEKRKFGFVETQKEDMPPEHVRKIIRDHGDMSSKKYRHDKRVYLGALKFVPHAVYKLLENMPMPWEQVRDVRVLYHITGAITFVDEIPWVVEPIFLAQWGTMWIMMRREKRDRRHFKRMRFPPFDDEEPPLDYADNLLDVDPLEPIQLELDEEEDSAVYEWFYDYKPLVKTKLINGPSYRRWHLSLPIMAALHRLAGQLLSDLIDRNYFYLFDMESFFTAKALNLCIPGGPKFEPLYRDMEKGDEDWNEFNDINKLIIRSPLRTEYRIAFPHLYNNRPRKVKLGVYHTPMVMYIKSEDPDLPAFYFDPLIHPIAFYKTDKRGERKAFQEEEDEDDFVLPEGVEPLLENVPQYTDTTAAGIALLFAPRPFNMRSGRTRRAEDIPLVSDWYKEHCPPTYPVKVRVSYQKLLKCYVLNELHHRPPKGQKKKYLFRSLRATKFFQTTELDWAEAGLQVCKQGYNMLNLLIHRKNLNYLHLDYNFNLKPVKTLTTKERKKSRFGNAFHLCREILRLTKLVVDANIQFRLGNVDAYQLADGLQYTFSHVGQLTGMYRYKYRLMRQIRMCKDLKHLIYYRFNTGPVGKGPGCGFWAPMWRVWLFFLRGVVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSHLIPVYEIEPLEKITDAYLDQYLWYEGDKRHLFPNWIKPADSEPPPLLVYKWCQGINNLQDIWDTSEGQCVVMLQTKFEKFFDKIDLTMLNRLLRLVLDHNIADYVTAKNNVVLSYKDMSHTNSYGLLQGLQFASFVVQYYGLVLDLLVLGLTRASEIAGPPQMPNEFITFWDVKVETRHPIRLYSRYIDKVHILFHFTHEEARDLIQRYLTEHPDPNNENIVGYNNKKCWPRDARMRLMKHDVNLGRSVFWDIKNRLPRSITTLEWENSFVSVYSKDNPNLLFSMCGFEVRILPKIRMTQEAFGSKDGVWNLQNEQTKERTAMAYLRVDDEHLKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEDEQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMSKPSLVAEPKDVFDQKASNKYWIDVQLRWGDYDSHDIERYTRAKFLDYTTDNMSIYPAPTGVMIGLDLAYNLHAAFGNWFPGSKPLFAQAINKIMKANPALYVLRERVRKGLQLYSSEPTEPYLSSQNYGELFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPNLSDDQWMKVEVALRDLILSDYAKKNNVNTSALTQSEIRDIILGAEITPPSQQRQQIAEIEKQAKEASQLTAVTTKTTNVHGDDLIVTTTSPYEQAAFGSKTDWRVRAISATNLHLRVNHIYVNSDDIKESGYTYIMPKNVLKKFICIADLRTQIAGYLYGVSPPDNPQVKEIRCIVMPPQWGTHQQVHLPAGLPEHEFLNELEPLGWLHTQPNELPQLSPQDLTSHARILENNKQWDGEKCIILTCSFTPGSCSLTAYKLTPTGYEWGRANKDSGSNPHGYLPTHYEKVQMLLSDRFLGFYMVPDNGPWNYNFMGVKHSVGMKYGIKLSIPREFYHEDHRPTHFLEFSNLEENDAAEGDREDVFT

SEQ ID NO: 4309 - protein, 2358 aa, Fragaria vesca
MWNNGQIVPPGTGGSSIPPPPAAQPSYTVLPPPADAEAVLEEKARKWQQLNSKRYSDKRKFGFVETQKEDMPPEHVRKIIRSVSFVLSLHFLVIDHGDMSSKKFRHDKRVYLGALKFVPHAVYKLLENMPMPWEQVRDVKVLYHITGAITFVNEIPWVVEPIYLAQWGSMWIMMRREKRDRRHFKRMRFPPFDDEEPPLDYADNLLDVDPLEPIQLELDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMVMYIKTEDPDLPAFYYDPLIHPIPSTNKERREKKVDEDDDTFILPEGVEPFLSDTQLYTDTTAAGVSLLFAPRPFNMRSGRTRRAEDIPLVSEWYKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQSIWDTGDGQCVVMLQTKFEKFFDKIDLTMLNRLLRLVLDHNIADYVTAKNNVVLSYKDMSHTNSYGLIRGLQFASFVVQYYGLVLDLLLLGLTRASEIAGPPQMPNEFITYWDTKVETRHPIRLYSRYIDKVHILFRFTHDEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMSQEAFSNTRDGVWNLQNEQTKERTAVAFLRVDDEHMKIFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAEPKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDTTVITEPHHIWPSLSDDQWMKVEVALRDLILSDYAKKNNVNTSALTQSEIRDIILGAEITPPSQQRQQIAEIEKQHKEASQLTAVTTRTTNVHGDELIVTTTSPYEQAAFGSKTDWRVRAISATNLYLRVNHIYVNSEDVKETGYTYIMPKNILKKFICVADLRTQIAGYLYGVSPPDNPQVKEIRCIAMPPQWGTHQQVNLPTALPEHDFLNDLEPLGWMHTQPNELPQLSPQDLTSHAKILENTKQWDGEKCIVLTCSFTPGSCSLTAYKLTPSGYEWGRVNKDTGSNPHGYLPTHYEKVQMLLSDRFLGFYMIPDNGPWNYNFMGVKHTQGMKYGVKLGTPREYYHEDHRPTHYLEFSNMEEGDTVVGDRDDTFT

SEQ ID NO: 4310 - protein, 844 aa, Solanum phureja
FPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKASTVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSVITEPHHIWPSLTDDQWMKVEVALRDLILSDYAKKNNVNTSALTVSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQIAGYLYGVSPPDNPQVKEIRCIAMPPQWGTHQQVHLPSGLPEHDFLTDLEPLGWMHTQPNELPQLSPQDVTSHARVLENNKHWDGEKCIILTCSFTPGSCSLTAYKLTPTGYEWGRANKDTGSNPHGYLPTHYEKVQMLLSDRFLGFYMIPDNGPWNYNFMGVKHTVSMKYGVKLGTPREYYNEDHRPTHFLEFSNMEEGDTAEADREDTFT

SEQ ID NO: 4311 - protein, 1030 aa, Trigonella foenum-graecum
MPSRFPPVIFYTPKEIGGLGMLSMGHILIPQSDLRYSQQTDVGVTHFRSGMSHEEDQLIPNLYRYIQPWESEFVDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKANNKYWVDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEPHHIWPSLSDDQWMKVEVALRDLILSDYAKKNNVNTSALTQSEIRDIILGAEITPPSQQRQQIAEIEKQAHEANQVTAVTTKTTNVHGDDLIVTTTSPYEQAAFGSKTDWRVRAISATNLYLRVNHIYVNSEDIKETGYTYIMPKNILKKFICIADLRSQISGYLYGISPPDNPQVKEIRCIVMPPQWGNHQQVHLPSALPEHDFLTDLEPLGWMHTQPNELPQLSPQDLISHAKVLENNKQWDGEKCIILTCSFTPGSCSLTAYKLTPSGYEWGRITKDPTINPHGYLPTHYEKVQMLLSDRFLGFYMIPDNGPWNYNFMGVRHASGMKYGVKLGTPREFYHEDHRPTHFLEFINLEEGETFAEGDREDTFS

SEQ ID NO: 4312 - protein, 2351 aa, Eucalyptus grandis
MWNDAGNGQTAPPGNSDPSTITLPPAPQPSYTVLPSPAEAEARLEGKARKWMQLNSKRYGDKRKFGFVEPQKEDMPPEHVRKIIRDHGDMSSKKYRHDKRVYLGALKFVPHAVYKLLENMPMPWEQVRDVKVLYHITGAITFVNEIPWVVEPIYLAQWGTMWIMMRREKRDRRHFKRMRFPPFDDEEPPLDYADNLLDVDPLEPIQLELDEEEDSAVCAWFYDHKPLVKTKLVNGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCVYHTPMVMYIKTEDPDLPAFYYDPLIHPIASISKDRREKKAYDDEDEENFSLPEGIEPLLNDTQLYTDTTAAGISLLFAPRPFDARSGHMRRAEDIPLVSEWYKEHCPPTYPVKVRVSYQKLLKCFVLNELHHRPPKAQKKKHLFRSLQATKFFQTTELDWVEAGLQVCKQGYNMLNLLIHRKNLNYLHLDYNFNLKPVKTLTTKERKKSRFGNAFHLCREILRLTKLVVDANVQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTITKQRVESHFDLELRAAVMHDVLDAMPEGIKHNKARTILQHLSEAWRCWKANIPWKVPGLPVPIENMILRYVKSKADWWTNVAHYNRERIRRGATVDKTVCRKNLGRLTRLWFKAEQERQHNYLKDGPFITPEEAVAIYTTTVHWLESRKFSPIPFPPLSYKHDTKLLILALEKLKESYSVAVRLNQLQREELGLIEQAYDNPHEALSRIKRHLLTRHAFREVGIEFMDLYSYLIPVYEIEPLEKITDAYLDQYLWYEGDKRHLFPNWIKPADSEPPPLLVYKWCQGINNLQAIWDTSEGQCVVMLQTKFEKFFEKIDLHFLNRLLRLILDHHIADYITEKSNAVLSYKDMSHTNFYGFIRGLQFSSFVVQFYGLVLDLLLLGLTRASEIAGPPQMPNEFITYWDTKVETRHPIRLYSRYIDRVHILFRFTHDEARDLIQRYLTEHPDPNNENMVGYNNKKCWPRDARMRLMKHDVNLGRSVFWDMKNRLPRSLTTLEWENSFVSVYSKDNPNLLFSMCGFEVRILPKIRMTQEAFSNTRDGVWSLQNEQTKERTAAAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEALTQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDIQLRWGDYDSHDIERYTRAKFMDYTTDNMSIYPSPAGIMIGLDLAYNLHSAFGNWFPGSKPLFAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQVIVTRKGMLDPLEVHLLDFPNIVIKGSELQLPFQACLKIEKFGDLILRATEPQMLLFNIYDDWLKSISSYTAFSRLILILRALHVNNEKAKMLLKPDKTVVTEPHHIWPSLTDDQWMKVEVALRDLILSDYAKKNNVNTTALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQIAGYLYGISPPDNPQVKEIRCIAMPPQWGTHQQVNLPSALPQHDFLNDLEPLGWMHSQPNELPQLSPQDLTNHARVLENNKQWDGEKCIILTCSFTPGSCSLTAYKLTPSGYEWGRLNKDTGSNPAGYLPTHYEKVQILLSDRFLGFYMIPDNGPWNYNFMGVKHTSSMKYGMKLGTPREYYHEDNRPTHFLEFSKMEEDDTAEGDREDTFS

SEQ ID NO: 4313 - protein, 2358 aa, Physcomitrella patens
MMDPQAPPTAPQQTAASAAADAEAHLEEKARKWHQLNSKRYGEKRKFGFVETQKEDMPPEHVRKIIRSWSFLQFFIICLFDTLERRCLLFWDHGDMSSKKYRHDKRVYLGALKFVPHAVYKLLENMPMPWEQVRDVRVLYHITGAITFVDEIPWVVEPIFLAQWGTMWIMMRREKRDRRHFKRMRFPPFDDEEPPLDYADNLLDVDPLEPIQLELDEEEDAAVYEWFYDYKPLVKTKLINGPSYRRWHLSLPIMAALHRLAGQLLSDLIDRNYFYLFDMESFFTAKALNLCIPGGPKFEPLYRDMEKGDEDWNEFNDINKLIIRSPLRTEYRIAFPHLYNNRPRKVKLCVYHTPMVMYIKSEDPDLPAFYFDPLIHPIAFYKTDKRGEKKGFQEEEDEDDFVLPEGVEPLLQDVPQYTDTTAAGIALLFAPRPFNMRSGRMRRAEDIPLVSDWYKEHCPPTYPVKVRVSYQKLLKCYVLNELHHRPPKGQKKKYLFRSLRATKFFQTTELDWAEAGLQVCKQGYNMLNLLIHRKNLNYLHLDYNFNLKPVKTLTTKERKKSRFGNAFHLCREILRLTKLVVDANIQFRLGNVDAYQLADGLQYTFSHVGQLTGMYRYKYRLMRQIRMCKDLKHLIYYRFNTGPVGKGPGCGFWAPMWRVWLFFLRGVVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSHLIPVYEIEPLEKITDAYLDQYLWYEGDKRHLFPNWIKPADSEPPPLLVYKWCQGINNLQDIWDTSEGQCVVMLQTKFEKFFDKIDLTMLNRLLRLVLDHNIADYVTAKNNVVLSYKDMSHTNSYGLLQGLQFASFVVQYYGLVLDLLVLGLTRASEIAGPPQMPNEFITFWDVKVETRHPIRLYSRYIDKVHILFRFTHEEARDLIQRYLTEHPDPNNENIVGYNNKKCWPRDARMRLMKHDVNLGRSVFWDIKNRLPRSITTLEWENSFVSVYSKDNPNLLFSMCGFEVRILPKIRMTQEAFGSKDGVWNLQNEQTKERTAMAYLRVDDEHLKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEDEQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMSKPSLVAEPKDVFDQKASNKYWIDVQLRWGDYDSHDIERYTRAKFLDYTTDNMSIYPAPTGVMIGLDLAYNLHAAFGNWFPGSKPLFAQAINKIMKANPALYVLRERVRKGLQLYSSEPTEPYLSSQNYGELFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPNLSDDQWMKVEVALRDLILSDYAKKNNVNTSALTQSEIRDIILGAEITPPSQQRQQIAEIEKQAKEASQLTAVTTKTTNVHGDDLIVTTTSPYEQAAFGSKTDWRVRAISATNLHLRVNHIYVNSDDIKESGYTYIMPKNVLKKFICIADLRTQIAGYLYGVSPPDNPQVKEIRCIVMPPQWGTHQQVHLPANLPEHEFLNELEPLGWLHTQPNELPQLSPQDLTSHARVLENNKQWDGEKCIILTCSFTPGSCSLTAYKLTPTGYEWGRANKDSGSNPHGYLPTHYEKVQMLLSDRFLGFYMVPDNGPWNYNFMGVKHSVGMKYGIKLSIPREFYHEDHRPTHFLEFSNLEDNDAAEGDREDVFT

SEQ ID NO: 4314 - protein, 2334 aa, Physcomitrella patens
MDPQAPPMAPPPPASASTAADAEARLDEKARKWHQLNAKRYGEKRKFGFVETQKEDMPPEHVRKIIRDHGDMSSKKYRHDKRVYLGALKFVPHAVYKLLENMPMPWEQVRDVRVLYHITGAITFVDEIPWVVEPIFLAQWGTMWIMMRREKRDRRHFKRMRFPPFDDEEPPLDYADNLLDVEPLEPIQLELDEEEDSAVYEWFYDYKPLVKTKLINGPSYRRWHLSLPIMAALHRLAGQLLSDLIDRNYFYLFDMESFFTAKALNLCIPGGPKFEPLYRDMEKGDEDWNEFNDINKLIIRSPLRTEYRIAFPHLYNNRPRKVKLGVYHTPMVMYIKSEDPDLPAFYFDPLIHPIAFYKTDKRGERKGFQEEEDEDDFVLPEGVEPLIQDIPQYTDTTAAGIALLFAPRPFNMRSGRMRRAEDIPLVSDWYKEHCPPTYPVKVRVSYQKLLKCYVLNELHHRPPKGQKKKYLFRSLRATKFFQTTELDWAEAGLQVCKQGYNMLNLLIHRKNLNYLHLDYNFNLKPVKTLTTKERKKSRFGNAFHLCREILRLTKLVVDANIQFRLGNVDAYQLADGLQYTFSHVGQLTGMYRYKYRLMRQIRMCKDLKHLIYYRFNTGPVGKGPGCGFWAPMWRVWLFFLRGVVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSHLIPVYEIEPLEKITDAYLDQYLWYEGDKRHLFPNWIKPADSEPPPLLVYKWCQGINNLQDIWDTSEGQCVVMLQTKFEKFFDKIDLTMLNRLLRLVLDHNIADYVTAKNNVVLSYKDMSHTNSYGLLQGLQFASFVVQYYGLVLDLLVLGLTRASEIAGPPQMPNEFITFWDVKVETRHPIRLYSRYIDKVHILFRFTHEEARDLIQRYLTEHPDPNNENIVGYNNKKCWPRDARMRLMKHDVNLGRSVFWDIKNRLPRSITTLEWENSFVSVYSKDNPNLLFSMCGFEVRILPKIRMTQEAFGSKDGVWNLQNEQTKERTAMAYLRVDDEHLKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEDEQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAYKWPMSKPSLVAEPKDVFDQKASNKYWIDVQLRWGDYDSHDIERYTRAKFLDYTTDNMSIYPAPTGVMIGLDLAYNLHAAFGNWFPGSKPLFAQAINKIMKANPALYVLRERVRKGLQLYSSEPTEPYLSSQNYGELFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTVVTEPHHIWPNLSDDQWMKVEVALRDLILSDYAKKNNVNTSALTQSEIRDIILGAEITPPSQQRQQIAEIEKQAKEASQLTAVTTKTTNVHGDDLIVTTTSPYEQAAFGSKTDWRVRAISATNLHLRVNHIYVNSDDIKESGYTYIMPKNVLKKFICIADLRTQIAGYLYGVSPPDNPQVKEIRCIVMPPQWGTHQQVHLPSSLPEHEFLNELEPLGWLHTQPNELPQLSPQDLTSHARVLENNKQWDGEKCIILTCSFTPGSCSLTAYKLTPTGYEWGRANKDSGSNPHGYLPTHYEKVQMLLSDRFLGFYMVPDNGPWNYNFMGVKHSVGMKYGIKLSIPREFYHEDHRPTHFLEFSNLEENDVAEGDREDVFQ

SEQ ID NO: 4315 - protein, 2273 aa, Medicago truncatula
VRKIIRDHGDMSSTKFRHDKRVYLGALKFVPHAIYKLLENMPMPWEQVRDVKVLYHVSGAITFVNEIPLVIEPIYIAQWSTMWIMMRREKRDRRCFKRMRFPPFDDEEPVIDYADNLLEVEPLEAIHLELDEEEDGPVFDWFYDHKPLVKTKFVNGLSYRKWCLPIPVMETLHRLAGQLLSDLCDRNYFYLFDVESFFTAKALNMCIPGGPKFEPLYRDAEKGDEDWNEFNDIHKLIIRSKLRTEYRIAFPHLYNDRPRKVRLGVYHTPMVVYVKADDPDLPAFYYDPLIHPIAGAGNKERCEMEICNEDDDDWILPDGVEPFLKDVELYTDTTTDGMSLLFAPRPFNMRSGRMRRAEDIPLVSEWYKEHCPPSYPVKVRVSYQKLLKCFVLNELHHRPPKPQQKKNLFRSLQATKFFQTTELDWVEAGLQVCKQGYNMLNLLIHRKNLNYLHLDYNFNLKPVKTLTTKERKKSRFGNAFHLCREILRLTKLVVDANVQYRLGNVDAFQLADGLQYTFSHVGQLTGMYRYKYRLLRQIRMCKDLKHLIYYRFNTGPVGKGPGCGFWAPMWRVWLFFLRGIVPLLERWLGNLLARQFEGRHSKGVAKTVTKQRVESHFDLELRAAVIHDVVDAIPEGMKETKSRVILQHLSEAWRCWKANIPWKVPGMAVPIENMILRYVKSKADWWTNVTHYNRERIRRGATVDKTVCRKNLGRMTRLWLMAEQERQCNYSKDGPYVTPEDGVTIYTTIVHWLESRKFSHIPFPPLSYKHDTKLLILALERLKESYSGSARLNQFQREELGLIEQAYDNPHEALSRIKRHLLTQRAFKEVGIEFMDLYGYLIPVYEIEPLEKITDAYLDQYLWYEGDKRHLFPNWIKPADSEPPPLLVYKWCQGINNLEGIWDTSDGHCVVMLQTKFEKFFEKIDILMLNRLLRLVLDHNIADYITAKNNVVLSYKDMSHTNKYGLIRGLQFASFVAQYYGLILDLLLLGLTRAREIAGPPQMPNEFITYWDTKVETRHPIRLHSRYIDKVYMLFRFTHEEARDLIQKYLTEHPDPNNENMVGYNNKKCWPRDARMRLMKHDVNLGRSVFWDMKNRLPRSITTLEWENSFVSVYSKDNPNLLFSMCGFEVRILPKIRTTQEAFGNTRDGVWNLQNEQTKERTATAFLRVDDEQIKMFENRVRQILMSSGSTTFTKIVNKWNTALIGLMTYFREATVHTQELLDLLVKCENKIQTRIKIGLNSKMPSRFPPVIFYSPKEVGGLGMLSMGHILIPQSDIRHNQKTDVGVTHFRSGMSHEEGQLIPSLHRYIQPWEREFNDSQRVWAEYAVKRQVAQAQNRRLTLEDLEDSWDQGIPRINTLFQKDRHTLAYDKGWRVRLDFKQYQVLKQNPFWWTHQRHDGKLWNLNNYRTDVIQALGGIEQILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHKWPMSKPSLVAESKDVFDQKASNKYWIDVQLRWGDYDSHDIERYTRAKFMDYTTDNMSIYPSPTGVMIGLDLAYNLHSAFGNWFPGSKPLLQQAMNKIMKLNPALYVLRERIRKGLQLYSSEPTEPYLSSQNYGEIFNNQIKWFVDDTNVYRVTIHKTFEGNLTTKPINGAIFIFNPRTGQLFLKVIHTSVWAGQKRLGQLAKWKTAEEVAALVRSLPVEEEPKQIIVTRKGMLDPLEVHLLDFPNIVIKGSELQLPFQACLKIEKFGDLILKATEPQMVLFNIYDDWLKSISSYTAFSRLILILRALHVNNEKAKMLLRPDITAVTEPHHIWPSLSDDQWMKVEVALRDLILSDYAKKNNVNTSALTQSEIRDIILGAEITPPSQQRQQIAEIEKQAREANQVTAVTTQTTNVHGEGLIVTTTSPYEQAAFGSKTDWRVRAISATNLYLRVNHIYVNSEDIKETGYTYIMPKNILKKFICIADLRTQISGYLYGISPPDNPQVKEIRCIVMPPQWGTHQHVHLPSDLPEHDFLNDLEPLGWMHTQPNEVPQLSPQDLTSHAKVLENNKQWDGEKCIILTCSFTPGSCSLTAYKLTPSGYEWGRINKDTGSNPHGYLPTHYEKVQMLLSDRFIGFYMIPDNGPWNYNFMGVRHASGMKYGVKLGTPREYYHEDHRPTHFLEFSNMEEGETIAKGDREDTFS

SEQ ID NO: 4316 - protein, 2261 aa, Aquilegia formosa
MSSKKYRHDKRVYLGALKFIPHAVYKLLENMPMPWEQVRDVKILYHITGAITFVNEIPWVVEPIYMAQWGTMWIMMRREKRDRRHFKRMRFPPFDDEEPPLDYADNLLDVDPLEPIQLELDEEEDSAVCTWFYDHKPLVKTKLINGPSYRRWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVKLCIYHTPMIMYIKTEDPDLPAFYYDPLLHPIVPSNTDRIERKLHEEVDDDFSLPEGVEPLLQSTQLYTDTTAAGISLLFAPRPFNMRSGRMRRAEDIPLVSEWYKEHCPPSYPVKVRVSYQKLLKCFVLNMLHHRPPKAQKKKHLFRSLQATKFFQSTQLDWAEAGLQVCKQGYNMLNLLIHRKNLNYLHLDYNFNLKPVKTLTTKERKKSRFGNAFHLCREILRLTKLVVDANIQFRLGNVDAFQLADGLQYTFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGIWDTSDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQSPNEFITFGDTKVETRHPIRLYSRYIDRVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSQQTDVGVTHFRSGMSHEEDQLIPNLYRYIQPWESEFVDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKVHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKIIHTSVWAGQKRLGQLAKWKTAEEVAALVRSLPVEEQPKQIIVTRKGMLDPLEVHLLDFPNIVIKGSELQLPFQACLKIEKFGDLILKATEPQMLLFNLYDDWLKSISSYTAFSRLILILRALHVNNEKAKMLLKPDKTITTQPHHIWPSLTDDQWMKVEVALRDLILSDYAKKNNVNTSALTQSEIRDIILGAEITPPSQQRQQIAEIEKQAKEASQLTAVTTRTTNVHGDELIVSTISPYEQAAFASKTDWRVRAISATNLYLRVNHIYVNSEDIKETGFTYIMPKNILKKFICIADLRTQIAGYLYGISPPDNPQVKEIRCITMVPQWGTHQEVHLPLELPGHEFLNDLEPLGWMHTQPNELPQLSPQDLTYHAKILETHKQWDGEKCIVLTCSFTPGSCSLTAYKLTPSGYEWGRVNKDTGGNPHGYLPTHYEKVQMLLSDRFLGFYMVPDNGPWNFNFMGVKHKHDMDYGIKLGTPREYYHYDHRPTHYLEFSNLEEGETQEGDREDTFT

SEQ ID NO: 4317 - protein, 2374 aa, Mimulus guttatus
MPPMAPPGTSGVQPVPPPLATVPPSYTVVPSESQLDERARKWMQLNTKRYSDKRKFGFVETQKEDMPPEHVRKIIRSAEKFLLTFPQLCIYNIYIPRSYMMYVLFFENVCIDFAKYRHDKRVYLGALKFVPHAVYKLLENMPMPWEQVREVKVLYHITGAITFVNEIPWVVEPIYLAQWGTMWIMMRREKRDRRHFKRMRFPPFDDEEPPLDYADNLLDVDPLEPIQLEMDEEEDSAVYTWFYDHKPLVKTKLINGPSYRKWHLSLPIMATLHRLAGQLLSDLIDRNYFYLFDMESFFTAKALNMCIPGGPKFEPLYRDMEKGDEDWNEFNDINKLIIRSPLRTEYRIAFPHLYNNRPRKVRLSIYHTPMVMYIKTEDPDLPAFYYDPLIHPITSTNKDRRDKKIYEEDDDDDFVLPEGVEPLLTSTPIYTDTTAAGVSLLFAPRPFNMRSGRMRRAEDIPLVSEWYKEHCPPSYPVKVRVSYQKLLKCFVLNELHHRPPKAQKKKHLFRSLQATKFFQTTELDWAEAGLQVCKQGYNMLNLLIHRKNLNYLHLDYNFNLKPVKTLTTKERKKSRFGNAFHLCREILRLTKLVVDANIQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPGKQGIKANKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQLQREELGLIEQAYDNPHEALSRIKRHLLTQRAFKEVGIEFMDLYSYLIPVYEIEPLEKITDAYLDQYLWYEGDKRHLFPNWIKPADSEPPPLLVYKWCQGINNLQGVWDTGDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITFHDTRVETRHPIRLYSRYIEKVHILFRFTHEEARDLIQRYLTEHPDPNNENMVGYNNKKCWPRDARMRLMKHDVNLGRSVFWDMKNRLPRSITTLEWENGFVSVYSKDNPNLLFSMSGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFVDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKTISSYTAFSRLILILRALHVNNEKAKMLLKPDKTIVTEPHHIWPSLSEDQWVKVEVALRDLILSDYAKKNNVNTSALTQSEMRDIILGAEITPPSQQRQQIAEIEKQAKEASQLTAVTTKTTNVHGEELIVTTTSPYEQAAFGSKTDWRVRAISATNLHLRVNHIYVNSEDIKETGYTYIMPKNVLKKFICIADLRTQIAGYLYGVSPPDNPQVKEIRCIAMPPQWGTHQQVNLPSALPEHDFLNDLEPLGWMHTQPNELPQLSPQDLAAHAKVLFNNKQWDGEKCIILTCSFTPGSCSLTAYKLTPSGYEWGKSNTDAASNPHGYLPTYYEKVQMLLSDRFLGFYMIPDNGPWNYNFMGVKHTPGMRYGVKLGTPREYYHEDHRPTHFLEFSNLEEGDTAEGDREDTFT

SEQ ID NO: 4318 - protein, 2382 aa, Arabidopsis thaliana
MWNNNDGMPLAPPGTGGSMMPPPPAAHPSYTALPPPSNPTPPVEPTPEEAEAKLEEKARKWMQLNSKRYGDKRKFGFVETQKEDMPPEHVRKIIRLVFFSSFSTISKYSLLDNYFLARDHGDMSSKKFRHDKRVYLGALKFVPHAVFKLLENMPMPWEQVRDVKVLYHITGAITFVNEIPWVVEPIYMAQWGTMWIMMRREKRDRRHFKRMRFPPFDDEEPPLDYADNLLDVDPLEPIQLELDEEEDSAVHTWFYDHKPLVKTKLINGPSYRRWNLSLPIMATLHRLAGQLLSDLIDRNYFYLFDMPSFFTAKALNMCIPGGPKFEPLYRDMEKGDEDWNEFNDINKLIIRSPLRTEYRIAFPHLYNNRPRKVKLCVYHSPMIMYIKTEDPDLPAFYYDPLIHPISNTNKEKRERKVYDDEDDFALPEGVEPLLRDTQLYTDTTAAGISLLFAPRPFNMRSGRTRRAEDIPLVSEWFKEHCPPAYPVKVRVSYQKLLKCYVLNELHHRPPKAQKKKHLFRSLAATKFFQSTELDWVEVGLQVCRQGYNMLNLLIHRKNLNYLHLDYNFNLKPVKTLTTKERKKSRFGNAFHLCREILRLTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEALAIYTTTVHWLESRKFSPIPFPPLSYKHDTKLLILALERLKESYSVAVRLNQQQREELGLIEQAYDNPHEALSRIKRHLLTQRGFKEVGIEFMDLYSYLIPVYEIEPLEKITDAYLDQYLWYEGDKRHLFPNWIKPADSEPPPLLVYKWCQGINNLQGIWDTGDGQCVVMLQTKFEKFFEKIDLTMLNRLLRLVLDHNIADYVSAKNNVVLSYKDMSHTNSYGLIRGLQFASFVVQFYGLLLDLLLLGLTRASEIAGPPQMPNEFMTFWDTKVETRHPIRLYSRYIDKVHIMFKFTHEEARDLIQRYLTEHPDPNNENMVGYNNKKCWPRDARMRLMKHDVNLGRSVFWDMKNRLPRSITTLEWENGFVSVYSKDNPNLLFSMCGFEVRILPKIRMTQEAFSNTKDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHKWPMSKPSLVAESKDMFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSVVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQSAFGSKTDWRVRAISATNLYLRVNHIYVNSDDIKETGYTYIMPKNILKKFICVADLRTQIAGYLYGISPPDNPQVKEIRCVVMVPQWGNHQLVHLPSSLPEHDFLNDLEPLGWLHTQPNELPQLSPQDVTSHSRILENNKQWDGEKCIILTCSFTPGSCSLTSYKLTQTGYEWGRLNKDNGSNPHGYLPTHYEKVQMLLSDRFLGFYMVPESGPWNYSFTGVKHTLSMKYSVKLGSPKEFYHEEHRPTHFLEFSNMEEADITEGDREDTFT

SEQ ID NO: 4319 - protein, 699 aa, Triphysaria pusilla
WPMSKPSLVAESKDVFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKTIVTEAHHIWPSLSDDQWTKVEVALRDLILSDYAKKNNVNTSALTQSEIRDIILGAEITPPSQQRQQIAEIEKQAKDASQLTAVTTRTTNVHGDEIIVTTISPYEQAAFGSKTDWRVRAISSTNLHLRVNHIYVNSDDIKETGYTYIMPKNILKKFICIADLRTQISGYLYGISPPDNPQVKEIRCIAMPPQWGTHQQVHLPSALPEHDFLNDLEPLGWMHTQPNELPQLSPQDLAAHARVLSNNKQWDGEKCIILTCSFTPGSCSLTAYKLTPSGYEWGKSNSDVASNPHGYLPTYYEKVQMLLSDRFLGFYMIPDNGPWNYNFMGVKHTVSMKYGVKLGTPREYYNEDHRPTHFLEFSNLEEGDMAEGDREDTFT

SEQ ID NO: 4320 - protein, 2381 aa, Arabidopsis lyrata
MWNNNDGMPLAPPGTGGSMMPPPPAAHPSYTALPPPSTPTPPLEPTPEEAEAKLEEKARKWMQLNSKRYGDKRKFGFVETQKEDMPPEHVRKIIRRVFSSSISNSSLLEYYFLARDHGDMSSKKFRHDKRVYLGALKFVPHAVFKLLENMPMPWEQVRDVKVLYHITGAITFVNEIPWVVEPIYMAQWGTMWIMMRREKRDRRHFKRMRFPPFDDEEPPLDYADNLLDVDPLEPIQLELDEEEDSAVYTWFYDHKPLVKTKLINGPSYRRWNLSLPIMATLHRLAGQLLSDLIDRNYFYLFDMPSFFTAKALNMCIPGGPKFEPLYRDMEKGDEDWNEFNDINKLIIRSPLRTEYRIAFPHLYNNRPRKVKLCVYHSPMVMYIKTEDPDLPAFYYDPLIHPISNTNKDKRERKVYDDDDEDDFALPEGVEPLLKDTQLYTDTTAAGISLLFAPRPFNMRSGRTRRAEDIPLVSEWFKEHCPPAYPVKVRVSYQKLLKCYVLNELHHRPPKAQKKKHLFRSLAATKFFQSTELDWVEVGLQVCRQGYNMLNLLIHRKNLNYLHLDYNFNLKPVKTLTTKERKKSRFGNAFHLCREILRLTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARTILQHLSEAWRCWKANIPWKVPGLPVPVENMILRYVKSKADWWTNVAHYNRERIRRGATVDKTVCRKNLGRLTRLWLKAEQERQHNYLKDGPYVTPEEALAIYTTTVHWLESRKFSPIPFPPLSYKHDTKLLILALERLKESYSVAVRLNQQQREELGLIEQAYDNPHEALSRIKRHLLTQRGFKEVGIEFMDLYSYLIPVYEIEPLEKITDAYLDQYLWYEGDKRHLFPNWIKPADSEPPPLLVYKWCQGINNLQGIWDTGDGQCVVMLQTKFEKFFEKIDLTMLNRLLRLVLDHNIADYVSAKNNVVLSYKDMSHTNAYGLIRGLQFASFVVQFYGLLLDLLLLGLTRASEIAGPPQMPNEFMTFWDTKVETRHPIRLYSRYIDKVHIMFKFSHEEARDLIQRYLTEHPDPNNENMVGYNNKKCWPRDARMRLMKHDVNLGRSVFWDMKNRLPRSITTLEWENGFVSVYSKDNPNLLFSMCGFEVRILPKIRMTQEAFSNTRDGVWNLQNEQTKERTAVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADVLLFAAHKWPMSKPSLVAESKDMFDQKASNKYWIDVQLRWGDYDSHDIERYTRAKFMDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRALHVNNEKAKMLLKPDKSVVTEPHHIWPSLTDDQWMKVEVALRDLILSDYAKKNNVNTSALTQSEIRDIILGAEITPPSQQRQQIAEIEKQAKEASQLTAVTTRTTNVHGDELIVTTTSPYEQSAFGSKTDWRVRAISATNLYLRVNHIYVNSDDIKETGYTYIMPKNILKKFICVADLRTQIAGYLYGISPPDNPQVKEIRCVVMVPQWGSHQQVHLPSSLPEHDFLNDLEPLGWLHTQPNELPQLSPHDVTSHSRVLENNKQWDGEKCIILTCSFTPGSCSLTSYKLTQTGYEWGRLNKDTGSNPHGYLPTHYEKVQMLLSDRFLGFYMVPENGPWNYNFMGVKHTVSMNYSVKLGSPKEYYHEEHRPTHFLEFSNMEEADIAEGDREDTFT

SEQ ID NO: 4321 - protein, 326 aa, Sequoia sempervirens
MQRRNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSDDIKETGYTYIIPKNILKKFICIADLRTQIAGYLYGVSPPDNPQVKEIRCISMPPQWGTHQQVHLPLALPEHDFLNDLEPLGWMHTQPNELPQLSPQDLTCHARILENNKQWDGEKCIILTCSFTPGSCSLTAYKLTPTGYEWGRLNKDTGSNPHGYLPTHYEKVQMLLSDRFLGFYMVPDNGPWNYNFMGVKHTVSMKYGVKLGTPRDFYHEDHRPTHFLE

SEQ ID NO: 4322 - protein, 42 aa, Raphanus sativus
IWFVDDTNVYRVTIHKTFEGNLTTKPINGAILFSIQELDSYS

SEQ ID NO: 4323 - protein, 925 aa, Plantago ovata
MILRYVKSKADWWTNVAHYNRERIRRGATVDKTVCRKNLGRLTRLWLKAEQERQHNYLKDGPYVTPEEAVAIYSTTVHWLESRKFSPIPFPPLSYKHDTKLLILALERLKESYSVAVRLNQLQREELGLIEQAYDNPHEALSRIKRHLLTQRSFKEVGIEFMDLYSYLIPVYEIEPLEKITDAYLDQYLWYEGDKRHLFPNWIKPADSEPPPLLVYKWCQGINNLQNIWDTGDGQCVVMLQTKFEKFFEKIDLTMLNRLLRLVLDHNIADYVTAKNNVVLSYKDMSHTNSYGLIRGLQFASFVVQYYGLVLDLLLLGLTRASEIAGPPQMPNEFITFHDTRVETRHPIRLYSRYIDKVHILFRFTHEEARDLIQRYLTEHPDPNNENMVGYNNKKCWPRDARMRLMKHDVNLGRSVFWDMKNRLPRSITTLEWENSFVSVYSKDNPNLLFSMCGFEVRILPKIRMTQEAFSNMRDGVWNLQNEQTKERTSVAFLRVDDEHMKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILFLLPIDGLCQSPVLWRRQRMSLTRRLVISTG

SEQ ID NO: 4324 - protein, 2299 aa, Silene vulgaris
MQLNSKRYGDKRKFGFVETQKEDMPPEHVRKIIRDHGDMSSKKYRHDKRVYLGALKFVPHAVYKLLENMPMPWEQVRDVKVLYHITGAITFVNEIPWVVEPIYLAQWGTMWIMMRREKRDRRHFKRMRFPPFDDEEPPLDYADNVLDVDPLEPIQLELDEEEDSAVHAWFYDHKPLVKTKLINGPSYRKWHLSLPIMATLYRFAGQLLSDLVDRNYFYLFDMESFFTAKALNMCIPGGPKFEPLYRDMEKGDEDWNEFNDINKLIIRSPLRTEYRIAFPHLYNNRPRKVRLGPYHTPMIMYIKTEDPDLPAFYYDPLIHPITAAPKDRREKKVYEEDEDDFELPEGVEPLLTDTQLYTDTTAAGISLLYAPRPFNMRSGRTRRAEDIPLVSEWFKEHCPPSYPVKVRVSYQKLLKCFVLNELHHRPPKAQKKKHLFRSLAATKFFQSTELDWVEAGLQVCRQGYNMLNLLIHRKNLNYLHLDYNFNLKPVKTLTTKERKKSRFGNAFHLCREILRLTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVLDAMPEGIKQNKARVILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLNQQQREELGLIEQAYDNPHEALSRIKRHLLTQRAFKEVGIEFMDLYSYLIPVYEIEPLEKITDAYLDQYLWYEGDKRHLFPNWVKPADTEPPPLLVYKWCQGINNLQSIWDTSEGQCVVMLQTKFEKFFEKIDLTMLNRLLRLILDHNIADYVTAKNNVVLSYKDMSHTNSYGLIRGLQFASFVVQYYGLVLDLLLLGLTRASEIAGPPQMPNEFMTYWDTKVETRHPIRLYSRYIDKVHIMFRFTHEEARDLIQRYLTEHPDPNNENMVGYNNKKCWPRDARMRLMKHDVNLGRSVFWDMKNRLPRSITTLEWENGFVSVYSKDNPNLLFSMCGFEVRILPKIRMTQEAFSNTKDGVWNLQNEQTKERTAVAFLRVDDEHLKVFENRVRQILMSSGSTTFTKIVNKWNTALIGLMTYFREATVHTQELLDLLVKCENKIQTRIKIGLNSKMPSRFPPVIFYTPKEIGGLGMLSMGHILIPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGWRVRTDFKQYQVLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDALEIETVQKETIHPRKSYKMNSSCADILLFAAHRWPMSKPSLVAETKDVFDQKASNKYWVDVQLRWGDYDSHDIERYTRAKFLDYTTDNMSIYPSPTGVMIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLFNIYDDWLKSISSYTAFSRLILILRSLHVNNEKAKMLLKPDRTVVTEPHHIWPSLTDDQWMKVEVALRDLILSDYAKKNNVNTSALTQSEIRDIILGAEITPPSQQRQQIAEIEKQAKATSQLTAVTTKTTNVHGEELIVSTTSPYEQEKFSSKTDWRVRAISATNLYLRVNHIYVNSEDIKETGYTYIMPKNILKKFICIADLRTQIAGYLYGVSPPDNPQVKEIRCIAMPPQLGTHQQVNLPLQLPEHDFLNDLEPLGWMHTQPNELPQLSPQDVTSHARILENNKQWDGEKCIILTCSFTPGSCSLTAYKLTPAGYEWARAQKDTGTSLHGYLPTHSEKVQMLLSDRFLGFYMVPDSSPWNYNFMGAKHAPNLKYGVKLGTPKEYYHEEHRPTHYLEFIKMEEGDSVEVEREDKFS

SEQ ID NO: 4325 - protein, 2197 aa, Arabidopsis lyrata
MAQWGSMWIMMRREKRDRRHFKRMRFPPFDDEEPPLDYADNLLDVDPLEPIQLELDEEDDSALYSWFYDHKPLVKTKLINSPSYQTWNLSLPIMSTLHRLAAQLLSDLVDRNYFYLFDMPSFFTAKALNMCIPGGPKFEPLYRDMEKGDEDWNEFNDINKLIIRSPLRTEYRVAFPHLYNNRPRKVKLCVYHTPMIMYIKTEDPDLPAFYYDPLIHPISNSSNTNKEHRKSNGYDDDEDDFVLPEGVQPLLNNSPLYTETTAAGISLLFAPRPFNMRSGRTRRAEDIPLVAEWFKEHCPPAYPVKVRVSYQKLLKCYVLNELHHRPPKSQKKKHLFRSLAATKFFQSTELDWVEVGLQVCRQGYNMLNLLIHRKNLNYLHLDYNFNLKPVKTLTTKERKKSRFGNAFHLCREILRVTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRAESHFDLELRASVMHDVVDAMPEGINQNKARTILQHLSEAWRCWKANIPWKVPGLPVAIENMILRYVKSKADWWTNVAHYNRERIRRGATVDKTVCRKNLGRLTRLWLKAEQERQHNFQKDGPYVTADEGIAIYSTTVNWLESRKFSPIPFPPLSYKHDTKLLILALERLKESYSAAVRLNQQQREELGLIEQAYDNPHEALMRIKRHLLTQHSFKEVGIEFMDLYSHLIPVYQIDPLEKITDAYLDQYLWYEGDKRHLFPNSIKPADSEPPPLLVYKWCQGINNLQGIWDTSDSQCVVMLQTKFEKLFEKIDFTVLNSLLRLVLDHKLANYVTGKNNVVLSYKDMSYTNTYGLIRGLQFASFVVQFYGLVLDLLLLGLTRASEIAGPPQRPNEFMTYWDTKVETRHPIRLYSRYIDKVHIMFKFTHEEARDLIQRHLTERPDPNNENMVGYNNKKCWPRDAWMRLMKHDVNLGRSVFWDMKNRLPRSITTLEWENGFVSVYSKDNPNLLFSMCGFEVRMLPKIRMGQEAFSSTRDGVWNLQNEQTKERTAVAFLRVDDEHMKVFENRVRQILMSSGSTTFTKIVNKWNTALIGLMTYFREATVHTQELLDLLVKCENKIQTRVKIGLNSKMPSRFPPVIFYTPKEIGGLGMLSMGHILIPQSDLRYSKQTDVGVSHFRSGMSHEEDQLIPNLYRYIQPWESEFIDSQLVWAEYALKRQEAQTHNRRLTLEDLEDSWDRGIPRINTLFQKDRHTLAYDKGWRVRTDFKQYQSLKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHLWQKIHESVVMDLCQVLDQELDPLEIETVQKETIHPRKSYKMNSSCADVLLFAAYKWPMSKPSLVAESKDMFDQKASNKYWINVQLRWGDYDSHDIERYTRAKFMDYTTDNMSIYPSPTGVIIGLDLAYNLHSAFGNWFPGSKTLLAQAMNKIMKSNPALYVLRERIRKGLQLYSSEPTEPYLSSQNYGEIFSNQIIWFVDDTNVYRVTIHKTFEGNLTTKPINGVIFIFNPRTGQLFLKVIHTSVWAGQKRLGQLAKWKTAEEVAALVRSLPVEEQPKQVIVTRKGMLDPLEVHLLDFPNIVIKGSELQLPFQACLKIEKFGDLILKATEPQMVLFNIYDDWLMTVSSYTAFQRLILILRALHVNNEKAKMLLKPDMSVVTEPNHIWPSLTDDQWMKVEVALRDLILSDYAKKNNVNTSALTQSEIRDIILGAEITPPSQQRQQIAEIEKQSKQASQLTAVTTRTTNVHGDELISTTISPYEQSAFGSKTDWRVRAISATNLYLRVNHIYVNSDDIKETGYTYVMPKNILKKFICIADLRTQIAGYLYGISPPDNPQVKEIRCVVMVPQWGNHQQVQLPSSFPEHQFLDDLEPLGWMHTQPNELPQLSPQDVTFHSRVLENNKQWDGEKCIILTCSFTPGSCSLMSYKLTQAGYEWGRLNKDAGSNPHGYLPTHYEKVQMLLSDRFFGFYMVPDNGPWNYNFMGVNHTVGMNYSLKLGTPKEYYHQDHRPTHFLEFSNMEEDGDLDREDTFA

SEQ ID NO: 4326 - protein, 468 aa, Citrus sinensis
MLDPLEVHLLDFPNIVIKGSELQLPFQACLKIEKFGDLILKATEPQMVLFNIYDDWLKSISSYTAFSRLILILRALHVNNEKAKMLLKPDKTIITEPHHIWPSLSDDQWMKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNILKKFICIADLRTQISGYLYGISPPDNPQVKEIRCIAMPPQWGTHQQVHLPSALPEHDFLNDLEPLGWMHTQPNELPQLSPQDLTSHARILENNKQWDGEKCIILTCSFTPGSCSLTAYKLTPSGYEWGRVNKDTGSNPHGYLPTHYEKVQMLLSDRFLGFYMVPDNGPWNYNFMGVKHTVSMKYGVKLGTPREYYHEDHRPTHFLEFSNLEEGEMAEGDREDTFS

SEQ ID NO: 4327 - protein, 74 aa, Fagopyrum esculentum
TRKGMLDPLEVHLLDFPNIVIKGSELQLPFQACLKIEKFGDLILKATEPQMVLFNIYDDWLRAFHLTQPFLGSF

SEQ ID NO: 4328 - protein, 468 aa, Helianthus annuus
MLDPLEVHLLDFPNIVIKGSELQLPFQACLKIEKFGDLILKASEPQMVLFNIYDDWLKSISSYTAFSRLILILRALHVNNEKAKMLLKPDKTIVTEPHHIWPSLTDDQWVKVEVALRDLILSDYAKKNNVNTSALTQSEIRDIILGAEITPPSQQRQQIAEIEKQAKEASQLTAVTTKTTNVHGDELIVTTTSPYEQAAFGSKTDWRVRAISATNLYLRVNHIYVNSEDIKETGYTYIMPKNVLKKFICIADLRTQICGYLYGMSPPDNPQVKEIRCIAMPPQWGTHQQVHLPSALPEHDFLNDLEPLGWMHTQPNELPQLSPQDLTFHARILENNKQWDGEKSIILTCSFTPGSCSLTAYKLTPTGYEWGRANKDSGSNPHGYLPTHYEKVQMLLSDRFLGFYMVPDNGPWNYNFMGVKHTVSMKYGVKLGTPREYYHEDHRPTHFLEFSNLEEADVAEGDREDTFS

SEQ ID NO: 4329 - protein, 468 aa, Tropaeolum majus
MLDPLEVHLLDFPNIVIKGSELQLPFQACLKIEKFGDLILKATEPQMVLFNIYDDWLKSISSYTAFSRLILILRALHVNNEKAKMLLKPDKTIVTEAHHIWPSLTDDQWIKVEVALRDLILSDYAKKNNVNTSALTQSEIRDIILGAEITPPSQQRQQIAEIEKQAKEASQLTAVTTRTTNVHGDELIVTTTSPYEQAAFGSKTDWRVRAISATNLYLRVNHIYVNSEDIKETGYTYIMPKNILKKFICIADLRTQISGYLYGVSPPDNPQVKEIRCVAMPPQWGTHQQVHLPSALPEHDFLNDLEPLGWLHTQPNELPQLSPQDVTSHSRILENNKQWDGEKCIILTCSFTPGSCSLTAYKLTPSGYEWGRVNKDTGSNPHGYLPTHYEKVQMLLSDRFLGFYMIPDNGPWNYNFMGVKHTASMRYGVKLGAPREYYHEDHRPTHFLEFSNLEEGDNAEGDREDTFN

SEQ ID NO: 4330 - protein, 2332 aa, Arabidopsis thaliana
MWNIDGTSLAPPGTDGSRMQTPSHPADHPSYTAPSNRNTPTVPTPEDAEAKLEKKARTWMQLNSKRDHGDMSSKKHRLDKRVYLGALKFVPHAVFKLLENMPMPWEQVRDVKVLYHITGAITFVNEVRWVVEPIYMAQWGSMWIMMRREKRDRRHFKRMRFPPFDDEEPPLDYADNLLDVDPLEAIQLELDEEEDSAVYSWFYDHKPLVKTKMINGPSYQTWNLSLPIMSTLHRLAAQLLSDLVDRNYFYLFDMPSFFTAKALNMCIPGGPKFEPLHRDMEKGDEDWNEFNDINKLIIRSPLRTEYKVAFPHLYNNRPRKVKLCVYHTPMVMYIKTEDPDLPAFYYDPLIHPISNSNNTNKEQRKSNGYDDDGDDFVLPEGLEPLLNNSPLYTDTTAPGISLLFAPRPFNMRSGRTRRAEDIPLVAEWFKEHCPPAYPVKVRVSYQKLLKCYLLNELHHRPPKAQKKKHLFRSLAATKFFQSTELDWVEVGLQVCRQGYNMLNLLIHRKNLNYLHLDYNFNLKPVKTLTTKERKKSRFGNAFHLCREILRLTKLVVDANVQFRLGNVDAFQLADGLQYIFSHVGQLTGMYRYKYRLMRQIRMCKDLKHLIYYRFNTGPVGKGPGCGFWAPMWRVWLFFLRGIVPLLERWLGNLLARQFEGRHSKGVAKTVTKQRVESHFDLELRAAVMHDVVDAMPEGIKQNKARTILQHLSEAWRCWKANIPWKVPGLPVAIENMILRYVKSKADWWTNVAHYNRERIRRGATVDKTVCRKNLGRLTRLWLKAEQERQHNFQKDGPYVTADEGIAIYSTTVNWLESRKFSAIPFPPLSYKHDTKLLILALERLKESYSAAVKLNQQQREELGLIEQAYDNPHEALMRIKRHLLTQHSFKEVGIEFMDLYSHLIPVYQIDPLEKITDAYLDQYLWYEGDKRHLFPNWIKPADSEPPPLLVYKWCQGINNLQGIWDTSDGQCVVMLQTKFEKLFEKIDLTVLNSLLRLVLDPKLANYVTGKNNVVLSYKDMSYTNTYGLIRGLQFASFVVQFYGLVLDLLLLGLTRASEIAGPPQRPNEFMTYWDTKVETRHPIRLYSRYIDKVHIMFKFTHEEARDLIQRHLTERPDPNNENMVGYNNKKCWPRDARMRLMKHDVNLGRSVFWDMKNRLPRSITTLEWENGFVSVYSKDNPNLLFSMCGFEVRVLPKIRMGQEAFSSTRDGVWNLQNEQTKERTAVAFLRADDEHMKVFENRVRQILMSSGSTTFTKIVNKWNTALIGLMTYFREATVHTQELLDLLVKCENKIQTRVKIGLNSKMPSRFPPVIFYTPKEIGGLGMLSMGHILIPQSDLRYSNQTDVGVSHFRSGMSHEEDQLIPNLYRYIQPWESEFIDSQRVWAEYALKRQEAQAQNRRLTLEDLEDSWDRGIPRINTLFQKDRHTLAYDKGWRVRTDFKQYQALKQNPFWWTHQRHDGKLWNLNNYRTDVIQALGGVEGILEHTLFKGTYFPTWEGLFWEKASGFEESMKYKKLTNAQRSGLNQIPNRRFTLWWSPTINRANVYVGFQVQLDLTGIYMHGKIPTLKISLIQIFRAHLWQKIHESVVMDLCQVLDQELEPLEIETVQKETIHPRKSYKMNSSCADVLLFAAHKWPMSKPSLIAESKDVFDQKASNKYWIDVQLRWGDYDSHDIERYTKAKFMDYTTDNMSIYPSPTGVIIGLDLAYNLHSAFGNWFPGSKPLLAQAMNKIMKSNPALYVLRERIRKGLQLYSSEPTEPYLSSQNYGEIFSNQIIWFVDDTNVYRVTIHKTFEGNLTTKPINGVIFIFNPRTGQLFLKIIHTSVWAGQKRLGQLAKWKTAEEVAALVRSLPVEEQPKQVIVTRKGMLDPLEVHLLDFPNIVIKGSELQLPFQACLKIEKFGDLILKATEPQMALFNIYDDWLMTVSSYTAFQRLILILRALHVNNEKAKMLLKPDMSVVTEPNHIWPSLTDDQWMKVEVALRDLILSDYAKKNKVNTSALTQSEIRDIILGAEITPPSQQRQQIAEIEKQAKEASQLTAVTTRTTNVHGDELISTTISPYEQSAFGSKTDWRVRAISATNLYLRVNHIYVNSDDIKETGYTYIMPKNILKKFICIADLRTQIAGYLYGISPPDNPQVKEIRCVVMVPQCGNHQQVQLPSSLPEHQFLDDLEPLGWIHTQPNELPQLSPQDVTFHTRVLENNKQWDAEKCIILTCSFTPGSCSLTSYKLTQAGYEWGRLNKDTGSNPHGYLPTHYEKVQMLLSDRFFGFYMVPENGPWNYNFMGANHTVSINYSLTLGTPKEYYHQVHRPTHFLQFSKMEEDGDLDRDDSFA

SEQ ID NO: 4331 - protein, 468 aa, Orobanche aegyptiaca
MLDPLEVHLLDFPNIVIKGSELQLPFQACLKIEKFGDLILRATEPQMVLFNIYDDWLKSISSYTAFSRLILILRALHVNNEKAKMLLKPDKTIVTEPHHIWPSLSDDQWAKVEVALRDLILSDYAKKNNVNTSALTQSEMRDIILGAEITPPSQQRQQILEIEKQAKEASQATAVTTFTTNVHGDPIIVTTVSPYEQAAFGSKTDWRVRAISATNLHLRVNHIYVNSEDIKETGYTYIMPKNILKKFICVADLRTQISGYLYGVSPPDNPQVKEIRCIAMPPQWGSHQQVHLPSSLPEHDFLNDLEPLGWMHTQPNELPQLSPQDLAAHARVLSNNKQWDGEKCIILTCSFTPGSCSLTAYKLTPSGYEWGKSNSDAASNPHGYLPTYYEKVQMLLSDRFLGFYMVPDNGPWNYNFMGVKHTASMKYGVKLGTPREFYHEDHRPTHFLEFSNLEEGETAAGDREDTFT

SEQ ID NO: 4332 - protein, 2149 aa, Arabidopsis lyrata
MQRGERGILFPNLKERNWSRQRVWFDCGFRRLMMKSRCWIMRLELDLEDDSCVYNWFYDHKPLLKTNMINGPSDKRWNLSLPIMATLHRLAGQLLSDLVDRNYFYLFDMPSFFTAKALNMCIPGGPKFEPLYRDMEKYDEEWNEFNDINKVITRSRLRTEGRIAFPYLYNNRPRKVKLCAYHTPMVMFIKTEDPDLPAFYYDPLINPISNTFHDRKVCDDDEDDFVLPNGVEPLLQETQLYTDTTTDGISLLFAPRPFNMRSGKTRRAEDIPLVSEWFKEHCPTSHPVKVRVSYQKLLKCYVLNDLHCRPPKPQKKKHLFRSLAGTKFFQSTELDWVEAGLQVCRQGYNMLNLLIHRKGLNYLHLDYNFNLKPVKTLTTKERKKSRFGNAFHLCREILRLTRGMYRYKYRLMRQIRMCKDLKHLIYYRFNTGPVGKGPGCGFWAPMWRVWLFFLRGIVPLLERWLGNLLGRQFEGRHSKGMAKTVTKQRVESHFDLELRSAIMHDIVDAMPEGTKQNKVRTIEQHLSEAWRCWKANIPWKVPGLPLPVENLILRYVKHKADWWTNITHFNRERIRRGATVDKTVCRKNLGRLTRLWLKAEQERQYNYLKDGSPVTPDEAVATYRTTQEWLEARRFSPIPFPPLSYKHETKLLILALERLKESCGGERLNQQQREELGLIEQAYDNPHETLARIKRHLFTQRQFKEVGIEFMDLYSYVIPVYEIDPLEKITDAYLDQYLWYEADKRHLFPNWIKPADSEPPPLLVYKWCQGINNLQGIWDTSDGQCVVMLQTKLEKLFEKVDFTLLNKLLRLIVDPSIADYVTAKNNVDLSYKDMRHTNSYGLIRGLQFSSFVTQFYGLVLDLLLLGLTRANEIAGPPQKPNEFMTYWDTKVETRHPIRLYSRYVDKVHIMLKFTHEEVRDLIQRYLREHPDPNNENMVGYNNKKCWPRDARMRLMKHDVNLGRSIFWEMKNRLPRSLTTFEWENSFVSVYSKDNPNLLFSMCGFEIRILPKARMSQEAFSNIGDGVWNLQNEQTKEKTAVAFLRVDEEQIKVFENRVRQILMSSGSATFTKITNKWNTALIGLMTYFREATLHTPELIDLLVKGESKIQTRIKIGLNSKMPSRFPPVVFYTPKELGGLGMLSMSHILIPESDRRYSRQTDVGVTHFRSGMSQEEDLKIPNLYRYIQPWESEFIDSQRVWAEYALKRQESQAQNRRLTLEDLEDSWDRGIPRINTLFQKDRHTLAYDKGWRVRTDFKQYQVLRQNSFWWTHQRHDGKLWNLNNYRTDVIQALGGVESILEHTLFKGTYFPTWEGLFWEKASGFEESMKYKKLTNAQRSGLNQIPNRRFTLWWSPTINRANVYVGFQVQLDLTGIFMHGKIPTLKISLIQIFRAHMWQMIHESVVMDLCQVLDQHMDEMGIDIVQKETIHPRKSYKMNSSCADILMFGASKWPMSKPSLVTDSNDMFDQKASKKYWIDVQLRWGDYDSHDIERYTRAKFMDYTTDNMSIYPSPTGVMIGIDLAYNVYSAFGNWFPDSKSLIAKAMNKIIKSNPTLYGLRERIRKGLQLYSSEPTEPNLSSQNYGEIFSNQIIWFIDDTNVYRVTMHKTFEGNLTTKPINGAAFIFNPRTGQLFLKVMHTSVWAGQKRLGQLAKWKTAEEVAALVRSFPVEEQPKQVIVTRKGMLDPIQTTMKDFPNIVIKGSELQLPFQACLKIEKFCDLILKATEPQMNLFNIYDDWLTSISSYTAFSRLILILRALHVNNEKAKMLLKPDKSVVTETHHIWPSLTDDQWMKVEVALKDLILFDYAKKNNLNISALTQSEIRDIILGAEITPPSQQRQQIAEINKQAKEVRQLSAVTTRTTNVHGDELIVTTISPYEQSAFGSKTDWRVRAISATNLHLRVNHIYVNSYDVNETGYTYIMPKNILKRFIRIADLRTQIAGYMYGISPLDNPQVKEIRCVVMVPQRGSHQQVHLPSSLPEHDFLKDFEPLGWMHTQPNELPQLSPQDVTSHARFLENNKQWDREKCIILTCSFTPGSCSLTSYKLTETGYEWGRLNKDSGSNPQGYLPTHYDKVQMLLSDRFLGFYMVPDNGPWNYNFMGVKHTESMKYSVKLGNPKEYYDNEHRPTHYLEFSNMEEDRNFSERDREDCYA

SEQ ID NO: 4333 - protein, 477 aa, Pteridium aquilinum
KGMLDPLEVHLLDFPNIVIKGSELQLPFQACLKIEKFGDLILKATEPQMVLFNIYDDWLKTVSSYTAFQRLILILRALHVNNEKAKMLLKPDKSIITESHHIWPSLSDDQWMKVEVALRDLILSDYAKKNNVNTSALTQSEIRDIILGAEITPPSQQRQQIAEIEKQAKEASQLTAVTTKTTNVHGDDLIVTTTSPYEQAAFGSKTDWRVRAISATNLYLRVNHIYVNSDDIKESGYTYIMPKNVLKKFICIADLRTQIAGYLYGLSPPDNPQVKEIRCIVMPPQWGTHQQVHLPSALPEHEYLGELEPLGWMHTQPNEFPQLSPQDVTSHARMLENNKSWDGERCIILTCSFTPGSCSLTAYKLTPSGYEWGRLNKDSGSNPHGYLLTHYEKVQMLLSDRFLGYYMVPDNGPWNYNYMGVKHSTSMKYGIKLSIPKEYYHEDHRPTHFLEFSNLEGDHVDADREDVLLRVRTEIEF

SEQ ID NO: 4334 - protein, 600 aa, Triticum aestivum
SNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLPVEEQPKQIIVTRKGMLDPLEVHLLDFPNIVIKGSELQLPFQACLKIEKFGDLILKATEPQMVLYNIYDDWLKSISSYTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSRETNQVTAQTTRTVNVHGDELIVTTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHAKILENNKQWDGEKCIILTCSFTPGSCSLTAYKLTPSGYEWARGNKDNGSNPQGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 4335 - protein, 262 aa, Triticum aestivum
MSAAAAAADTYSPAAEAGSKRRERREELRRHLAEDADWPRADGRSLHDCRPAFMQTGPTTAASGSAYAEFGKTKVIVSVFGPRESKKAMLYSDTGRLNCSVSYTTFATGIRGQGLENKEYSGMLHKALEGAVMLHTFPKTTVDVFALVLESGGSDLPIIISCASLALADAGIMMYDLVTSVSVSCLGKNVIIDPTSDEEAWQDGGLMVSYMPARKEITQLTLTGEWTDGKITNAVELCMDACSKLCEILRERLKDPASLASE

SEQ ID NO: 4336 - protein, 262 aa, Leymus cinereus x Leymus triticoides
MSAAAAAADTYSPAAEAGSKRRERREELRRHLAEDADWPRADGRSFHDCRPAFMQTGPTTAASGSAYAEFGKTKVIVSVFGPRESKKAMLYSDTGRLNCSVSYTTFATGIRGQGLENKEYSGMLHKALEGAVMLHTFPKTTVDVFALVLESGGSDLPIIISCASLALADAGIMMYDLVTSVSVSCLGKNVIIDPTSDEEAWQDGGLMVSYMPARKEITQLTLTGEWTDGKITNAVELCMDACSKLCEILRERLKDTASLASE

SEQ ID NO: 4337 - protein, 262 aa, Brachypodium distachyon
MSAAAGTAGTYSPAAEAGGKRRERKEELRRHLAEDADWPRADGRSFHDCRPAFMQTGPTTAASGSAYAEFGKTKVIVSVFGPRESKKAMLYSDTGRLNCNVSYTTFATGIRGQGLDNKEYSEMLHKALEGAVMLDTFPKTTVDVFALVLESGGSDLPIIISCASLALADAGIMMYDLVTSVSVSCLGKNVIIDPTSDEEAWQDGGLLVSYMPTRKEITQLTLTGEWSDGKITNAVELCMDACSKLCEILRERLKDSTSLASE

SEQ ID NO: 4338 - protein, 262 aa, Oryza sativa
MSAAAAATDGTYSPAAAAGEKRRERKEELRRHLAEDADWPRADGRSFHDCRPAFMQTGPTTAASGSAYAEFGKTKVIVSVFGPRESKKAMLYSDTGRLNCNVSYTTFATPIRGQGMDNKEYSAMLHKALEGAVMLHTFPKTTVDVFALVLESGGSDLPIIISCASLALADAGIMIYDLVTSVSVSCFGKNIIIDPTSDEEAWQDGSIMVAYMPARKEITQLTLTGEWSDGKITNAVELCMDACSKLCDILRERLKDAASLAE

SEQ ID NO: 4339 - protein, 260 aa, Oryza sativa
MSAAATAGTYSPASAAGEKRRERKEELRRHLAEDADWPRADGRSFHDCRPAFMQTGPTTAASGSAYAEFGKTKVIVSVFGPRESKKAMLYSDTGRLNCNVSYTTFATPIRGQGTDNKEYSAMLHKALEGAVMLHTFPKTTVDVFALVLESGGSDLPIIISCASLALADAGIMMYDLVTSVSVSCFGKNIIIDPTSDEEAWQDGSLMVAYMPARKEITQLTLTGEWSDGKITNAVELCMDACSKLCDILRERLKDASSLAE

SEQ ID NO: 4340 - protein, 261 aa, Setaria italica
MSAQAGTGTYSPAAAAGDKRRERREELRRHLAEDADWPRADGRSFHDCRPAFMQTGPTTAASGSAYAEFGKTKVIVSVFGPRESKKAMMYSDVGRLNCNVSYTTFATPVRGQGADNKEYSSMLHKALEGAVMLHTFPKTTVDVFALVLESGGSDLPIIISCASLALADAGIMMYDLVTSVSVSCFGKNIIIDPTSDEEAWQDGSLMVAFMPARKEITQLTLTGEWSDGKITNAVELCMDACSKLGEILRDRLKDTATLTNE

SEQ ID NO: 4341 - protein, 261 aa, Panicum virgatum
MSAQAGTGTYSPAAAAGDKRREKREELRRHLAEDANWPRADGRSFHDCRPAFMQTGPTTAASGSAYAEFGKTKVIVSVFGPRESKKAMLYSDVGRLNCNVSYTTFATPVRGQGADNKEYSSMLHKALEGAVMLHTFPKTTVDVFALVLESGGSDLPIIISCASLALADAGIMMYDLVTSVSVSCFGKNIIIDPTSDEEAWQDGSLVVAFMPARKEITQLTLTGEWSDGKITNAVELCMDACSKLGDILRDRLKDTATLTSE

SEQ ID NO: 4342 - protein, 261 aa, Zea mays
MSAQAGPGTYSPAAAAGDRRRERKEELRRHLAEDADWPRADGRSFHDCRPAFMQTGPTTAASGSAYAEFGKTKVIVSVFGPRESKKAMMYSDVGRLNCNVSYTTFATPVRGQGADNKEYSSMLHKALEGAVMLHTFPKTTVDVFALVLESGGSDLPIIISCASLALADAGIMMYDLVTSVSVSCFRKNIIIDPTSDEEAWQDGSLVVAFMPARKEITQLTLTGEWSDGRITNAVELCMDACSKLGDILRDRLKDTATLTCE

SEQ ID NO: 4343 - protein, 261 aa, Sorghum bicolor
MSAQAGTGTYSPAVAAGDKRRERKEELRRHLVEDADWPRADGRSFHDCRPAFMQTGPTTAASGSAYAEFGKTKVIVSVFGPRESKKAMMYSDIGRLNCNVSYTTFATPVRGQGADNKEYSSMLYKALEGAVMLHTFPKTTVDVFALVLESGGSDLPIIISCASLALADAGIMMYDLVTSVSVSCFGKNIIIDPTSDEEAWQDGSLVVAFMPARKEITQLTLTGEWSDGRITNAVELCMDACSKLGDILRDHLKDTATLTSE

SEQ ID NO: 4344 - protein, 204 aa, Triticum aestivum
MAAAAGDGGSVPPKTPIAEAPPASRPHVTRNAMPWERCVAGVQLALKDPKVVFLREQIEKAGCTVWPTFFRAAICTSSGNYASGVGVQVCCNHMRRQDEITQVIIHELVHVYDDCVVKNIDWKNCAHQACSEIRANHLSGNCHYKRELMKGFLKIKGHEPECVKRRALLSVKNNPHCSEKAAEAAVEKVWDMCYNDPRPFDKAL

SEQ ID NO: 4345 - protein, 216 aa, Triticum aestivum
NPRRSCRQRYRTMAAAAGDGGSVPPKTPIAEAPPASRPHVTRNAMPWQKCVAGVQLALKDPKVVFLREQIEKAGCTVWPTLFRAAICTSSGNYASGVGVQVCCNHMRRQDEINQVIIHELVHAYDDCVVKNIDWKNCAHQACSEIRANHLSGNCHYKRELMKGFLKIKGHEPECVKRRALLSVKNNPHCSEKAAEAAVEKVWDMCYNDPRPFDKAL

SEQ ID NO: 4346 - protein, 204 aa, Triticum aestivum
MAAAAGDGGSVPPKTPIAESPPASRPHVTRNAMPWEKCVAGVQLALKDPKVVFLREQIEKAGCTVWPTLFRAAICRSGGNYASGMGVVVCCNHMRRQDEITQVIIHELVHAYDDCVVKNIDWKNCADHACSEIRANHLSGDCHYKRELMKGFLKIKGHEPECVKRRALLSVKVNPHCSEKDAEAAVEKVWDMCYNDPRPFDKAL

SEQ ID NO: 4347 - protein, 216 aa, Triticum aestivum
YPRRSCRQRYRPMAAAAGDGGSVPPKTPIAESPPASRPHVTRNAMPWEKCVAGVQLALKDPKVVFLREQIEKAGCTVWPTLFRAAICRSGGNYASGMGVVVCCNHMRRQDEITQVIIHELVHAYDDCVVKNIDWKNCADHACSEIRANHLSGDCHYKRELMKGFLKIKGHEPECVKRRALLSVKVNPHCSEKDAEAAVEKVWDMCYNDPRPFDKAL

SEQ ID NO: 4348 - protein, 199 aa, Triticum aestivum
MGKSKSKGAKFAAVKKIISKKTIKKYKEEVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 4349 - protein, 199 aa, Leymus cinereus x Leymus triticoides
MGKSKSKGAKFAAVKKIISKKTIKKYKDEVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 4350 - protein, 199 aa, Triticum aestivum
MGKSKSKGAKFAAVKKIISKKTIKKYKDEVLDPRKKHTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 4351 - protein, 199 aa, Avena sativa
MGKAKSKGAKFAAVKKIISKKTIKKYKDEVLDPRKKDAEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVDRITQHKCYIVATCDRDLKRRIRKVPGVPIMYITQHRYSIERLPEATIGGAPRI

SEQ ID NO: 4352 - protein, 199 aa, Avena sativa
MGKAKSKGAKFAAVKKIISKKTIKKYKEEVLDPRKKDAEAEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVDRITQHKCYIVATCDRDLKRRIRKVPGVPIMYITQHRYSIERLPEATIGGAPRI

SEQ ID NO: 4353 - protein, 199 aa, Triticum aestivum
MGKSKSKGAKFAAVKKIISKKTIQKYKEDVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 4354 - protein, 199 aa, Brachypodium distachyon
MGRAKSKGPKFAAVKKMISKKTIKKYKDEVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 4355 - protein, 199 aa, Setaria italica
MGRSKSKGPKFAAVKKIISKKTINKYKQDVLNHNKKDAEKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVDRVTQHKCYIVATCDRDLKRRIRKVPGVPIMYITQHRYSIERLPEATIGGAPRI

SEQ ID NO: 4356 - protein, 199 aa, Pennisetum glaucum
MGRSKSKGPKFAAVKKIITKKTINKYKQDVLNPNKKDAEKEKLGRNVPQVSSALFFSYNTALGPPYRVIVDTNFINFSIQNKLDLEKGMMDCLYAKCTPCITDCVMAELEKLGQKYRVALRIAKDPRFKRLACTHKGTYADDCIVERVTQHKCYIVATCDRDLKRRIRKVPGVPIMYITRHRYSIERLPEATIGGAPRI

SEQ ID NO: 4357 - protein, 199 aa, Oryza sativa
MGRAKSKGPKFAAVKKIITKKTIQKYKEDVLNPKKKDNEKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 4358 - protein, 199 aa, Zea mays
MGKAKSKGPKFAAVKKIITKKTINKYKEDVLNHKKKDADKEKLGRNVPQVSSALFFSYNTALGPPYRVIVDTNFINFSIQNKLDLEKGMMDCLYAKCTPCITDCVMAELEKLGQKYRVALRIAKDPRFQILACTHKGTYADDCIVERVTQHKCYIVATCDRDLKRRIRKVPGVPIMYITRHRYSIERLPEATIGGAPRI

SEQ ID NO: 4359 - protein, 199 aa, Zea mays
MGKAKSKGPKFAAVKKIITKKTINKYKEDVLNHKKKDADKEKLGRNVPQVSSALFFSYNTALGPPYRVIVDTNFINFSIQNKLDLEKGMMDCLYAKCTPCITDCVMAELEKMGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 4360 - protein, 199 aa, Zea mays
MGKAKSKGPKFAAVKKIITKKTINKYKEDVLNHKKKDVDKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 4361 - protein, 199 aa, Sorghum bicolor
MGKAKGKGPKFAAVKKIITKKTINKYKEDVLNHKKKDADKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 4362 - protein, 199 aa, Saccharum officinarum
MGKAKGKGPKFAAVKKIITKKTINKYKEDVLNHKKKDADREKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 4363 - protein, 199 aa, Cenchrus ciliaris
  misc_feature (147)..(147): Xaa can be any naturally occurring amino acid
  misc_feature (149)..(150): Xaa can be any naturally occurring amino acid
  misc_feature (157)..(158): Xaa can be any naturally occurring amino acid
  misc_feature (162)..(162): Xaa can be any naturally occurring amino acid
MGRSKSKGPKFAAVKKIITKKTINKYKQDVLNPNKKDAEKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVEXVXXHKCYIVXXCDRXLKRRIRKVPGVPVMYITRHRYSIERLPEATIGGAPRI

SEQ ID NO: 4364 - protein, 199 aa, Panicum virgatum
MGKAKNKGPKFAVMKKMITKKSVNKYKKDVLNPNKKDAEKEKLGRNVPQVSSALFFSYNTALGPPYRVIVDTNFINFSIQNKLDLEKGMMDCLYAKCTPCITDCVMAELEKLGQKYRVALRIAKDPRFQRLACTHKGTYADDCIVDRVTQHKCYIVATCDRDLKRRIRKVPGVPIMYITRHQYSIERLPEATVGGAPRI

SEQ ID NO: 4365 - protein, 198 aa, Elaeis guineensis
MGKAKKGPKFAVVKRLVSSKTLRKYKEEVLNPKKKDLEKDKLPRNVPAVSSALFFKYNTALGPPYRVIVDTNFINFSIQNKLDLEKGMMDCLYAKCTPCITNCVMAELEKLGQKYRVALRIAKDSRFERLPCTHKGTYADDCIVERVTQHKCYIVATCDRDLKRRIRKIPGVPIMYITQHKYSIERLPEATIGGAPRI

SEQ ID NO: 4366 - protein, 198 aa, Abies balsamea
MGKSKKTPKYAKMKSIISAKAIRKHKEEVLNPNKKNAEKQKLPRNVPNVSSALFFKYNTALGPPYLVLVDTNFINFSIQNKLDLEKAMMDCLYAKCTPCITDCVMAELEKLGQKYRVALRIAKDPRFERLPCTHGGTYADDCIVERVTQHKCYIVATCDRDLKRRIRKIPGVPIMYITQHKYSIERLPEATIGGAPRF

SEQ ID NO: 4367 - protein, 198 aa, Pinus pinaster
MGKSKKTPKFAKMKSIISAKAIRKYKEEVLNPNKKDAEKQKLPRNVPNVSSALFFKYNTALGPPYLVLVDTNFINFSIQNKLDLEKAMMDCLYAKCTPCITDCVMAELEKLGQKYRVALRIAKDPRFERLPCTHEGTYADDCIVERVTQHKCYIVATCDRDLKRRIRKIPGVPIMYITQHKYSIERLPEATIGGAPRF

SEQ ID NO: 4368 - protein, 198 aa, Pinus taeda
MGKSKKTPKFAKMKSIISAKAIRKYKEEVLNPNKKDAEKQKLPRNVPNVSSALFFKYNTALGPPYLVLVDTNFINFSIQNKLDLEKAMMDCLYAKCTPCITDCVMAELEKLGQKYRVALRIAKDPRFERLPCTHGGTYADDCIVERVTQHKCYIVATCDRDLKRRIRKIPGVPIMYITQHKYSIERLPEATIGGAPRF

SEQ ID NO: 4369 - protein, 198 aa, Pseudotsuga menziesii
MGKSKKTPKFAKMKSIISSKTIKKYKEEVLNPNKKNAEKQKLPRNVPNVSSALFFKHNTALGPPYLVLVDTNFINFSIQNKLDLEKAMMDCLYAKCTPCITDCVMAELEKLGQKYRVALRIAKDPRFERLPCTHEGTYADDCIVQRVTQHKCYIVATCDRDLKRRIRKIPGVPIMYITQHKYSIERLPEATIGGAPRF

SEQ ID NO: 4370 - protein, 198 aa, Centaurea maculosa
MGRAKKGPKFAVMKKLASHKAIKQHKEEVLNPNKKDLTKEKLPRNVPYVSSALFFTYNTALGPPYRVLVDTNFINFSIQNKLDLEKGMMDCLYAKCTPCITDCVMAELEKLGQKYRVALRIAKDPRFERLPCTHKGTYADDCIVERVTQHKCYMVATCDRDLKRRIRKIPGVPIMYITQHKYSIERLPEATMGGAPRI

SEQ ID NO: 4371 - protein, 198 aa, Helianthus annuus
MGRSKKGPKFAVMKKLVSHKAIKQHKEEVLNPNKKDLTKENLPRNVPYVSSALFFTYNTALGPPYRVLVDTNFINFSIQNKLDLEKGMMDCLYAKCTPCITDCVMAELEKLGQKYRVALRIAKDPRFERLPCTHKGTYADDCIVERVTQHKCYMVATCDRDLKRRIRKIPGVPIMYITQHKYSIERLPEATMGGAPRI

SEQ ID NO: 4372 - protein, 198 aa, Pseudotsuga menziesii
MGKSKKTPKFAKMKSIISSKTIQKYKEEVLNPNKKNAEKQKLPRNVPNVSSALFFKHNTALGPPYLVLVDTNFINFSIQNKLDLEKAMMDCLYAKCTPCITDCVMAELEKLGQKYRVALRIAKDPRFERLPCTHEGTYADDCIVQRVTQHKCYIVATCDRDLKRRIRKIPGVPIMYITQHKYSIERLPEATIGGAPRF

SEQ ID NO: 4373 - protein, 198 aa, Fragaria vesca
MGKAKKGPKFAVMKKVVTKKAIKNYKEEVLNPKKKDISKEKLPRNVPNVPSALFFEYNTALGPPYRVLVDTNFINFSIQNKLDLEKGMMDCLYAKCTPCITDCVMAELEKLGQKYRVALRIAKDPRFERLLCTHKGTYADDCLVERVTQHKCYIVATCDRDLKRRIRKIPGVPIMYITQHKYSIERLPEATIGGAPRY

SEQ ID NO: 4374 - protein, 198 aa, Solanum lycopersicum
MGKAKKAPKFAVMKKMVTHKAIKEHKEAVLNPNKKDLTKEKLPRNVPYVSSALFFKYNTALGPPYLVLVDTNFINFSIQNKLDLEKGMMDCLYAKCTPCITDCVMAELEKLGQKYRVALRIAKDPRFERLPCTHKGTYADDCIVERVTQHKCYIVATCDRDLKRRIRKVPGVPIMYITQHKYSIERLPEATIGGAPRF

SEQ ID NO: 4375 - protein, 198 aa, Ipomoea nil
MGKAKKSPKFAVMKKIVTHKAIKQHKEEVLNPKKKDLSKEKLPRNVPYVSSALFFKYNTALGPPYRVLVDTNFINFSIQNKLDLEKGMMDCLYAKCTPCITDCVMAELEKLGQKYRVALRIAKDPRFERLPCTHKGTYADDCLVDRVTQHKCYIVATCDRDLKRRIRKIPGVPIMYITQHKYSIERMPEATIGGAPRI

SEQ ID NO: 4376 - protein, 198 aa, Capsicum annuum
MGKAKKGPKFAVMKKMITHKAIKQHKEEILNPKKKDLNKEKLPRNVPYVSSALFFKYNTALGPPYLVLVDTNFINFSIQNKLDLEKAMMDCLYAKCTPCITDCVMAELEKLGQKYRVALRIAKDPRFERLPCTHKGTYADDCIVERVTQHKCYIVATCDRDLKRRIRKVPGVPIMYITQHKYSIERLPEATMGGAPRF

SEQ ID NO: 4377 - protein, 198 aa, Aristolochia fimbriata
MGKAKKSPKFAAMKKLVSSKTLRQYKKDVLNPNKKDLDKDKLPRNVPSVSSALFFKHNTALGPPYRVIVDTNFINFSIQNKLDLEKGMMDCLYAKCTPCITDCVMAELEKLGQKYRVALRIAKDPRFERLPCTHKGTYADDCIVDRVTQHKCYIVATCDRDLKRRIRKVPGVPIMYITMHRYSIERLPEATIGGAPRI

SEQ ID NO: 4378 - protein, 198 aa, Malus domestica
MGRAKKGPKFAVMKKVVTSKAIKSYKEAVLNPNKKDLTKEKLPRNVPNVSSALFFKHNTALGPPYRVLVDTNFINFSIQNKLDLEKGMMDCLYAKCTPCITDCVMAELEKLGQKYRVALRIAKDPRFERLLCTHKGTYADDCIVERVTQHKCYIVATCDRDLKRRIRKVPGVPIMYITQHKYSIERLPEATIGGAPRF

SEQ ID NO: 4379 - protein, 198 aa, Ricinus communis
MGRAKKGPKFAAMKKIITSKAIKHYKEEVLNPKKKDLSKDKLPRNVPQVSSALYFKYNTALGPPYRVLVDTNFINFSIQNKLDLEKAMMDCLYAKCTPCITDCVMAELEKLGQKYRVALRIAKDPRFERLPCIHKGTYADDCIVDRVTQHKCYIVATCDRDLKRRIRKVPGVPIMYITQHKYSIERLPEATMGGAPRF

SEQ ID NO: 4380 - protein, 198 aa, Vigna unguiculata
MGKAKKGPKFAVRKKIITSKAIKSYKEEVLNPEKKDIVKEKLPRNIPSHSSALFFQYNTALGPPYRVLVDTNFINFSIQNKLDLEKGMMDCLYAKCTPCITDCVMAELEKLGQKYRVALRIAKDPRFERILCTHKGTYADDCLVERVTQHKCYIVATCDRDLKRRIRKIPGVPIMYITKHRYSIERLPEATMGGAPRI

SEQ ID NO: 4381 - protein, 198 aa, Vitis vinifera
MGKAKKAQKFAVMKKMVTSKALKKHKEEVLNPTKKDENKEKTSRNVPYVPSALFFKYNTALGPPYRVLVDTNFINFSIQNKLDLEKGMMDCLYAKCTPCITDCVMAELEKLGQKYRVALRIAKDPRFERLLCTHKGTYADDCIVDRVTQHKCYIVATCDRDLKRRIRKVPGVPIMYITKHQYSIERLPEATIGGAPRI

SEQ ID NO: 4382 - protein, 198 aa, Unknown
  Sequence found in Organisms: Solanum tuberosum, Solanum phureja
MGKAKKAPKFAVMKKMVTHKAIKEHKEAVLNPNKKDLTKEKLPRNVPYVSSALFFKYNTALGPPYLVLVDTNFINFSIQNKLDLEKGMMDCLYAKCTPCITDCVMAELEKLGQKYRVALRIAKDPRFERLPCTHKGTYADDCIVERVTQHKCYIVATCDRDLKRRIRKIPGVPIMYITQHKYSIERLPEATIGGAPRF

SEQ ID NO: 4383 - protein, 206 aa, Petunia hybrida
MGKAKKAPKFAVMKKMVTHKAIKHQKEEVLNPNKKDLTKEKLPRNVPYVSSALFFKYNTALGPPYRVLVDTNFINFSIQNKLDLEKGMMDCLYAKCTPCITDCVMAELEKLGQKYRVALRIAKDPRFERLPCVHKGTYADDCIVERVTQHKCYIVATCDRDLKRRIRKVPGVPIMYITQHKYSIERLPEAQLVELQDIEYVFRAVS

SEQ ID NO: 4384 - protein, 198 aa, Cedrus atlantica
MGKSKKTQKFAKMKSIISSKAIRKYKEEVLNPNKKNVEKQKLPRNVPNVSSALFFKYNTALGPPYLVLVDTNFINFSIQNKLDLEKAMMDCLYAKCTPCITDCVMAELEKLGQKYRVALRIAKDPRFERLPCTHEGTYADDCIVDRVTQHKCYIVATCDRDLKRRIRKIPGVPIMYITQHKYSIERMPEATIGGAPRF

SEQ ID NO: 4385 - protein, 198 aa, Cephalotaxus harringtonia
MGKSKKAPKFAKMKKIISHKSIRSYKEEVLNPNKKNTGKEKLPRNVPNVSSALFFKHNTALGPPYQVLVDTNFINFSIQNKLDLEKAMMDCLYAKCTPCITDCVMAELEKLGQKYRVALRIAKDPRFDRLPCSHKGSYADDCIVERVTQHKCYIVATCDRDLKRRIRKIPGVPIMYITQHKYSIERLPEATIGGAPRF

SEQ ID NO: 4386 - protein, 198 aa, Unknown
  Sequence found in Organisms: Citrus sinensis, Citrus clementina, Citrus sinensis
MGKAKKAPKFAAMKKIITKRAIKNYKEDVLNPNKKDLTKEKMPRNVPNVSSALFFTHNTALGPPYRVLVDTNFINFSIQNKLDLEKGMMDCLYAKCTPCITDCVMAELEKLGQKYRVALRIAKDPRFERLPCTHKGTYADDCLVERVTQHKCFIVATCDRDLKRRIRKVPGVPIMYITRHKYSIERLPEATVGGAPRI

SEQ ID NO: 4387 - protein, 198 aa, Podocarpus macrophillus
MGKSKKTPKFAKMKKIISSKAIRSYKEEVLNPNKKNTEKEKLPRNVPNVSSALFFKHNSALGPPYQVLVDTNFINFSIQNKLDLEKAMMDCLYAKCTPCITDCVMAELEKLGQKYRVALRIAKDPRFDRLPCTHQGTYADDCLVQRVTQHKCYIVATCDRDLKRRIRKIPGVPIMYITQHKYSIERLPEATIGGAPRF

SEQ ID NO: 4388 - protein, 198 aa, Sciadopitys verticillata
MGKSKKTPKFAKMKKIISHKAIHSYKEEVLNPNKKNTKEEKLPRNIPNVSSALFFKYNTALGPPYQVLVDTNFINFSIQNKLDLEKAMMDCLYAKCTPCITDCVMAELEKLGQKYRVALRIAKDPRFDRLPCTHNGTYADDCIVERVTQHKCYIVATCDRDLKRRIRKIPGVPIMYITQHKYSIERLPEATIGGAPRF

SEQ ID NO: 4389 - protein, 198 aa, Taxus baccata
MGKSKKTPKFARMKKIISHKTIRSYKEEVLNPNKKNTEKDKLPRNIPNVSSALFFKHNTALGPPYQVLVDTNFINFSIQNKLDLEKAMMDCLYAKCTPCITDCVMAELEKLGQKYRVALRIAKDPRFDRLPCTHKGTYADDCLVERVTQHKCYIVATCDRDLKRRIRKIPGVPIMYITQHKYSIERLPEATMGGAPRF

SEQ ID NO: 4390 - protein, 198 aa, Aquilegia formosa
MGKAKKSPKFAVTKKLVTTKMIKKHKEDVLNPNKKDLEKEKLPRNVPTVSSALFFKHNSALGPPYRVLVDTNFINFSIQNKLDLEKAMMDCLYAKCTPCITDCVMAELEKLGQKYRVALRIAKDPRFERLPCTHKGTYADDCLVDRVTQHKCYIVATCDRDLKRRIRKIPGVPIMYITQHKYSIERLPEATIGGAPRY

SEQ ID NO: 4391 - protein, 198 aa, Aquilegia formosa
MGKAKKSPKFAVMKKLVTTKMIKKHKEDVLNPNKKDLEKEKLPRNVPTVSSALFFKHNSALGPPYRVLVDTNFINFSIQNKLDLEKAMMDCLYAKCTPCITDCVMAELEKLGQKYRVALRIAKDPRFERLPCTHKGTYADDCLVDRVTQHKCYIVATCDRDLKRRIRKIPGVPIMYITQHKYSIERLPEATIGGAPRY

SEQ ID NO: 4392 - protein, 198 aa, Musa acuminata
MGRAKKTRKFAVMKKLVSSKTLKKYKEEILNPKKKDPEKENLPRNVPSVSSALFFKYNTALGPPYMVIVDTNFINFSIQNKLDLEKGMMDCLYAKCTPCITDCVMAELEKLGQKYRVALRIAKDPRFERLPCTHKGTYADDCIVDRVTQHKCYIVATCDRDLKRRIRKIPGVPIMYITRHKYSIERLPKATIGGAPRI

SEQ ID NO: 4393 - protein, 198 aa, Cycas rumphii
MGKSKKIPKFAKMKRIISSKTLRKYKEEVLNPDKKNVEKQKLPRNVPNFSSALFFKYNTALGPPYQVLVDTNFINFSIQNKLDLEKAMMDCLYAKCTPCITDCVMAELEKLGQKYRVALRIAKDPRFERLPCTHKGTYADDCIVQRVIQHKCYIVATCDRDLKRRIRKIPGVPIMYITQHKYSIERLPEATIGGAPRF

SEQ ID NO: 4394 - protein, 198 aa, Heritiera littoralis
MGKAKKAPKFAGMKKMITQKAIKNYKEQVLNPNKKDLSKEKLPRNVPNVSSALFFTYNTSLGPPYRVLVDTNFINFSIQNKLDLEKGMMDCLYAKCTPCITDCVMAELEKLGQKYRVALRIAKDPRFERLPCSHKGTYADDCIVERVTQHKCFIVATCDRDLKRRIRKVPGVPIMYITQHKYSIERLPEATIGGAPRF

SEQ ID NO: 4395 - protein, 198 aa, Mimulus guttatus
MGKAKRTAKFAVMKKLVSHKAIKQYKEEVLNPNKKDLTKENLPRNVPQVSSALFFKHNTALGPPYRVLVDTNFINFSIQNKLDLEKGMMDCLYAKCTPCITDCVMAELEKLGQRYRVALRIAKDPRFERLPCTHKGTYADDCLVDRVTQHKCYIVATCDRDLKRRIRKIPGVPIMYIAQHRYSIERLPEATIGGAPRI

SEQ ID NO: 4396 - protein, 198 aa, Glycine max
MGKAKKGPKFAVMKKIVTSKAIKSYKEEVLNPEKKNLMKEKLPRNVPTHSSALFFQYNTALGPPYRVLVDTNFINFSIQNKLDLEKGMMDCLYAKCTPCITDCVMAELEKLGQKYRVALRIAKDPRFERILCTHKGTYADDCLVERVTQHKCYIVATCDRDLKRRIRKIPGVPIMYITKRKYSIERLPEATIGGAPRI

SEQ ID NO: 4397 - protein, 196 aa, Tragopogon dubius
MGRAKKGPKFAVMKKLVSHKAIKQHKEDVLNPNKKDLTKLPRNVPYVSSALFFTYNTALGPPYRVLVDTNFINFSIQNKLDLEKGMMDCLYAKCTPCITDCVMAELEKLGQKYRVALRIAKDPRFERLPCTHKGTYADDCIVERVTQHKCYLVATCDRDLKRRIRKIPGVPIMYITQHKYSIERLPEATMGGAPRI

SEQ ID NO: 4398 - protein, 186 aa, Tabernaemontana elegans
MKKMVTSKAIKQHKQEVLNPNKKDLSKEKLPRNVPNVSSALFFKHNTALGPPYRVLVDTNFINFSIQNKLDLEKGMMDCLYAKCTPCITDCVMAELEKLGQKYRVALRIAKDPRFERLPCTHKGTYADDCLVDRVTQHKCYIVATCDRDLKRRIRKVPGVPIMYITQHKYSIERLPEATIGGAPRY

SEQ ID NO: 4399 - protein, 196 aa, Artemisia annua
AAKKGPKFAAMKKLVSHKAIKQHKEEVLNPNKKDLTKQNLPRNVPYVSSALFFTYNTALGPPYRVLVDTNFINFSIQNKLDLEKGMMDCLYAKCTPCITDCVMAELEKLGQKYRVALRIAKDPRFERLPCTHKGTYADDCIVERVTQHKCYMVATCDRDLKRRIRKIPGVPIMYITQHKYSIERLPEATMGGAPRI

SEQ ID NO: 4400 - protein, 198 aa, Manihot esculenta
MGRAKKGPKFAAMKKIITSKAIKKYKEEVLNPAKQDLSKDKLPRNVPQVSSALYFKYNTALGPPYRVLVDTNFINFSIQNKLDLEKAMLDCLYAKCTPCITDCVMAELEKLGQKYRVALRIAKDPRFERLPCIHKGTYADDCIVDRVTQHKCYIVATCDRDLKRRIRKIPGVPIMYITQHKYSIERMPEATIGGAPRF

SEQ ID NO: 4401 - protein, 198 aa, Coffea canephora
MGKAKKAPKFAVMKKMVTSKAIKQHKEEVLNPNKKDLTKEKLPRNVPNVSSALFFKHNTALGPPYMILVDTNFINFSIQNKLDLQKGMMDCLYAKCTPCVTDCVMAELEKLGQKYRVALRIAKDPRFERLPCTHKGTYADDCIVDRVTQHKCYIVATCDRDLKRRIRKVPGVPIMYITQHKYSIERLPEATIGGAPRI

SEQ ID NO: 4402 - protein, 198 aa, Cyamopsis tetragonoloba
  misc_feature (187)..(187): Xaa can be any naturally occurring amino acid
MGKAKKGPKFAVMKKIVTSKAIKNYKEEVLNPEKKNLLKEKLPRNVPSHSSALFFQYNTALGPPYRVLVDTNFINFSIQNKLDLEKGMMDCLYAKCTPCITDCVMAELEKLGHKYRVALRIAKDPRFERILCTHKGTYADDCLVERVTQHKCYIVATCDRDLKRRIRKIPGVPIMYITKHKYSIERXPEATIGGAPRI

SEQ ID NO: 4403 - protein, 196 aa, Lactuca sativa
MGRAKKGPKFAVMKKMVSHKEIKQHKEDVLNPNKKDLTKLPRNVPYVSSALFFTYNTALGPPYRVLVDTNFINFSIQNKLDLEKGMMDCLYAKCTPCITDCVMAELEKLGQKYRVALRIAKDPRFERLPCTHKGTYADDCIVERVTQHKCYLVATCDRDLKRRIRKIPGVPIMYITQHKYSIERLPEATMGGAPRM

SEQ ID NO: 4404 - protein, 198 aa, Populus trichocarpa
MGRAKKGPKFAKMKKMITSKAIKQHKEEVLNPKKKDLSLEKLPRNVPQVSSALYFSYNTALGPPYRVLVDTNFINFSIQNKLDLEKAMLDCLYAKCTPCITDCVMAELEKLGQKYRVALRIAKDPRFERLPCIHKGTYADDCIVERVTKHKCYIVATCDRDLKRRIRKIPGVPIMYITQHKYSIERLPEATVGGAPRY

SEQ ID NO: 4405 - protein, 198 aa, Prunus persica
MGRARKGPKFAVMKKVVTSKAIKSYKEEVLNPNKKDLTKEKLPRNVPNVSSALFFKYNTALGPPYRVLVDTNFINFSIQNKLDLEKAMMDCLYAKCTPCITDCVMAELEKLGQKYRVALRIAKDPRFERLPCTHKGTYADDCLVERVTQHKCYIVATCDRDLKRRIRKIPGVPIMYITQHKYSIERLPEATIGGAPRF

SEQ ID NO: 4406 - protein, 198 aa, Nicotiana tabacum
  misc_feature (74)..(74): Xaa can be any naturally occurring amino acid
  misc_feature (170)..(170): Xaa can be any naturally occurring amino acid
MGKAKKAPKFAVMKKMVTHKAIKQYKEDVLNPNKKDLTKEKLPKNVPYVSSALFFKYNTALGPPYRVLVDTNFXNFSIQNKLDLEKGMMDCLYAKCTPCITDCVMAELEKLGQKYRVALRIAKDPRFERLPCTHKGTYADDCIVERVTQHKCYIVATCDRDLKRRIRKVXGVPIMYITQHKYSIERLPEATIGGAPRY

SEQ ID NO: 4407 - protein, 111 aa, Cucurbita pepo
MMDCLYAKCTPCITDCVMAELERLGQKYRVALRIAKDPRFERLPCTHKGTYADDCLVERVTQHKCYIVATCDRDLKRRIRKIPGVPIMYITRHQYSIERLPEATMGGAPRM

SEQ ID NO: 4408 - protein, 104 aa, Sequoia sempervirens
MMDCLYAKCTPCITDCVMAELEKLGQKYRVALRIAKDPRFDRLPCTHKGTYADDCIVERVTQHKCYIVATCDRDLKRRIRKIPGVPIMYITQHKYSLNACQKQL

SEQ ID NO: 4409 - protein, 199 aa, Persea americana
QWGRRRKPPNSQFVKKLVSSKTLRKYKEEVLNPKRKDLEREKLPRNVPSVPSALFFKHNTALGPPYRVLVDTNFINFSIQNKLDLEKGMMDCLYAKCTPCITDCVMAELEKLGQKYRVALRIAKDPRFERLPCTHKGTYADDCLVDRVTQHKCYIVATCDRDLKRRIRKIPGVPIMYITQHKYSIERLPEATIGGAPRL

SEQ ID NO: 4410 - protein, 197 aa, Theobroma cacao
MGKAKKAPKFASMKKIVTQKAIKKQEQVLNPNKKDLSKEKLPRNVPNVSSALFFTYNTSLGPPYRVLVDTNFINFSIQNKLDLEKGMMDCLYAKCTPCITDCVMAELEKLGQKYRVALRIAKDPRFERLPCTHKGTYADDCILFRRKQHKCFIVATCDRDLKRRIRKVPGVPIMYITQHKYSIERLPEATIGGAPRF

SEQ ID NO: 4411 - protein, 198 aa, Eucalyptus grandis
MGRAKKGPKFAAMKKIVTSKAIKNYKQEVLNPNKKDLSKEKLPRNVPNVSSALFFKHNSALGPPYQVLVDTNFINFSIQNKLDLEKGMMDCLYAKCTPCITECVMAELEKLGQKYRVALRIAKDPRFERLPCTHKGTYADDCLVERVTQHKCYIVATCDRDLKRRIRKIPGVPIMFITQHKYSIERLPEATIGGAPRF

SEQ ID NO: 4412 - protein, 196 aa, Fagopyrum esculentum
MGRAKKGPKFAVKKKLVTSKALKQHKQEVLNPNKKDLEKLPRNVPYVSSALFFKHNVALKPPYRVIVDTNFINFSIQNKLDLEKGMLDCLYAKCTPCITDCVMAELEKLGQKYRVALRIAKDPRFERLPCTHKGTYADDCIVDRVTQHKCYIVATCDRDLKRRIRKVPGVPIMYITQHKYSIERLPEATIGGAPRY

SEQ ID NO: 4413 - protein, 196 aa, Taraxacum officinale
MGRAKKGPKFAVMKKLVSHKAIKQHKEDVLNPNKKNLTKLPRNVPYVSSALFFTYNTALGPPYRVLVDTNFINFSIQNKLDLEKGMMDCLYAKCTPCITDCVMAELEKLGQKYRVALRIAKDPRFERLPCTHKGTYADDCIVERVTQHKCYLVATCDRDLKRRIRKIRGVPIMYITQHKYSIERLPEATMGGAPRM

SEQ ID NO: 4414 - protein, 198 aa, Rhizophora mangle
MGKAKKGPKFAAVKKMVTSKALKHYKEEVLNPGKKDVSKQKLPRNVPQVSSALYLGYNTALGPPYRVLVDTNFINFSIQNKLDLERGMMDCLYAKCTPCITDCVMAELEKLGQKYRVALRIAKDPRFERIPCIHKGTYADDCIVDRVTQHKCYIVATCDRDLKRRIRKIPGVPIMYITQHKYSIERLPEATIGGAPRF

SEQ ID NO: 4415 - protein, 203 aa, Malus domestica
MGRAKKGPKFAVMKKVVTSKAIKSYKEAVLNPNKKNLTKEKLPRNVPNVSSALFFKHNTALGPPYQVLVDTNFINFSIQNKLDLEKGMMDCLYAKCTPCITDCVMAELEKLGQKYRVALRIAKDPRFERLLCTHKGTYADDCIVERVTQHKCYIVATCDRDLKRRIRKVPGVPIMYITQHKYSIERLPEATIGGGRLGYQKLT

SEQ ID NO: 4416 - protein, 108 aa, Cajanus cajan
MGKAKKGPKFAVMKKVVTSKAIKSYKEEVLNPEKKNLLKEKLPRNIPSHSSALFFQYNTALGPPLSVFWWIPTSSISPSKIIGSGERNDGLLICKMHPLYHRLCDGRT

SEQ ID NO: 4417 - protein, 198 aa, Cucumis sativus
MGRAKKGPKFAVMKKMVTSKAIKNYKEEVLNPKRKDLTKENLPRNVPNVPSALFFKYNTALGPPYRVLVDTNFINFSIQNKLDLEKGMMDCLYAKCTPCITDCVMAELERLGQKYRVALRIAKDPRFERLPCTHKGTYADDCLVERVTQHKCYIVATCDRDLKRRIRKVPGVPIMYITRHQYSIERLPEATIGGAPRM

SEQ ID NO: 4418 - protein, 198 aa, Triphysaria pusilla
MGKAKKSPKFAVMKKIVTHKALKHYKEEILNPNKKDLTKEKLSKNVPQVSSALYFSHNTALGPPYRVLVDTNFINFSIQNKLDLEKGMMDCLYAKCTPCITDCVMAELEKLGQKYRVALRIAKDPRFERLPCIHKGTYADDCLVDRVTMHKCYIVATCDRDLKRRIRKVPGVPIMYITQHRYSIERLPEATLGGAPRN

SEQ ID NO: 4419 - protein, 153 aa, Nuphar advena
  misc_feature (149)..(149): Xaa can be any naturally occurring amino acid
MGKSKKTPKFAVKKKLVSSKTLKKYKEEVLNPNKKDTQKEKLPRNVPTVSSALYFTYNTALGPPYRVLVDTNFINFSIQNKLDLVDAMMQCLYAKCTPCITDCVMAELEKLGQKYRVALRIAKDPRFDRLPCIHKGTYADDCIVDRVTXTNAI

SEQ ID NO: 4420 - protein, 198 aa, Gossypium hirsutum
MGKAKKAPKFAGMKKIVTQKAIKHYKDQVLNPNKKDLSKEKLPRNVPNVSSALFFTHNTSLGPPYRVLVDTNFINFSIQNKLDLEKGMMDCLYAKCTPCITDCVMAELEKLGQKYRVALRIAKDPRFERLPCVHQGTYADDCIVERVTQHKCFIVATCDRDLKRRIRKVPGVPIMYVTQHKYSIERLPEATIGGAPRF

SEQ ID NO: 4421 - protein, 198 aa, Vinca minor
MGKAKKAPKFAVMKKMVTSKAIKQYKEEILNPNKKDLTKGKLPRNVPNVSSALFFSHNTALGPPYRVLVDTNFINFSIQNKLDLEKAMMDCLYAKCTPCITDCVMAELEKLGTKYRVALRIAKDPRFERLPCTHKGTYADDCLVDRVTQHKCYIVATCDRDLKRRIRKVPGVPIMYITQHKYSIERLPEATVGGAPRY

SEQ ID NO: 4422 - protein, 198 aa, Quercus alba
MGKAKKGPKFAAMKKMVTKKSIKNYKQQVLDPKKNDNNEKKLPRNVPKVSSALFFNYNTSLGPPYRVLVDTNFINFSIQNKLDLEKGMMDCLYAKCTPCITQCVMAELEKLGQKYRVALRIAKDPRFERLICTHKGTYADDCIVDRVTEHKCYIVATCDRDLKRRIRKVPGVPIMYITRHKYSIERLPEATVGGAPRY

SEQ ID NO: 4423 - protein, 198 aa, Populus trichocarpa
MGRAKKGPKFAKMKTMITSRAIKQHKEEVLNPKKRDLYLEKLPRNVPQVSSALFFSYNTALGPPYRVLVDTNFINFSIQNKLDLEKAMLDCLYAKCTPCITDCVMAELEKLGQKYRVALRIAKDPRFERLPCVHKGTYADDCIVERVTKHKCYVVATCDRDLKRRIRKIPGVPIMYITQHKYSIERLPEATVGGAPRY

SEQ ID NO: 4424 - protein, 203 aa, Malus domestica
MGRAKKSPKFSVMKKVVTSKAIKSYKEAVLNPNKKDLTKEMLPRNVPNVSSALFFKYNTALGPPYRVLVDTNFINFSIQNKLDLEKGMMDCLYAKCTPCITDCVMAELEKLGQKYRVALRIAKDPRFERLLCTHKGTYADDCIVERVIQHKCYIVATCDRDLKRRIRKVPGVPIMYITQHKYSIERLPEATIGGGRLRYQKTH

SEQ ID NO: 4425 - protein, 198 aa, Chelidonium majus
MGKAKKGPKFAVMKRTISSKMIKQNKEEVLNPKKKDLEKENRTRNVPNVSSALFFKHNTALGPPYRVLIDTNFINFSIQNKLDLEKAIDGLPLCKMYPCITDCVMAELEKLGQKYRVALRIAKDPRFERLPCTHKGTYADDCLVDRVTQHKCYIVATCDRDLKRRIRKVPGVPIMYITQRKYSIERLPEATIGGAPRY

SEQ ID NO: 4426 - protein, 197 aa, Unknown
  Sequence found in Organisms: Euphorbia peplus, Euphorbia esula
MGKAKKGRKFAVMKKMVTSKAIKQYKEDVLNPNKKDLSKEKLPRNVPRVSSALYFKHNTALGPPYRVLVDTNFINFSIQNKLDLEKAMLDCLYAKCTPCITDCVMAELEKLGQKYRVALRIAKDPRFDRISCIHKGTYADDCIVDRVTQHKCYIVATCDRDLKRRIRKIPGVPIMYITQHKYSIERLPEATIGGAPR

SEQ ID NO: 4427 - protein, 198 aa, Lippia dulcis
MGKAKKSSKFAVMKKIVTHKAIKQYKEDVLNPNRKDLTKEKLPRNVPQVSSALYFKHNTALGPPYRVLVDTNFINFSIQNKLDLEKAMMDCLYAKCTPCITDCVMAELEKLGQKYRVALRIAKDPRFERLPCIHKGTYADDCLVDRVTQHKCYIVATCDRDLKRRIRKIPGVPIMYITKHQYSIERLPEATIGGAPRV

SEQ ID NO: 4428 - protein, 198 aa, Primula obconica
MGRAKKSPKFAVMKNLISSKAIKHHKEEVLNPNKKDLTKLNLPRNVPNVPSALFFKYNTALGPPYRVLVDTNFINFSIQNKLDLEEGMKVCLYAKCTPCITDCVMAELEKLGQKYRVALRIAKDPRYERLPCIHKGTYADDCLVDRVTQHKCYIVATCDRDLKRRIRKIPGVPIMYITQHRYSIERLPEATIGGAPRI

SEQ ID NO: 4429 - protein, 198 aa, Trigonella foenum-graecum
MGKAKKGPKFAVMKKMVTSKAIKSYKEAVLNPEKKDTLKEKLPRNVPKLSSALFFQYNTALGPPYRVLVDTNFINFSIQNKLDLEKGMMDCLYAKCTPCITDCVMAELEKLGTKYRVALRIAKDPRFQRLICTHKGTYADDCLVERVTERKCFIVATCDRDLKRRIRKISGVPIMYITKHKYSIERLPEATMGGAPRI

SEQ ID NO: 4430 - protein, 198 aa, Medicago truncatula
MGKAKKGPKFAVMKKMVTSKAIKSYKEAVLNPEKKNTLKEKLPRNVPTHSSALFFHYNTALGPPYRVLVDTNFINFSIQNKLDLEKGMMDCLYAKCTPCITDCVMAELEKLGTKYRVALRIAKDPRFERLLCTHRGTYADDCLVDRVTESKCFIVATCDRDLKRRIRKIPGVPIMYITKHRYSIERLPEATIGGAPRI

SEQ ID NO: 4431 - protein, 198 aa, Carthamus tinctorius
  misc_feature (26)..(26): Xaa can be any naturally occurring amino acid
  misc_feature (71)..(71): Xaa can be any naturally occurring amino acid
  misc_feature (79)..(79): Xaa can be any naturally occurring amino acid
  misc_feature (113)..(113): Xaa can be any naturally occurring amino acid
  misc_feature (120)..(120): Xaa can be any naturally occurring amino acid
  misc_feature (123)..(123): Xaa can be any naturally occurring amino acid
  misc_feature (127)..(127): Xaa can be any naturally occurring amino acid
  misc_feature (151)..(151): Xaa can be any naturally occurring amino acid
MGRAKKGPKFAVMKKLASHKAIKQHXEEVLNPNKKDLTKEKLPRNVPYVSSALFFTYNTALGPPYRVLVDXNFINFSIXNKLDLEKGMMDCLYAKCTPCITDCVMAELEKLGXKYRVALXIAXDPRXERLPCTHKGTYADDCIVERVTQHXCYMVATCDRDLKRRIRKIPGVPIMYITQHKYSIERLPEATMGGAPRI

SEQ ID NO: 4432 - protein, 361 aa, Triticum aestivum
MSSQTAIFVYGKPAPFSLACLFRSSCAILSLSLVAASTSSHVECSSAVLSEPTFSFTPCAASFVASQAPCAACFAFSPSTCAVSATLLAPSLVISATFSPALLVPSAALSLASPALSMAPSATSAVFSLAAPAVSLALSIACPVVSLALSFISPALSAAWLAVSLVSCLAFSVMREALSAASSAVSLALSFISPALSAAWFAVSLVSWFAFSVMREAFSAASPALSLVSSAMRDAWSFALSLAWPVASLACSAAPLYLSLISLRSSGELLYACDDLGAVCMQMGLQLAACGRGARKQGLGMAFTAVFPVSAVALATRAPPRSMAAINLDMDVLCQDGSIRQCGEILQALSLGSAVNYGGCA

SEQ ID NO: 4433 - protein, 365 aa, Triticum aestivum
MSSQTAIFFYGKPAPFSLACLFRSSCAILSLSLVAASTSSHVECSSAVLSEPTFSFTPCAASFVASQAPCAACFAFSPSACAVSATLLAPSLVISATFSPALLVPSAALSLASPALSMAPSATSAVFSLAAPAVSLALSIACPVVSLALSFISPALSAAWLAVSLVSCLAFSVMREALSAASSAVSLALSFISPALSAAWLAVSLVSCFALSVMREAFSAASPALPLVSSAMRDAWSFALSLAWPVASLACSAAPLYLSLISLRSSGELLYACDDLGAVCKQMGLQFAACGRGARKQGLGMAFTAVLPVSAVALATRAPPRSMAAINLDMDVLYQHCSISQCGEILKAWNLGSVGNDGAEAWVAV

SEQ ID NO: 4434 - protein, 320 aa, Triticum aestivum
  misc_feature (237)..(237): Xaa can be any naturally occurring amino acid
MSRLMAAMLLGGARVASATALTGNTAVKAIPRPCFLAPRPHAASWSPICMQTAPRSSQAYNNAPDDRREIKDKYRGAAEQAKDATGHAKESAKDHASRMADETKDRAGDAAEKASRMTEKAKHETKETASQAADKAGEMKEKAKETAEEAAEKASRMTEKAKHETKETASQAAHKAGEMKERAKETTGQAMDKAKETAGAAKEKTAEVAEGAMDKAGEAKDRAAEGTRSAGEKVAEXTKEGASKVAETAQALSEKAKQAAQGAWEATKEAAQGVKEKVGTESTAEEHSTWDDVEAATKERDRIAQEERKRQAREKGAGLP

SEQ ID NO: 4435 - protein, 320 aa, Triticum aestivum
MSRLMAAMLLGGARVASATALTGNTAVKAIPRPCFLAPRPHAASWSPICMQTAPRSSQAYNNSPDDRREIKDKYRGAAEQAKDATGHAKESAKDQASRMADETKDKAGDAAEKASRMTEKANHETKETANQAADKAGEMKERAKETAEEAAERASRMTEKAKHETKETASQAADKAGEMKERAKETTGQAIDKAKETAGAAKEKTAEVAEGAMDKAGEAKDRAAEGTRSAGEKVAEMTKEGASKVAETAQVLGEKAKQAAQGAWEATKEAAQGVKEKVGSESTAEEHSTWDDVEAATKERDRIAQEERKRQAREKGAGLP

SEQ ID NO: 4436 - protein, 320 aa, Triticum aestivum
MSRLMAAMLLGGARVASATALTGNTAVKAIPKPCFLAPRPHAANWSPICLQTAPRSSQAYNNSPDDRREIKDKYRGAAEQAKDATGHAKESAKDQASRMADETKGRAGDAAEKASRMTDKAKHETKETASQAADKAGEMKDRAKETAEEAAERASRMTEKAKHETKETASQAADKAGEMKERAKETTGQAIDKAKETAGAAKEKTAEVAEGAMDKAGEAKDRAAEGTRSAGEKVAEMTKEGASKVAETAQALGEKAKQAAQGAWEATKEAAQGVKEKVGSESTAEEHSTWDDVEAATKERDRIAQEERKRQAREKGAGLP

SEQ ID NO: 4437 - protein, 313 aa, Pseudoroegneria spicata
MSRLMAAMLLGGARVASATALTGNTAVKAIPRPCFLAPRPHAASWSPICLQTAPRSSQAYNNSPDDRREIKDKYRGAAEQAKDATGGAKESAKGQASRMADETKDKAGDAAEKASRMTEKAKHETKETASQAADKTAEMKDRAKETAEEAAEKAKHETKETASQAADKAGEMKERAKETTGQAIDKAKETAGAAKEKTAEVAEGAKDRVGEAKDTAAEGTRSAGEKVAEMTKEGASKVAETAQALGEKAKQAAQGAWDATKGAAQGVKEKVTSESTTEEHSTWDDVEAATKGRDRIAQEESKRQAREKGAGLP

SEQ ID NO: 4438 - protein, 275 aa, Triticum aestivum
MELATAAVVSTASIHPGRSHFSTPRVASWSSSSSPSSSRSLSTSASTSRSQRRRLPVASAAVELREAAAGGGDSVRVIETPQPNSSVKFSVEVPPSICQECYQTTLLEYSKRFKVPGFRPGKIVPENVLLNYVGPQHVRAATVEAILRHTLPQALSSVEERALEDSVRILTKFDDMNEAFSLDHVFRYDVAVDVVPEVRWLSEDKYKNLKVVIEIDEIVDAEKAAELELKRRRKSLGLLRIVPDRGLQVGDLVVLDILAETITTDGSRGRKNSVS

SEQ ID NO: 4439 - protein, 526 aa, Leymus cinereus x Leymus triticoides
MELATAAVVSTASIHTGRSHFSTPRAASWSSSSSPSSSRSLSTSASTSRSQRRRLPVASAAVELREAAAGGGDSVRVIETPQPNSSVKFSVEVPPSICQECYQTTLLEYSKRFKVPGFRPGKIVPENVLLNYVGPQHVRAATVEAILRHTLPQALSSVEERALEDSVRILTKFDDMNEAFSLDHVFRYDVAVDVVPEVRWLSEDKYKNLKVVIEIDEIVDAEKAAELELKRRRKSLGLLRIVPDRGLQVGDLVVLDILAETITTDGSKGEKIPSAESTGFHLDTEENTNLVPGFLGSLIGIRPGETRSFPIQFPESFEQETLQGVRAQFTVVCKELFFRELPELDDSLAPKLLPGCTTIDQVKERILERCKEVEKTAIEQATDNAILDQLGKLVDVDVPHSLFQEQGQQLYGAKLLQLQAERKLDKDQLASLSSEKSVQEYLKSERENITRIIKQMLVVGEIFKAENLQYSTDQLVKEVENSIEEFKRYNQDYDEGNIKQQVQDVLEAAKVLEWLKENCTIEYIRK

SEQ ID NO: 4440 - protein, 543 aa, Triticum aestivum
RLLPHKSKRAAPLRAAAMELATAAVVSTASIHPGRSHFSTARVASWSSSSSPSSSRSLSTSASTSRSQRRRLPVASAAVELREAAAGGGDSVRVIETPQPNSSVKFSVEVPPSICQECYQTTLLEYSKRFKVPGFRPGKIVPENVLLNYVGPQHVRAATVEAILRHTLPQALSSVEERALEDSVRILTKFDDMNEAFSLDHVFRYDVAVDVIPEVRWLSEDKYKNLKVVIEIDEIVDAEKAAELELKRRRKSLGLLRIVPDRGLQVGDLVVLDILAETITTDGSKGEKIPSAESTGFHLDTEENNNLVPGFLGSLIGIRPGETRTFPIQFPESFEQETLQGVRAQFTVVCKELFFRELPELDDSLAAKLLPGCNTIDEVKERILERCKEVEKTAIEQATDNAILDQLGKLVDVDVPRSLFQEQGQQLYGAKLLQLQAERKLDKDQLASLSSEKSVQEYLKSERENIARIIKQMLVVGEIFKAENLQYSTDQLVKEVENSIEEFKRYNQDYDEGNIKQQVQDVLEAAKVLEWLKENCTIEYIKK

SEQ ID NO: 4441 - protein, 525 aa, Brachypodium distachyon
MELATAAAVVSTASTHPGRNRFYSSRSASWSNCSPLSSSRSLSTSTSRFQIRPLPVAWAAVELREAASGGGDSVRVTETLQPGSSVKFSVEVPPSICQECYETTLMEYSKRFKVPGFRPGKIVPENVLINYVGPQHVRAATVEAILRHTLPQALSSVEERALEDSVRILTKFDDMNNSFSLEDVFRYDVAVDIIPEVRWLSEDKYKNLKVVIEIDEIVDAEKAAEVELKRRRKALGLLRIVTDRGLQVGDLAVFDISAETITTDGSKGEKIPSAESTGFHLDTEENNNLVPGFLGSLIGIRPGETRSFPIQFPESFDQESLRGVRAQFTVVCKELFFRQLPELDDSLAEKLLPGCTTMDQVRERILERCKEVEKTAIEQATDNAILDQLGQLVEVDVPRSLFQEQGQMLYGAKLLQLQAETKLDRDQLASLSSEKSVQEYLKNERENITRIIKQMLAVGEIFKAENLQYSTEQLIKEVENSIEEFKRYNQDYDEGNIKQQVQDVLEAAKVLEWLKENCTIEYIRR

SEQ ID NO: 4442 - protein, 537 aa, Oryza sativa
MELATATAAAAASSTTRAHRPRSSRLAVPTRDSCSLLPSSSSRQFAALSTSAASTASRSRAQRRRLPVASAAVELREASSQGGDSVRVTETLQPGSSVKFSVEVPPSICQQCYETTLQEYAKRFKIPGFRPGKVVPENVLINYVGPKHVQDATVEAILRHTLPQALSSVEDRALEDSVRILTKFEDMANSFSLDNVFRYDVSVDVAPEVRWLSEDKYKNLKVVVEIDEIVDAEKAAEIELKRRHKALGLLRIVADRGLQVGDLVVLDIFAESITSDGSKGEKIPSAESKGFHLDTEENNNLVPGFLGSLIGIRPGETRSFPLQFPESFEQESLQGVRAQFTVVCKELFYRELPELDDSLAGKLLPGCTTMDQVRERILQRCKEVEKTAIEQATDNAILDQLGKLVEVDVPRALFQEQGQQLYGAKLLQLQAERKLDKDQLASLSSQKSVQEYLESERENINRIIKQMLAVGEIFKAENLQFSTEQLVKEVENSIEEFKHYNQDYDEGSIKQQVQDVLEAAKVLEWLKENCIIEYIRP

SEQ ID NO: 4443 - protein, 525 aa, Sorghum bicolor
MELSTVAAAVASAAARPHGHFSSPRAASVSVSVSWNNSPSLASTSRRQRLLRRLPVTSAVVELRQAAAGGGDSLRVTETRQPGSSVKFSVEVPTSIIHDCYQTTLQEYAKRFKVPGFRPGKIIPENILINYVGPQHVQDATIEAVLKHTLPQALSSVEERALEDSVRILTQFDDMRNSFSLDNVFRYDVAVDVVPEVRWLSEDKYKNLKVVVEIDEAVDAEKAAEKELQRRHKALGLLRVVADRGLQIGDLVVLDIFADSINSDGSKGEKISSAESTGFHLDTEETNNLVPGFLGSLIGIRPGEARSFPIQFPESFEQESLRGVHAQFTVVCKELFYRELPEMGDSLAVKLLPGCTTIDEVRGRILERCKEVEKMAIEQATDNAILDQLGKLVEVDVPRALFQEQGQQLYGAKLLQLQAERKLDKDQLASLSTQRSVQAYLEDEKENITRIIKQMLAVGDVFKSENLQYSTEQLIKEVENSIAEFKQYNQDYDEDNIRQQVQDVLEAAKVLEWLKENCTVEYIRR

SEQ ID NO: 4444 - protein, 669 aa, Triticum aestivum
MVQYNFKKITVVPPGKDFIDIILSRTQRQTPTVVHKGYAINRIRQFYMRKVRYTQQNFYEKLSTIIDEFPRLDDIHPFYGDLLHVLYNKDHYKLALGQINTARNIIAKISKDYLRLLKYGDTLYRCKCLKVAALGRMCTVLKRISPSLAYLEQIRQHMARLPSIDPNTRTILICGYPNVGKSSFMNKVTRADVDVQPYAFTTKSLFVGHADYKYLRYQVIDTPGILDRPFEDRNIIEMCSITALAHLRAAVLFFLDISGSCGYTIAQQAALFHSIKSLFMNKPLVIVCNKTDLQPFDGLSEDDMKLVMEMKSEAMKTIPQGGDPSEEGVLLTMSALTDEGVMAVKNAACERLLEQRVEIKMKSKKINDCLNRFHVAMPKPRDNRDRPTCIPQAVLEAQAIAAAKEKKKLERDLENENGGAGVYSASLKKHYLLADDEWKEDILPEILDGHNVADFLDPDILERCEELEREEGLRLEEEAAQDAFMIDGHDELTEEQREILGKIRKKKAMLIQEHRMKKSTAESRPIVPRKHDKDRKFTTKRLGRQLTSMGVDPTAAVNRLRSQSRGRKRERSLSRADGDDAMDVDGQHSDKKLRTRSRSRSKSRPIEEVVPGDGIRDVAQKKKAIKKSRDSVKNRNKEARRGEADRVIPTLKPKHLFSGKRGVGKTQRR

SEQ ID NO: 4445 - protein, 666 aa, Brachypodium distachyon
MVQYNFKKITVVPPGKDFIDIILSRTQRQTPTVVHKGYAINRIRQFYMRKVRYTQQNFYEKLSTIIDEFPRLDDIHPFYGDLLHVLYNKDHYKLALGQINTARNIVAKISKDYLRLLKYGDTLYRCKCLKVAALGRMCTVIKRISPSLAYLEQIRQHMARLPSIDPNTRTILICGYPNVGKSSFMNKVTRADVDVQPYAFTTKSLFVGHADYKYLRYQVIDTPGILDRPFEDRNIIEMCSITALAHLRAAVLFFLDISGSCGYTIAQQAALFHSIKSLFMNKPLVIVCNKTDLQPLDGLSEEDMKLVMEMKSEAMKTIPQGGDPSEEGVLLTMSALTDEGVMAVKNAACERLLEQRVEIKMKSKKINDCLNRFHVAMPKPRDNRERPTCIPEAVLEAQAVAAAKEKKKLERDLENENGGAGVYSVSLKKHYILANDEWKEDILPEILDGHNVADFLDPDILERCEELEREEGLRLEEAAAQDAFMIDGHDELTKEQREILGQIRKKKAMLIQEHRMKKRTAESRPIVPRKFDKDRKFTTKRMGRQLSSMGVDPSAAVSRVRSQSRGRKRERSLSRAEGDDMEIDGQHSNKKLRTRSRSKSRPIEEVAPGEGFKDSAQKKKAIKKSRDSVKNRNKEARRGEADRVIPTLKPKHLFSGKRGNGKTSRR

SEQ ID NO: 4446 - protein, 220 aa, Avena sativa
MVQYNFKKITVVPPGKDFIDIILSRTQRQTPTVVHKGYAINRIRQFYMRKVRYTQQNFYEKLSTIIDEFPRLDDIHPFYGDLLHVLYNKDHYKLALGQINTARNIIAKISKDYLRLLKYGDTLYRCKCLKVAALGRMCTVLKRITPSLAYLEQIRQHMARPSVNRPQHQDYIDLWISKCWEELFHEQGYKGRCGCAALCFYNKVPVCWPCRLQVSAVPSD

SEQ ID NO: 4447 - protein, 676 aa, Oryza sativa
MVQYNFKRITVVPPGKDFIDIILSRTQRQTPTVVHKGYSISRIRQFYMRKVKYTQSNFYEKLSTVIDDFPRLDDIHPFYGDLLHVLYNKDHYKLALGQINTARNIIAKIAKDYLRLLKYGDSLYRCKCLKVAALGRMCTVIKRISPSLAYLEQIRQHMARLPSIDPNTRTLLICGYPNVGKSSFMNKITRADVDVQPYAFTTKSLFVGHADYKYLRYQVIDTPGILDRPFEDRNIIEMCSITALAHLRAAVLFFLDISGSCGYSIAQQAALFHSIKSLFMNKPLVIVCNKTDLQPLENLSEEDMKLVMEMKAEAMKTLGHGGEANEEGVLLTMSTLTEEGVMAVKNAACERLLDQRVEIKMKSKKINDCLNRFHVAMPKPRDNKERPACIPQAVLDARASAAAAKEKKKLERKLEKDLENENGGAGVYSASLKKHYLLADDEWKEDILPEILDGHNVADFLDPDILQRCEELEREEGLRLEEEAAQEAFQIDGHELTEEQREILGQIRKKKALLIQEHRMKKRTAESRPIVPRKFDKDRTFTTNRMGRQLSSMGFDPRAALDRARSRSRGRKRERSLSRAASDGDDMDIDGQQSSKKLRALSRSRSRSKSRPPEEVVPGEGFKDSAQKKKAIKKAKDSVRNRNKEARRGEADRVIPTLKPKHLFSGKRSIGKTSRR

SEQ ID NO: 4448 - protein, 667 aa, Setaria italica
MVQYNFKKITVVPPGKDFIDIILSRTQRQTPTVVHKGYAISRIRQFYMRKVRYSQQNFYEKLSTIIDEFPRLDDIHPFYGDLLHVLYNKDHYKLALGQINTARNIIAKISKDYLRLLKYGDSLYRCKCLKVAALGRMCTVVKRISPSLAYLEQIRQHMARLPSIDPNTRTVLICGYPNVGKSSFMNKVTRADVDVQPYAFTTKSLFVGHTDYKYLRYQVIDTPGILDRPFEDRNIIEMCSITALAHLRAAVLFFLDISGSCGYSIAQQAALFHSIKSLFMNKPLVIVCNKTDLQPLEGLSEDDMKLVMDMKAEAMKTITQAGDPNEEGVLLTMSTLTDDGVMAVKNAACERLLEQRVDVKMKSKKMVDCLNRFHVAVPKPRDNKERPICIPPAVLEARANAAAKEKKKLEKDFEQENGGAGVYSTSLKKHYILANDEWKEDILPEILDGHNVADFLDPDILERCEELEREEGLRLEEQAAQDAFEIDGHELTEEQKEILSQIRKKKALLIQEHRMKKRTAESRPIVPRKFDKDRKFTTKRMGRQLSSMGVDPSAAIARSKSRGRKRERSLSRAAADGDDMEVDGQQSNKKLRLRSRSRSKSRAPEEVIPGEGFKDSEQKKKAIKKAKDATRNRNKEARRGEADRVIPTLKPKHLFSGKRTLGKTSRR

SEQ ID NO: 4449 - protein, 676 aa, Oryza sativa
MVQYNFKRITVVPPGKDFIDIILSRTQRQTPTVVHKGYAISRIRQFYMRKVKYTQSNFYEKLSTVIDDFPRLDGIHPFYGDLLHVLYNKDHYKLALGQINTARNIIAKIAKDYLRLLKYGDSLYRCKCLKVAALGRMCTVIKRISPSLAYLEQIRQHMARLPSIDPNTRTLLICGYPNVGKSSFMNKITRADVDVQPYAFTTKSLFVGHADYKYLRYQVIDTPGILDRPFEDRNIIEMCSITALAHLRAAVLFFLDISGSCGYSIAQQAALFHSIKSLFMNKPLVIVCNKTDLQPLENLSEEDMKLVMEMKAEAMKTIGHGGEANEEGVLLTMSTLTENGVMAVKNAACERLLDQRVEIKMKSKKINDCLNRFHVAMPKPRDNKERPPCIPQAVLDARASADAAKEKKKLERKLEKDLENENGGAGVYSASLKKHYLLADDEWKEDILPEILDGHNVADFLDPDILQRCEELEREEGLRLEEEAAQEAFQIDGHELTEEQREILGQIRKKKALLIQEHRMKKRTAESRPIVPRKFDKDRTFTTDRMGRQLSSMGFDPSAAMDRARSRSRGRKRERSLSRAASDGDDMDIDGQQSSKKLRALSRSRSRSKSRPPEEVVPGEGFKDSAQKKKAIKKAKDSVRNRNKEARRGEADRVIPTLKPKHLFSGKSSIGKTSRR

SEQ ID NO: 4450 - protein, 669 aa, Sorghum bicolor
MVQYNFKKITVVPPGKDFIDIILSRTQRQTPTVVHKGYAINRIRQFYMRKVRYSQQNFYEKLSTIIDEFPRLDDIHPFYGDLLHVLYNKDHYKLALGQINTARNIIAKISKDYLRLLKYGDTLYRCKCLKVAALGRMCTVVKRISPSLAYLEQIRQHMARLPSIDPNTRTVLICGYPNVGKSSFMNKVTRADVDVQPYAFTTKSLFVGHTDYKYLRYQVIDTPGILDRPFEDRNIIEMCSITALAHLRAAVLFFLDISGSCGYSIAQQAALFHSIKSLFMNKPLVIVCNKTDLQPLEGLSEDDMKLVMEMKAEAMKTITQAGGPNEEGVLLTMSTLTDDGVMAVKNAACERLLEQRVDVKMKSKKMMDCLNRFHVAVPKPRDNKERPVCIPQAVLEARANAAAKEKKKLEKDIENENGGAGVYSASLKKHYILANDEWKEDILPEILDGHNVADFLDPDILVRCEELEREEGLRLEEQAAEDAFQIDGHELTQEQKEILAQIRKKKALLIQEHRMKKRTAESRPIVPRKFDKDRKFTTDRMGRQLSSMGVDPSAAMNRARSKSRGRKRERSLSRAAADGDSMEIDGQQSNKKLRRTSRSRSRSRAPEEVIPGEGFKDSEQKKKAIKKAKASTRNRNKEARRGEADRVIPTLKPKHLFSGKRTLGKTSRR

SEQ ID NO: 4451 - protein, 667 aa, Pennisetum glaucum
MVQYNFKKITVVPPGKDFIDIILSRTQRQTPTVVHKGYAISRIRQFYMRKVRYSQQNFYEKLSTIIDEFPRLDDIHPFYGDLLHVLYNKDHYKLALGQINTARNIIAKISKDYLRLLKYGDTLYRCKRLKVAALGRMCTVVKRISPSLAYLEQIRQHMARLPSIDPNTRTVLICGYPNVGKSSFMNKVTRADVDVQPYAFTTKSLFVGHTDYKYLRYQVIDTPGILDRPFEDRNIIEMCSITALAHLRAAVLFFLDISGSCGYSIAQQAALFHSIKSLFMNKPLVIVCNKTDLQPLEGLSEDDMKLVMEMKAEAMKTITQAGDPNEEGVLLTMSTLTDDGVMAVKNAACERLLEQRVDVKMKSKKMVDCLNRFHVAVPKPRDNKERPVCIPPAVLEARENAAAKEKKKLEKDFEQENGGAGVYSASLKKHYILANDEWKEDILPEILDGHNVADFLDPDILERCEELEREEGLRLEEQAAQDAFEIDGHELTEEQKEILSQIRKKKAQLIQEHRMKKRTAESRPVVPRKFDKDRKFTTNRMGRQLSSMGVDPSAAIARSKSRGRKRDRSLSRAAADGDDMEVDGQQSSKKLRLRSRSRSKSRAPEEVIPGEGFKDSAQKAVAIRKAKDSTKKRNKQARRGEADRVIPTLKPKHLFSGKRTLGKTSRR

SEQ ID NO: 4452 - protein, 669 aa, Zea mays
MVQYNFKKITVVPPGKDFIDIILSRTQRQTPTVVHKGYAISRIRQFYMRKVRYSQQNFYEKLSTIIDEFPRLDDIHPFYGDLLHVLYNKDHYKLALGQINTARNIIAKISKDYLRLLKYGDSLYRCKCLKVAALGRMCTVVKRISPSLAYLEQIRQHMARLPSIDPNTRTVLICGYPNVGKSSFMNKVTRADVDVQPYAFTTKSLFVGHTDYKYLRYQVIDTPGILDRPFEDRNIIEMCSITALAHLRAAVLFFLDISGSCGYSIAQQAALFHSIKSLFMNKPLVIVCNKTDLQPLEGLSEDDMKLVMEMKAEAMKTITQAVGPNEEGVLLTMSTLTDDGVMAVKNAACERLLEQRVDVKMKSKKMMDCLNRFHVAVPKPRDNKERPVCIPPAVLEARANAAAKEKKKLEKDIENENGGAGVYSASLKKHYILANDEWKEDILPEILDGHNVADFLDPDILVRCEELEREEGLRLEEQAAEDAFQIDGHELTQEQKEILAQIRKKKALLIQEHRMKKRTAESRPIVPRKFDKDRKFTTNRMGRQLSSMGVDPIAAINRARSQSRGRKRERSVSRAAADGDGMEIDGQQSNKKLRRTSRSRSRSRAPEEVIPGEGFKDSEQKKKAIKKAKASTRNRNKDARRGEADRVIPTLKPKHLFSGKRTLGKTSRR

SEQ ID NO: 4453 - protein, 670 aa, Zea mays
MVQYNFKKITVVPPGKDFIDIILSRTQRQTPTVVHKGYAISRIRQFYMRKVRYSQQNFYEKLSTIIDEFPRLDDIHPFYGDLLHVLYNKDHYKLALGQINTARNIIAKISKDYLRLLKYGDSLYRCKCLKVAALGRMCTVVKRISPSLAYLEQIRQHMARLPSIDPNTRTVLICGYPNVGKSSFMNKVTRADVDVQPYAFTTKSLFVGHTDYKYLRYQVIDTPGILDRPFEDRNIIEMCSITALAHLRAAVLFFLDISGSCGYSIAQQAALFHSIKSLFMNKPLVIVCNKTDLQPLEGLSEDDMKLVMEMKAEALKTIIQAGGPNDEGVLLTMSTLTDDGVMAVKNAACERLLEQRVDVKMKSKKMMDCLNRFHVALPKPRDNKERPVCIPLAVLEARANAAAKEKKLEKDIENENGGAGVYSASLKKHYILANDEWKEDILPEILDGHNVADFLDPDILVRCEELEREEGLRLEEQAAEDAFQIDGHELTQEQKEILAQIRKKKALLIQEHRMKKRTAESRPIVPRKFDKDRKFTTDRMGRQLSSMGMDPSAAMNRIRSQSRGRKRERSVSRAAADGDGMEIDGQQSNKKLRRTSRSRSRSRSRAPEEVLPGEGFKDSEQKKKAIKKAKAATRNRNKEARRGEADRVIPTLKPKHLFSGKRTLGKTSRR

SEQ ID NO: 4454 - protein, 645 aa, Pennisetum glaucum
LSRTQRQTPTVVHKGYAISRIRQFYMRKVRYSQQNFYEKLSTIIDEFPRLDDIHPFYGDLLHVLYNKDHYKLALGQINTARNIIAKISKDYLRLLKYRDTLYQCKCLKVAALGRMCTVVKRISPSLAYLEQIRQHMARLPSIDPNTRTVLICGYPNVGKSSFMNKVTRADVDVQPYAFTTKSLFVGHTDYKYLRYQVIDTPGILDRPFEGRNIIEMCSITALAHLRAAVLFFLDISGSCGYSIAQQAALFHSIKSLFMNKPLVIVCNKTDLQPLEGLSEDDMKLVMEMKAEAMKTITQAGDPNEEGVLLTMSTLTDDGVMAVKNAACERLLEQRVDVKMKSKKMVDCLNRFHVAVPKPRDNKERPVCIPPSVLEARVNAAAKEKKKLEKDLEQENGGAGVYSASLKKHYILANDEWKEDILPEILDGHNVADFLDPDILERCEELEREEGLRLEEQAVQDSFEIDGHELTEEQKEILSQIRKKKALLIQEHRMKKRTAESRPIVPRKFDKDRKFTTNRMGRQLSSMGVDPSAAIARSKSRGRKRDRSLSRAAADGDDMEVDGQQSNKRLRLRSRSRSKSRAPEEVIPGEGFKDSQQKMKAIRKAKDATRNRNKDARRGEADRVIPTLKPKHLFSGKRTLGKTSRR

SEQ ID NO: 4455 - protein, 673 aa, Malus domestica
MVQYNFKKMTVVPNGKDFIDIILSRTQRQTPTVVHKGYAISRLRQFYMRKVKYTQQNFHEKLSTIVDEFPRLDDIHPFYGDLLHVLYNKDHYKLALGQINTARNLIGKISKDYVKLLKYGDSLYRCKCLKVAALGRMCTVIKRIGPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLDGISEEDKKLVAEMKSEAMKTVIGQGGEATNDDGVLLTMSTLTEEGVIAVKNAACDRLLNQRVELKMKSKKINDCLNRFHVAMPKPRDNKERPPCIPQAVIEAKIKQAAEKEKRQTERDLENENGGAGVYSASLKKHYILANDEWKEDVMPEILDGHNVYDFVDPDILHRLEELEREEGLRQEEEGDDFEMDGLELTPEEKKTLAAIRKKKSLLIQEHRIKKSTAESRPIVPRKFDKDREFTTKRMGRQLSKLGIDPSRAIERARSRSVSRGRKRERSVDRGDTDGGDAMEVDTPNKKQRMLSRSRSRSRSRPPTEVVPGEGFKDSNQKAKALQKARKSNKNRNKDARRGEADRVIPTLKPKHLFSGKRSIGKTQRR

SEQ ID NO: 4456 - protein, 674 aa, Gossypium hirsutum
MVQYNFKKITVVPNGKDFIDIILSRTQRQTPTVVHKGYAISRLRQFYMRKVKYTQQNFHEKLSTIIDEFPRLDDIHPFYGDLLHVLYNKDHYKLALGQINTARNLISKIAKDYVKLLKYGDSLYRCKSLKVAALGRMCTVIKRIGPSLAYLEQIRQHMARLPSIDPNTRTMLICGYPNVGKSSFMNKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLDGISEEDRKLVMEMKAEAMKTVIGQGGEPTNEEGVLLTMSTLTEDGVIAVKNAACERLLNQRVELKMKSKKINDCLNRFHVALPKARDQKERPACIPQAVLEAKAKQAAEKEKRKTEKELEDENGGAGVYSASLRKNYILANDEWKEDTMPEILDGHNVYDFIDPDILLRLEELEREEGLRQAEEEGDDFEMDGQELSLEEQEALAEIRKKKSLLIQQHRMKKSTAESRPVVPRKFDTDRKFTTGRMGRQLSSLGLDPSLAINRARSKSRGRKRERSVDKREGDGGDAMDIDDNQASKKLRLRSTSRSRSQSRPPGEVIPGEGLKDSAQKIKAIKLAKKSVLKRNKNARRGEADRVIPTLKPKHLFSGKRSIGKTQRR

SEQ ID NO: 4457 - protein, 674 aa, Gossypium hirsutum
MVQYNFKKITVVPNGKDFIDIILSRTQRQTPTVVHKGYAISRLRQFYMRKVKYTQQNFHEKLSTIIDEFPRLDDIHPFYGDLLHVLYNKDHYKLALGQINTARNLISKVAKDYVKLLKYGDSLYRCKSLKVAALGRMCTVIKRIGPSLAYLEQIRQHMARLPSIDPNTRTMLICGYPNVGKSSFMNKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLDGISEEDRKLVMEMKAEAMKTVIGQGGEPTNEEGVLLTMSTLTEDGVIAVKNAACERLLNQRVELKMKSKKINDCLNRFHVALPKPRDQKERPACIPQAVLEAKAKQAAEKEKRKTEKELEDENGGAGVYSASLRKNYILANDEWKEDTMPEILDGHNVYDFIDPDILLRLEELEREEGLRQAEEEGDDFEMDGQELSLEEQEALAEIRKKKSLLIQQHRMKKSTAESRPVVPRKFDTDRKFTTGRMGRQLSSLGLDPSLAINRARSKSRGRKRERSVDKREGDGGDAMDIDDNQASKKLRLRSTSRSRSQSRPPGEVIPGEGLKDSAQKIKAIKLAKKSVLKRNKNARRGEADRVIPTLKPKHLFSGKRSIGKTQRR

SEQ ID NO: 4458 - protein, 676 aa, Populus trichocarpa
MVQYNFKKITVVPNGKDFVDIILSRTQRQTPTVVHKGYAISRLRQFYMRKVKYTQQNFHEKLSTIIDEFPRLDDIHPFYGDLLHVLYNKDHYKLALGQINTARNLISKIAKDYVKLLKYGDSLYRCKSLKVAALGRMCTVMKRIGPSLAYLEQIRQHMARLPSIDPNTRTVLICGYPNVGKSSFINKITRADVDVQPYAFTTKSLFVGHTDYKYLRYQVIDTPGILDRPFEDRNIIEMCSITALAHLRAAVLFFLDVSGSCGYSIAQQAALFHSIKSLFMNKPLTIVCNKTDLQPLEGISEEDMKLVMEMKSEAMKTLVAQGGEATNDADVLLTMSTLTEEGVIAVKNAACERLLNQRVEMKMKSKKINDCLNRFHVAMPKPRDQKERPPCIPQPVLEAKAKEAAEKEKRKTEKDLEDENGGAGVYSASLKKNYILAHDEWKEDVLPEILDGHNVYDFIDPDILQRLEELEQEEGIRQAEEGDDDFEMDGEELTAEEKEALAEIRKKKSLLIQEHRMKKSTAESRPTVPRKFDKDRKFTTKRMGRQLSAMGVDPSKAINRLRERSLSTRGRKRERSTDRGHDDGDAMDMDVDQPNKKLRLRSTSRSRSRSRPPNEVVPGEGFKDSAQKSKALKLFKNSAKKRNKDARRGEADRVIPTLKPKHLFSGKRSIGKTQRR

SEQ ID NO: 4459 - protein, 675 aa, Prunus persica
MVQYNFKKMTVVPSGKDFIDIILSRTQRQTPTVVHKGYAISRLRQFYMRKVKYTQQNFHEKLSTIIDEFPRLDDIHPFYGDLLHVLYNKDHYKLALGQINTARNLIGKISKDYVKLLKYGDSLYRCKCLKVAALGRMCTVIKRIGPSLAYLEQIRQHMARLPSIDPNTRTVLICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLEGISEEDKKLVTEMKAEAMKTVIGQGGEATNDEGVLLTMSTLTEEGVIAVKNAACERLLNQRVELKMKSKKINDCLNRFHVAMPKPRDNKERPPCIPQAVLEAKAKQAAEKEKRNTERDLENENGGAGVYSASLKKNYILANDEWKEDVMPEILDGHNIYDFVDPDILHRLEELEREEGHRQAEEGDDDFEMDGLELTPEEQKTLAEIRKKKSLLIQQHRIKKSTAESRPTVPRKFDKDRKFTTKRMGRQLSKLGLDPTKAINRARSRSVSTRGRKRERSLDRDDTDGGDAMDVDTPNKKQRMLSRSRSRSRSRPPTEVVPGEGFKDSAQKAKALQKANKSNKMRNKNARRGEADRVIPTLKPKHLFSGKRSIGKTQRR

SEQ ID NO: 4460 - protein, 675 aa, Amsonia hubrichtii
MVQYNFKKITVVPSGKDFVDIILSRTQRQTPTVVHKGYAISRIRQFYMRKVKYTQQNFHDKLSTIVDEFPRLDDIHPFYGDLLHVLYNKDHYKLALGQINTARNLISKIAKDYVKLLKYGDSLYRCKSLKVAALGRMCTVIKRIGPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIVVCNKTDLQPLEGISEEDKKLVMEMKAEAMKTVIGQGGEPTNEEGVLLTMSTLTEEGVIAVKNAACERLLDQRVELKMKSKKLNDCLNRFHVAMPKPRDQKERPACIPEAVLEARAKKAEQTAEKEKRKLEKDLEDENGGAGVYSASLRKHYILANEEWKEDIMPEILDGHNVYDFVDPDILQRLEELEREEGLRQEQEGDDDFEMDGADLTPEEQEALAEIRKKKSLLIQQHRMKKSTAESRSIIPRIFDKDRQFTAGRMGRQLQALGLDPTSAINRARSRSRGRKRERSSVRGEDDGGDAMDIDNDQPSKKLRFRSSSRSKSRPPNEVVPGEGFRDSAQKVKALKMAKNSVKKRNKNARRGEADRVIPTLKPKHLFSGKRSIGKTQRR

SEQ ID NO: 4461 - protein, 671 aa, Quercus alba
MVQYNFKNITVVPNGKDFIDIILSRTQRQTPTVVHKGYAISRLRQFYMRKVKYTQTNYYDKLSTIIDEFPRLDDIHPFYGDLLHVLYNKDHYKLALGQINTARNLISKIAKDYVRLLKYGDSLYRCKCLKVAALGRMCTVIKRVAPSLAYLEQIRQHMARLPSIDPNTRTVLICGYPNVGKSSFINKITRADVDVQPYAFTTKSLFVGHTDYKYLRYQVIDTPGILDRPFEDRNIIEMCSITALAHLRAAVLFFLDISGSCGYTIAQQAALFHSIKSLFMNKPLTIVCNKTDLQPLEGLSEEDMKLVMEMKAEAMKTVVGQGGEPTDDQGVLLTMSTLTEDGVIAVKNAACERLLDQRVEIKMKSKKINDCLNRFHVAIPKPRDQKERPPCIPQAVLEAKAKQAAEKEKRKTEKDLENENGGAGVYSASLKKNYILANDEWKEDVLPEILDGHNVYDFIDPDILQRLEELEQEEGLRQAEEVDDDFEMDGKELTPEEQQALAEIRKKKSLLIQQHRIKKSTAESRPIVPRKFDKDKQFTTRRMGRQLSALGLDPSKAIDRARSRSRGRKRERSPANDGGDAMDMDVDTPNKRLRMRSRSRSRSVSRPPGELVPGEGFRDSAQKVKAQKLAKKSSKKRNKDARRGEADRVIPTLKPKHLFSGKRSSGKTDRR

SEQ ID NO: 4462 - protein, 671 aa, Quercus alba
MVQYNFKNITVVPNGKDFIDIILSRTQRQTPTVVHKGYAISRLRQSYMRKVKYTQTNYYDKLSTIIDEFPRLDDIHPFYGDLLHVLYNKDHYKLALGQINTARNLISKIAKDYVRLLKYGDSLYRCKCLKVAALGRMCTVIKRVAPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYTIAQQAALFHSIKSLFMNKPLTIVCNKTDLQPLEGISEEDKKLVMEMKAEAMKTVIGQGGEPTDDQGVLLTMSTLTEDGVIAVKNAACERLLDQRVEIKMKSKKINDCLNRFHVAIPKPRDQKERPPCIPQAVLEAKAKQAAEKEKRKTEKDLENENGGAGVYSASLKKNYILANDEWKEDVLPEILDGHNVYDFIDPDILQRLEELEQEEGLRQAEEVDDDFEMDGKELTPEEQQALAEIRKKKSLLIQQHRIKKSTAESRPIVPRKFDKDKQFTTRRMGRQLSALGLDPSKAIDRARSRSRGRKRERSPDNECGDAMDIDVDTPNKKLRMRSRSRSRSVSRPPGEVVPGEGFKDSAQKVKAQKLAKKSSKKRNKDARRGEADRVIPTLKPKHLFSGKRSSGKTDRR

SEQ ID NO: 4463 - protein, 668 aa, Eucalyptus grandis
MVQYNFKKITVVPSATDFINIILSRTQRQTPTVVHKGYAISRLRQFYMRKVKYTQQNFHDKLSTIIEEFPRLDDIHPFYGDLLHVLYNKDHYKLALGAINTARNQIGKVAKDYVKLLKYGDSLYRCKSLKVAALGRMCTLVKKLSGSLAYLEQIRQHMARLPSIDPNTRTLLICGYPNVGKSSFMNKITRADVDVQPYAFTTKSLFVGHTDYKYLRYQVIDTPGILDRPFEDRNIIEMCSITALAHLRSAVLFFLDISGSCGYSIAQQAALFHSIKSLFMNKPLMIVCNKTDLQPLEGLSEGDMKLVMEMKAEAMKTVIGQGGEATDDEGVLLTMSTLTEDGVMAVKNAACGRLLNQRVEIKMKSKKINDCLNRFHVAIPKPRDQKERPACIPQAVLEARAQQAAEKEKRKTERDLEDENGGAGVYSASLKKNYILANEEWKEDILPEILDGHNVADFIDPDILMRLEELEREEGMRQVEDDEDFEMDGKDLTPEEQEALAAIRKKKSMLIQQHRVKKSTAESRPTVPRKFDKSREFTTKRMGRQLSSLGLDPSLAIERARSRSRGRKRERSPERGDAMDVDTDESNKKLRTRSRSRSRSMSRPPTEFVPGAGFKDSEQKVKAIKLAKKSVKKRNKNARRGEADRVIPTLKPKHLFSGKRSIGKTDRR

SEQ ID NO: 4464 - protein, 671 aa, Mimulus guttatus
MVQYNFKKITVVPTGKDFIDIILSRTQRRTPTQVHKGYAISRLRQFYMRKVKFTQTNFHEKLSTIIEEFPRLGDIHPFYGDLLHVLYNKDHYKLALGQINTARNLIGKIAKDYVKLLKYGDSLYRCKSLKVAALGRMCTVIKRVSPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYTIAQQAALFHSIKSLFMNKPLTIVCNKTDLQPLDGISEEDKKLVMEMKSEAMKTVIGQGGEPTDDNGVLLTMSTLTEDGVIAVKNAACERLLDQRVELKMKSKKLNDCLNRFHVAMPKPRDHKERPPCIPQAVLEAKAKKAEETAEKEKKKLERDIENENGGAGVYSASLKKHYMLANDEWKEDNMPEILDGHNVYDFIDPDILMRLEELEREEGTLQGLEEDDDFEMDGAELTPDEQAALAEIRKKKSLLIQQHRIKKSTAESRPIVPRKFDKDGKFTSERMGRQLSSLGLDPSKAIDRARSKSRGRKRERSVSQVDSMDVDGDNSNKKMRLRSRSASRSSRPPGELVPGEGLRDTAQKKKAIKLAQGSSKNRNKDARKGEADRVIPTLRPKHLFSGKRSKGKTDRR

SEQ ID NO: 4465 - protein, 678 aa, Ricinus communis
MVQYNFKKITVVPSGKDFVDIILSRTQRQTPTVVHKGYAISRLRQFYMRKVKYTQQNFHEKLSTIIDEFPRLDDIHPFYGDLLHVLYNKDHYKLALGQINTARNLISKIAKDYVKLLKYGDSLYRCKSLKVAALGRMCTVIKRIGPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLEGISEEDRELVMEMKAEALKTVIGQGGEATGDEGVLLKMSTLTEEGVIAVKNAACERLLDQRVELKMKSKKINDCLNRFHVAIPKPRDQKERPPCIPQAVLEAKAKQAAEAAEKEKRKTEKDLENENGGAGVYSASLRKKYILANDEWKEDVLPEILDGHNVYDFIDPDVLERLEELEREEGIRLAEEEDEDFEMDGEELTPEEQEALAAIRKKKTLLIQEHRMKKSTAESRPTVPRKFDKDRRFTTDRMGRDLKSVGLDPSLAINRVRSRSVSRGRKRERSLAREDKDGGDAMDMDVDQPNKKLRLAISRSRSKSRPPTEVVPGEGFKDSAQKIKGIKLHKKSAKKRNKDARRGEADRVIPTERPKHLYTGKRGIGKTDRR

SEQ ID NO: 4466 - protein, 676 aa, Citrus clementina
MVQYNFKKITVVPNGKDIVDIILSRTQRQTPTVVHKGYSITRLRQFYMRKVKYTQQNFFEKLSTIIDEFPRLDDIHPFYGDLLHVLYNKDHYKLALGQINTARNLISKIAKDYVKLLKYGDSLYRCKSLKVAALGRMCTVVKRIGPSLAYLEQIRQHMARLPSIDPNTRTILICGYPNVGKSSFMNKITRADVDVQPYAFTTKSLFVGHTDYKYLRYQVIDTPGILDRPFEDRNIIEMCSITALAHLRSAVLFFLDISGSCGYSIAQQAALFHSIKSLFMNKPLIIVCNKTDLQSLDGISEEDKKLVMEMKAEAMKTVMGQGGEVGDDEGVLLTMSTLNEEGVAAVKNAACERLLNQRVELKMKTKKINDCLNRFHVAIPKPRDQKERPPCIPQAVLEAKAKQAAEKERRKTEKDLEDENGGAGVYSASLKKNYILANEEWKDDVMPEILDGHNVYDFVDPDILLRLEELEREEGLREEEEEDDDFEMDGKELTPEEKEALAEIRKKKSLLIQQHRIKKSTAESRPSVPRKFDKDKKFTTKRMGRQLSSLGLDPSMAIDRARSKSRGRKRERSVDRGDKDNGDAMDMDMDQPNKKLRLRSMSRPRSRSRSRPPSEVAPGEGFKDSAQKVKAIKLGKKSVKKRNKDARRGEADRVIPTLKPKHLFSGKRSIGKTDRR

SEQ ID NO: 4467 - protein, 677 aa, Aristolochia fimbriata
MVQYNFKKITVVPSGKDFIDIILSRTQRQTPTVVHKGYSISRLRQFYMRKVKYTQQNFHEKLSLIIDEFPRLDDIHPFYGDLLHVLYNKDHYKLALGQINTAKNIIGKIAKDYVRLLKYGDSLYRCKCLKVAALGRMCTVVKRIGPSLAYLEQIRQHMARLPSIDPNTRTVLICGYPNVGKSSFINKITRADVDVQPYAFTTKSLFVGHTDYKYLRYQVIDTPGILDRPFEDRNIIEMCSITALAHLRAAVLFFLDVSGSCGYSIAQQAALFHSIKSLFMNKPLIIVCNKIDLQPLDSLSEEDLKLVSEMKAEAAKTLIGQGGEVDEAGVLLSMSTLTDEGVIAVKNAACERLLNQRVDIKMKSKKINDCLNRFHVAIPKPRDGKERPLCIPQAVLDAREKKIEKEKRKLERDLEEENGGAGVYSASLRKHYILADDGWKEDIMPEILDGHNVYDFVDPDILQRLEELEREEGLRQVEENEDEDFEMDGKLLTPEELEALAEIRKKKSLLIQEHRIKKSTAESRPIIPRKFDKDRKFTHARMGRQLSSLGLDPTAAINRARSRSVSRGRKRERSPVRNDAADAMDIDSERSNKKKKMRSSSLSMARSRSRSRPPGEVVPGEGFKDSAQKIKAVKLGKESVMKRNKDARKGEADRVIPNLKPKHLFSGKRSIGKTSRR

SEQ ID NO: 4468 - protein, 680 aa, Manihot esculenta
MVQYNFKKITVVPSGKDFIDIILSRTQRQTPTVVHKGYAISRLRQFYMRKVKYTQQNFSEKLSTIIEEFPRLDDIHPFYGDLLHVLYNKDHYKLALGQVNTAKNLISRISKDYVKLLKYGDSLYRCKSLKVAALGRMCTVIKRIGPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLEGISEEDMKLIMEMKAEALKTVIGQGGEPTNDEGVLLTMSTLTEEGVIAVKNAACERLLDQRVELKMKSKKINDCLNRFHVAIPKPRDQKERPPCIPQAVLEAKAKQAAQAAEKEKRKTEKDLEDENGGAGVYSASLRKNYILANEEWKEDILPEILDGHNVYDFIDPDILQRLEELETEEGIRQAEEENEDFSMDGEELTPEEQAALAEIRRKKSLLIQEHRMKKSTAESRSIVPRKFDKDRKFTTERMGRQLSALGLDPSHAINRARSRSLSRRGRKRERSLDRGDNDAGDAMDMDVDQQNKKLRMRSRSRSRSKSRPPSEVVPGEGFKDSTQKVKALKLAKKSVKKRNKDARRGEADRVIPSLKPKHLFSGKRSIGKTQRR

SEQ ID NO: 4469 - protein, 680 aa, Manihot esculenta
MVQYNFKKITVVPSGKDFIDIILSRTQRQTPTVVHKGYAISRLRQFYMRKVKYTQQNFEEKLSTIIEEFPRLDDIHPFYSDLLHVLYNKDHYKLALGQVNTAKNLISKIAKDYVKLLKYGDSLYRCKSLKVAALGRMCTVIKRIGPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLIIVCNKTDLQPLEGISEEDKKLVMEMKAEAMKTVIGQGGEPTNDEGVLLTMSTLTEEGVIAVKNAACERLLDQRVELKMKSKKINDCLNRFHVAMPKPRDQKERPPCIPQAVLEAKAKQAAQAAEKEKRKTEKDLEDENGGAGVYSASLKKNYILANDEWKEDVLPEILDGHNVYDFIDPDILQRLEELEQEEGIRQAEEENEDFEMDGEELTPEEQAALAEIRKKKSLLIQEHRMKKSTAESRPTVPRKFDKDRKFTTGRMGRQLSALGLDPSQAINRVRGRSLSRRGRKRERSVDKGENDAGDAMDMDVDQQNKKLRMKSRSRSRSKSRPPSEVAPGEGFKDSAQKVKALKIAKKSVKKRNKDARRGEADRVIPTLKPKHLFSGKRSIGKTQRR

SEQ ID NO: 4470 - protein, 680 aa, Solanum lycopersicum
MVQYNFKKITVVPNGKDFVDIILSRTQRQTPTVVHKGYAISRIRQFYMRKVKYTQQNFYDKLSTIIDEFPRLDDIHPFYGDLLHVLYNKDHYKLALGQINTARNLISKVAKDYVKLLKYGDSLYRCKFLKVAALGRMCTVIKRIGPSLAYLEQIRQHMARLPSIDPNTRTILICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLMIVCNKTDLQPLDGISEEDKKLVTEMKDEAMKTVIGQGGEATDEAGVLLTMSTLTEDGVISVKNAACERLLNQRVELKMKSKKLNDCLNRFHVAMPKPRDQKERPPCIPEAVLEARAKQAEADAEKQKKKLERDLENENGGAGVYSASLRKHYLLANEEWKEDIMPEILDGHNVYDFVDPDILQRLEELEREEGLRQEEEGDDDFEMDGAELTPEEKAALAEIRKKKSLLIQQHRMKKSTAESRPTVPRKFDKDKEFTSKRMGRQLSALGLDPTLAINRARSKSRGRKRERSVECGDDIGNDAMDVDEITPSKKQRRSRSLSMSRSRSMSRPRSEFVPGEGFKDKPQKEKAIKMFKNSANKRNKDARRGESDRVIPTLKPKHLFSGKRSSGKTDRR

SEQ ID NO: 4471 - protein, 650 aa, Populus trichocarpa
MVQYNFKKITVVPKGKDFIDIILSRTQRQTPTVVHKGYAISRLRQFYMRKVKYTQSNFHEKLSTIIDEFPRLDGIHPFYGDLLHVLYNKDHYKLALGQINTARNLISKIAKDYVKLLKYGDSLYRCKSLKVAALGRMCTVIKRIGPSLAYLEQIRQHMARLPSIDPNTRTVLICGYPNVGKSSFINKITRADVDVQPYAFTTKSLFVGHTDYKYLRYQVIDTPGILDRPFEDRNIIEMCSITALAHLRAAVLFFLDVSGSCGYSIAQQAALFHSIKSLFMNKPLTIVCNKTDLQPLDGISEEDMKLVMEMKSEAMKTLVAQGGEATNDADVLLTMSTLTEDGVIAVKNAACERLLNQRVELKMKSKKINDCLNRFHVAMPKPRDQRERPPCIPQAVLEAKAKEAAEKEKRKTEKDLEDENGGAGVYSASLKKNYILANDEWKEDVLPEILDGHNVYDFIDPDILQRLEELESEEGIRQAEEGDEDFELDGEELTPEEKEALSEIRKKKSLLIQEHRMKKSTAESRPTVPRKFDKDRKFTTKRMGRQLSAMGVDPSKAITRLRERSLSRKGRKRERSTSRSRSRSRPPGEVVPGEGFKDSVQKNKALKLFKNSAKKRNKDARRGEADRVIPTLKPKHLFSGKRSIGKTERR

SEQ ID NO: 4472 - protein, 672 aa, Euonymus alatus
MVQYNFKKITVVPNGKDFIDIILSRTQRQTPTVVHKGYAISRLRQFYMRKVKYTQTNFHEKLSTIIDEFPRLDDIHPFYGDLLHVLYNKDHYKLALGQVNTARNLISKIAKDYVRMLKYGDSLYRCKCLKVAALGRMCTVIKRIGPSLAYLEQIRQHMARLPSIDPNTRTILICGYPNVGKSSFINMITRADVDVQPYAFTTKSLFVGHTDYKYLRYQVIDTPGILDRPFEDRNIIEMCSITALAHLRAAVLFFLDISGSCGYSIAQQAALFDSIKSLFMNKPLIIVCNKTDLQPLEGISEEDMKLVMEMKAEAMKTLVGQGGESTDGEGVLLTMSTLTEEGVMSVKNAACERLLNQRVELKMKSKKMNDCLNRFHVAIPKPRDQKERPPCIPQAVLEAKAKQAAEKEKRKTERDLEDENGGAGVYAANLRKNYILADDEWKEDILPEILDGHNVYDFVDPDILQRLEELEQEEGIRQAEDDDDDFEIDGKELTPEEQAALAEIRKKKSLLIQQHRIRKSTAESRPTVPRKFDKDRKYTSERMGRQLSALGLDPSRAISRSRSRGRKRERSLGGEGNNGVDAMDVDQPNKKLRTRSRSMSVSRSTSRPPGEVVPGEGFKDSAQKLKAIKIAKKSVRKRNKEARRGEADRVIPTLKPKHLFSGKRSSGKTDRR

SEQ ID NO: 4473 - protein, 675 aa, Vinca minor
MVQYNFKKITVVPSGKDFVDIILSRTQRQTPTVVHKGYAISRIRQFYMRKVKYTQTNYHDKLSTIVDEFPRLDDIHPFYGDLLHVLYNKDHYKLALGQINTARNLISKIAKDYVKLLKYGDSLYRCKALKVAALGRMCTVIKRIGPSLAYLEQIRQHMARLPSIDPNTRTLLICGYPNVGKSSFINKITRADVDVQPYAFTTKSLFVGHTDYKYLRYQVIDTPGILDRPFEDRNIIEMCSITALAHLRAAVLFFLDISGSCGYSIAQQAALFHSIKSLFMNKPLVIVCNKTDLQPLEGISEEDMKLVMEMKAEAMKTVIGQGGEATDEEGVLLTMSTLTEEGVISVKNAACERLLNQRVELKMKSKKLNDCLNRFHVALPKPRDQKERPACIPQAVLEVIAKKAKQAAEKEKRKLEKDLEDENGGAGVYSASLRKHYILANEEWKEDIMPEILDGHNVYDFVDPDILQRLEELEREEGLRQEQEGDDDFEMDGTDLTPEEQEALAQIRKKKSLLIQQHRMKKSTAESRSIVPRKFDKDREFTSGRMGRQLQGLGLDPTLAMNRARSKSRGRKRERSPERGENAGGDAMDVDNDQPSKKLRLRSRSMSRHPHEVVPGEGFKDSVQKVKALKLAKSSVKKRNKNARRGEADRVIPTLKPSTYSLANDPTENPEALRR

SEQ ID NO: 4474 - protein, 295 aa, Pseudoroegneria spicata
MSMAATAAAASSSVLTPRTRHHATPSSRALRSGFLGRALTLAAATDRPSRGAVSVSVRAAWDGPLSSARLIMQGRNVKLTEKLKEHIEDKVGRAVSNHAHLVREVDVRLSARGGDLSKGPKLSRCEVTLFTKRHGVVRAEEEEESSYASIDAAAAVVKRKLRKIKEKETDVRHLKGTKEWQAADADGIGFSDVEEESELEEDDELVEVIGAEDEETVLTKVVRTKVFEMAPLTVDEALEQLENVDHDFYAFRNEQTGEVNILYKRKEGGFGLIIPKLDGHVDKATVNAKEHPVTG

SEQ ID NO: 4475 - protein, 301 aa, Triticum aestivum
MSMAATAATATAWPSTSSSVLAPRTRHHATRSPRALRSGFLGRALTLAAPTDRPSPVSVSVRAAWDGPLSSARLIMQGRNVKLTEKLKEHIEDKVGRAVHNHAHLVREVDVRLSARGGDLSKGPKLSRCEVTLFTRRHGVVRAEEEEESSYASIDAAAAVVKRKLRKIKEKETDVRHLKGTKEWQASGLSDVEDESEAEELEDDDDDELVEVIGAEDEETVLTKVVRTKVFEMAPLTVDEALEQLENVDHDFYAFRNEQTGEVNILYKRKEGGFGLIIPKQDGHVDKATVNAKEKEHPVAG

SEQ ID NO: 4476 - protein, 301 aa, Triticum aestivum
MSMSATAATATAWPSTSSSVLAPRTRHHAAPSPRALRSGFLGRALTLAAATDRPSSAPAAVSVSVRAAWDGPLSSARLIMQGRNVKLTEKLKEHIEDKVGRAVHNHAHLVREVDVRLSARGGDLSKGPKLSRCEVTLFTRRHGVVRAEEEEESSYASIDAAAAVVKRKLRKIKEKETDVRHLKGTKEWQSSGLSGVEDESEAEEEEEEDELVEVIGAEDEETVLTKVVRTKVFEMAPLTVDEALEQLENVDHDFYAFRNEQTGEVNILYKRKEGGFGLIIPKQDGHVDKATVNAKEHPVVG

SEQ ID NO: 4477 - protein, 299 aa, Triticum aestivum
MSMAATAATATAWPSTSSSVLAPRTRHHVTPSPRALRSGFLGRALTLAAATDRPSSVSISVRAAWDGPLSSARLIMQGRNVKLTEKLKEHIEDKVGRAVHNHAHLVREVDVRLSARGGDLSKGPKLSRCEVTLFTRRHGVVRAEEEEESSYASIDAAAAVVKRKLRKIKEKETDVRHLKGTKEWQSSGLSDVEDESEAEEEEEDDELVEVIGAEDEESVLTKVVRTKVFEMAPLTVDEALEQLENVDHDFYAFRNEQTGEVNILYKRNEGGFGLIIPKQDGHVDKATVNAKEKEHPVAG

SEQ ID NO: 4478 - protein, 303 aa, Avena sativa
MSIAATAAAAAAWPSTSSSVLAPHSHHATPRTCCHLRSGFLGRALAVAPHPVAAVSASASVRAAWDGPLSSARLIMQGRNVKLTEKLKEHIEDKVGRAVVKHSHLVREVDVRLSARGGDLGRGPKASRCEITLFTRRHGVVRAEEEEESSYASIDVAAGIIKRKLRKIKEKETDVRHLMKGTKEWIDAGDALVSESDVEVDEEEEDDELVEVIGAEDEETVLTKVVRTKVFEMAPLTVDEALEQLENVDHDFYAFRNEQTGEVNILYKRKEGGFGLIVPKQDGHVDKETVAKQDNGKEQSVAG

SEQ ID NO: 4479 - protein, 210 aa, Hordeum vulgare
MASGVFGTPISEKTVIATGEYKEPITQKDVADYAMKMINAGGKDINALTFVDNLKERYGNGIAVKCLIYNATGATLSLAKYNDWHGHIYDTPYPSDIQNGQWGAFLHVHPSGAAVGSAGAVVYRTKIPSSSRSCDWLFSWTAPYIGDNGVYTEIREEGHYPSVGSWGYIYGVKLANSNLNSTDENYGYVSKTNIGEGSTMNARGVFQYPY

SEQ ID NO: 4480 - protein, 210 aa, Triticum aestivum
MASGVFGTPISEKTVLATGEYKEPITQKDVADYTMKMINAGGKDINAQTFVDNLKERYGNGISVKCLIYNATGATLNLANYKDWHGHIYDTPYPSDIQNGQWGAFLHVHPSGAAVGSAGAVVYRTKVPSSSSSCDWLFSWTAPYIGANGIYTEIREEGHYPSVGSWDYIYDVKLENANLNSTDKNYGYVSKTNIGEGSTMNARGVFQFPY

SEQ ID NO: 4481 - protein, 208 aa, Pseudoroegneria spicata
MASGVFGTPISEQTVIATGEYPEPISQKDVADYAMKMINAGGKDVNAQQFVDNLKDRYGNGISVKCLIYNATGTTLNFSTYKNWHGHIYDTPYPSDIQNGQWGAFLHVHPSGAAVGSAGAAVYRTKVPSSSSSCDWLFSWTIPYIGDNGVHTEIREEGHFPKHWDYIYNVKLAKSNLSSTDKGYGYVSKLDIAEGTTVNARAVFQLPY

SEQ ID NO: 4482 - protein, 102 aa, Secale cereale
TRPLINISDAKAQLLLLEIFSGSQIWRMSCNCGSGCSCGSDCKCGKMYPDLTEQGSAAAQVAAVVVLGLAPENKAGQFEVAAGQSGEGCSCGDNCKCNPCNC

SEQ ID NO: 4483 - protein, 100 aa, Triticum aestivum
VLIIIPDTKAHLLLLEIFLGSQIWRMSCNCGSGCSCGSDCKCGKMYPDLTEQGSAAAQVAAVVVLGVAPENKAGQFEVAAGQSGEGCSCGDNCKCNPCNC

SEQ ID NO: 4484 - protein, 96 aa, Triticum aestivum
SSTPKLIFFSLKSFWVHQIWRMSCNCGSGCSCGSDCKCGKMYPDLTEQGSAAAQVAAVVVLGVAPENKAGQFEVAAGQSGEGCSCGDNCKCNPCNC

SEQ ID NO: 4485 - protein, 75 aa, Unknown
  Sequence found in Organisms: Setaria italica, Pseudoroegneria spicata, Triticum aestivum
MSCNCGSGCSCGSDCKCGKMYPDLTEQGSAAAQVAAVVVLGVAPENKAGQFEVAAGQSGEGCSCGDNCKCNPCNC

SEQ ID NO: 4486 - protein, 75 aa, Avena sativa
MSCNCGSGCSCGSDCKCGKMYPDLTEQGSATSQVAAVVVLGVAPENKAGQFEVAAGQSGEGCSCGDNCKCNPCNC

SEQ ID NO: 4487 - protein, 75 aa, Leymus cinereus x Leymus triticoides
  misc_feature (49)..(49): Xaa can be any naturally occurring amino acid
MSCNCGSGCSCGSDCKCGKMYPDLTEQGSAAAQVAAVVVLGVAPENKAXQFEVAAGQSGEGCSCGDNCKCNPCNC

SEQ ID NO: 4488 - protein, 75 aa, Triticum aestivum
MSCNCGSGCSCGSDCKCGKVYPDLTEQGSAAAQVAAVVVLGVAPENKAGQFEVAAGQSGEGCSCGDNCKCNPCNC

SEQ ID NO: 4489 - protein, 103 aa, Triticum aestivum
IRHEGIIIPDTKAHLLLLEIFLGPQIWRMSCNCGSGCSCGSDCKCGKMYPDLTEQGSAAAEVAAVVVLGVAPENKAGQFEVAAGQSGEGCSCGDNCKCNPCNC

SEQ ID NO: 4490 - protein, 101 aa, Triticum aestivum
  misc_feature (96)..(96): Xaa can be any naturally occurring amino acid
IFLGSQIWRMSCNCGSGCSCGSDCKCGKMYPDLTEQGSAAAQVAAVVVLGVAPENKAGQFEVAAGQSGEGCSCGDNCKCNPATVNCMHPTYVCWVXRVYVE

SEQ ID NO: 4491 - protein, 75 aa, Triticum aestivum
MSCNCGSGCSCGSDCKCGKMYPDLTEQGSAAAEVAAVVVLGVAPENKAGQFEVAAGQSGEGCSCGDNCKCNPCNC

SEQ ID NO: 4492 - protein, 75 aa, Triticum aestivum
MSCNCGSGCSCGSNCKCGKMYPDLTEQGSAAAEVAAVVVLGVAPENNAGQFKVAAGQSGEGCSCGDNCKCNPCNC

SEQ ID NO: 4493 - protein, 75 aa, Triticum aestivum
MSCNCGSGCSCGSDCKCGKMYPDLTEQGSAAAEVAAVVVLGVAPENKAGHSRWPPGIPAKAATAATTANATPATV

SEQ ID NO: 4494 - protein, 96 aa, Triticum aestivum
  misc_feature (71)..(71): Xaa can be any naturally occurring amino acid
IPDTKAHLLLLEIFLGPQIWRMSCNCGSGCSCGSDCKCGKMYPDLTEQGSAAAEVAAVVVLGVAPENKAGXFEVAAGQSGEGCNCRDNCKCKPCNC

SEQ ID NO: 4495 - protein, 92 aa, Triticum aestivum
  misc_feature (20)..(20): Xaa can be any naturally occurring amino acid
  misc_feature (31)..(31): Xaa can be any naturally occurring amino acid
  misc_feature (64)..(64): Xaa can be any naturally occurring amino acid
  misc_feature (69)..(69): Xaa can be any naturally occurring amino acid
  misc_feature (77)..(77): Xaa can be any naturally occurring amino acid
KAILLLLEIFWGSQIWRDVXQLWIRLQLRLXLQVREDVPDLTEQGSAAAQVAAVVVLGVAPENXAGQFXVAAGQSGXGCSCGDNCKCNPCNC

SEQ ID NO: 4496 - protein, 101 aa, Triticum aestivum
  misc_feature (23)..(23): Xaa can be any naturally occurring amino acid
  misc_feature (34)..(34): Xaa can be any naturally occurring amino acid
  misc_feature (36)..(36): Xaa can be any naturally occurring amino acid
  misc_feature (53)..(53): Xaa can be any naturally occurring amino acid
  misc_feature (83)..(83): Xaa can be any naturally occurring amino acid
LVPNSARDNKAHLLLLEIFLGPXIWRMSCNCGSXCXCGSNCKCGKMYPDLTEXGSAAAEVAAVVVLGVAPENKAGQFEVAAGXSGEGCSCGDNCKCNPCNC

SEQ ID NO: 4497 - protein, 79 aa, Triticum aestivum
MSCNCGSGCSCGSDCKCGKMYPDLTEQGSAAAQVAAVVVLGVAPENKAGQFEVAAGQSGEGCSCGDNCKCNPATVKLHA

SEQ ID NO: 4498 - protein, 75 aa, Pseudoroegneria spicata
  misc_feature (4)..(4): Xaa can be any naturally occurring amino acid
MSCXCGSGCSCGSDCKCGMMYPDLAEQGSTTAQVAAVVVLGVAPENKAGQFEMTADESGEGCSCGANCNCNPCNC

SEQ ID NO: 4499 - protein, 75 aa, Festuca arundinacea
MSCSCGSSCNCGSNCKCGKMYPDLDEQASITTQTQAVVVLGVAPGNKAGQFEMAAGESGEGCSCGANCKCNPCNC

SEQ ID NO: 4500 - protein, 97 aa, Festuca arundinacea
FSDPKSFLLLLNLILHHLDIWKMSCSCGSSCNCGSNCKCGKMYPDLDEQVSITTQTQAVVVLGVAPGNKAGQFETAAGESGEGCSCGANCKCNPCNC

SEQ ID NO: 4501 - protein, 99 aa, Triticum aestivum
  misc_feature (69)..(69): Xaa can be any naturally occurring amino acid
SSSSSTPKLIFFSLKSFWVHQIWRMSCNCGSGCSCGSDCKCGKVYPDLTEHGSAAAHVDAVDDLGVAPXNMACQFQVDAGQYGEGCSCRDNCKCNPCNC

SEQ ID NO: 4502 - protein, 262 aa, Triticum aestivum
MSVQCTANSLRALAALPAPSPSRRLARNEFLMPCRPSRTGALVRAADSSPPAAPASSSGAADDKAVIPDDEFTLAKVSFGVIGLGIGGSLLSYGFGAYFNLLPGSEWSALMLTYGFPLTIIGMALKYAELKPVPCITYSDAFALREKCATPILKQVRSDVTRYRYGDEQHLDEALKRIFQYGLGGGIPRRSAPILQKIQEVTDDGKYCLVLEFEAKSLELSDFEKRQAKFTSFFGPGIKAEIGKGGDDLYEVRLISETTEEE

SEQ ID NO: 4503 - protein, 316 aa, Triticum aestivum
SPSFPCPRAETPATISFSSFCSTEIPGEQTLTSKDKSSRLIYTLVAVPRRAARDMSVQCTANSLRALAALPAPSPSRRLARNEFLMPCRPSRTGALVRAADSSPPAAPASSSGAADDKAVIPDDEFTLAKVSFGVIGLGIGGSLLSYGFGAYFNLLPGSEWSALMLTYGFPLTIIGMALKYAELKPVPCITYSDAFALREKCATPILKQVRSDVTRYRYGDEQHLDEALKRIFQYGLGGGIPRRSAPILQKIQEVTDDGKYCLVLEFEAKSLELSDFEKRQAKFTSFFGPGIKAEIGKGGDDLYEVRLISETTEEE

SEQ ID NO: 4504 - protein, 262 aa, Leymus cinereus x Leymus triticoides
  misc_feature (6)..(6): Xaa can be any naturally occurring amino acid
  misc_feature (34)..(34): Xaa can be any naturally occurring amino acid
  misc_feature (36)..(36): Xaa can be any naturally occurring amino acid
  misc_feature (40)..(40): Xaa can be any naturally occurring amino acid
  misc_feature (67)..(67): Xaa can be any naturally occurring amino acid
MSVQCXANSLRALAALPAPSSSRRLARNAFLMPXRXSRTXALVRAADSSPPAAPASSSGAADDKAVXPDDEFTLAKVSFGVIGLGIGGSLLSYGFGAYFNLLPGSEWSALMLTYGFPLTIIGMALKYAELKPVPCITYSDAFALREKCATPILKQVRSDVTRYRYGDEQHLDEALKRIFQYGLGGGIPRRSAPILQKIQEVTDDGKYCLVLEFEAKSLELSDFEKRQAKFTSFFGPGIKAKIGKGGDYLYEVRLISETTEEE

SEQ ID NO: 4505 - protein, 262 aa, Pseudoroegneria spicata
  misc_feature (143)..(143): Xaa can be any naturally occurring amino acid
  misc_feature (160)..(160): Xaa can be any naturally occurring amino acid
MSVQCTANSLRALAALPAPSSSRRLARNAFLMPCRPSRTGALVRAADSSPPAAPASSSGAADDKAVIPDDEFTLAKVSFGVIGLGIGGSLLSYGFGAYFNLLPGSEWSALMLTYGFPLTIIGMALKYAELKPVPCITYSDAFXLREKCATPILKQVRSDXTRYRYGDEQHLDEALKRIFQYGLGGGIPRRSAPILQKIHEVTNDGKYCLVLEFEAKSLELSDFEKRQAKFTSFFGPGIKAEIGKSGDDLYEVRLISETTEEE

SEQ ID NO: 4506 - protein, 264 aa, Brachypodium distachyon
MSMQSAAHAVRALAALPAPSSSSRRRAGHAPSLLPCRPSRAVAPVRAADSSPPAAPASPSPSGAAGGKAVVPDDEFTLAKVSFGVIGLGIGGSLLSYGFGAYFNILPGSEWSALMLTYGFPLTIIGMALKYAELKPVPCITYSDAFALRDKCATPILKQVRNDVTRYRYGDEQHLDEALKRIFQYGLGGGIPRRSAPILQKIQEEVTEEGKYCLVLEFEAKALELSDFEKRQAKFTSFFGPGIKAEIGKGGDDLYEVRLISETT

SEQ ID NO: 4507 - protein, 320 aa, Triticum aestivum
LPVSPVHEPKPQPPSRSHLSVPLKFPGNKHSLPKDKSLGLIYTLVAVPRRAARDMSVQCTANLLRALAALPAPFPSRRLARNEFLVPCRPSRTGALVRAADSSPPAAPASSSGAADDKAVIPDDEFTLAKVSFGVIGLGIGGSLLSYGFGAYFNLLPGSEWSALMLTYGFPLTIIGMALKYAELKPVPCITYSDAFALREKCATPILKQVRSDVTRYRYGDEQHLDEALKRIFQYGLGGGIPRRSAPILQKIQEVTDDGKYCLVLEFEAKSLELSDFEKRQASTALLKKMDNVWTEDVETFGLVLRSFHSFPSSPLSHSL

SEQ ID NO: 4508 - protein, 262 aa, Avena sativa
MSVQCSAHAVRALAAFQAPLSPRRRVSHAPSIVPCRPGREVTPVRAADSSPPAAPASSSGAAGDKALVPDDDGFTLAKVSFGVIGLGVGGSLLTYGFGAYFNLLPGSEWSALMLTYGFPLTIIGMALKYAELKPVPCITYADAFALREQCATPILKQVRSDVTRYRYGDEQHLDEALKRIFQYGLGGGIPRRSAPILQKIREEVTDEGKYCLVLEFEAKSLELSDFEKRQAKFTSFFGPGIKAEIGKGGDDLYEVRLISETT

SEQ ID NO: 4509 - protein, 265 aa, Festuca arundinacea
MSVQCAAHAVRALAAFQAAPSSRRRVSHASVVPCRPRRAVAPVRAADSSPPAAPAPSSSSSSGVASDKAIVPDDDGFTLAKVSFGVIGLGVGGSLLSYGFGAYFNLLPGSEWSALMLTYGFPLTIIGMALKYAELKPVPCITYADAFALREQCATPILKQVRSDVTRYRYGDEQHLDEALKRIFQYGLGGGIPRRSAPILQKIQEEVTDDGKYCLVLEFEAKSLELSDFEKRQAKFTSFFGPGIKAEIGQGGDDLYQVRLISETT

SEQ ID NO: 4510 - protein, 324 aa, Hordeum vulgare
MSSRMAGATLLRHLGPRLFAAAEPASGLAASARGVMPAATRIFPARMASTAAAPHAKQEEATEKPQGATTPEQAVSYWGIEPRKLVKDDGTEWPWFCFRPWDTYRPDTSIDVAKHHEPRALPDKVAYLIVRTLRAGSDLFFQRRHASHALLLETVAAVPPMVGGVLLHLRSLRRFEHSGGWIRALMEEAENERMHLMTFMEVTQPLWWERALVLATQGVFFNAYFVGYLVSPKFAHRFVGYLEEEAVHSYTEYLKDLEAGLIENTPAPAIAIDYWRLPADARLKDVVTAVRADEAHHRDANHYASDIHYQGMTLNQTPAPLGYH

SEQ ID NO: 4511 - protein, 329 aa, Triticum aestivum
MSSRMAGATLLRHLGPRLFAAAEPASGLAASARGIMPAAARIFPARMASTEAAGPRAKQEEATEKPQGATTPEQNKKAVVSYWGIEPRKLVKDDGTEWPWFSFRPWDTYRPDTSIDVAKHHEPRAVADKVAYLIVRTLRKGSDLFFQRRHASHALLLETVAAVPPMVGGVLLHLRSLRRFEHSGGWIRALMEEAENERMHLMTFMEVTQPLWWERALVLATQGVFFNAYFVGYLVSPKFAHRFVGYLEEEAVHSYTEYLKDLEAGLIENTPAPAIAIDYWRLPADARLKDVVTAVRADEAHHRDANHYASDIHYQGMTLNQTPAPLGYH

SEQ ID NO: 4512 - protein, 329 aa, Triticum aestivum
  misc_feature (235)..(235): Xaa can be any naturally occurring amino acid
MSSRMAGATLLRHLGPRLFAAAEPASGLAASARGIMPAAARIFPARMASTEAAGPRAKQEEATEKPQGATTPEQNKKAVVSYWGIEPRKLVKDDGTEWPWFSFRPWDTYRPDTSIDVAKHHEPRAVADKVAYLIVRTLRKGSDLFFQRRHASHALLLETVAAVPPMVGGVLLHLRSLRRFEHSGGWIRALMEEAENERMHLMTFMEVTQPLWWERALVLATQGVFFNAYFVGYLXSPKFAHRFVGYLEEEAVHSYTEYLKDLEAGLIENTPAPAIAIDYWRLPADARLKDVVTAVRADEAHHRDANHYASDIHYQGMTLNQTPAPLGYH

SEQ ID NO: 4513 - protein, 330 aa, Triticum aestivum
MSSRMAGATLLRHLGPRLFAAAEPASGLAASARGIMPAAARIFPARMASTEAAAPHAKQEDDAASPQAAATPEQQNKKPVVSYWGIEPRKLVKDDGTEWPWFCFRPWDTYRPDTSIEVAKHHEPKALADKVAYFVVRSLRVPRDLFFQRRHASHALLLETVAAVPPMVGGVLLHLRSLRRFEHSGGWIRALMEEAENERMHLMTFMEVTQPRWWERALVLAAQGVFFNAYFVGYLISPKFAHRFVGYLEEEAVESYTEYLKDLEAGLIENTPAPAIAIDYWRLPADARLKDVVTAVRADEAHHRDANHYASDIHYQGMTLNQTPAPLGYH

SEQ ID NO: 4514 - protein, 330 aa, Brachypodium distachyon
MSSRMAGATLLRHLGPRLFAAAEPASGLAARSIMAPAAARILPARMASTASAAPDAKEGASAAAKTDSAATPEQSKTKSVVSYWGIESRKLVKPDGTEWPWFCFTPWDTYRADTSIDMEKHHKPKSVPDKVAYYAVRSLRVPMDLFFQRRHASHALLLETVAAVPPMVGGMLLHLRSLRRFEHSGGWIRALMEEAENERMHLMTFLEVTQPNWWERALVMAAQGVFVNAYFVGYLVSPKFAHRFVGYLEEEAVHSYTEYLKDLEAGKIENTPAPAIAIDYWRLPADATLKDVVTVIRADEAHHRDANHYASDIHYQGLTLKETPAPIGYH

SEQ ID NO: 4515 - protein, 567 aa, Triticum aestivum
MLGRLAARRPRLGSARAAAAYRSSAAAASSSVLPDALDRSSDAYARNAAAVGGLLSDLRSRVSQVLGGGGAGAVKRNEGRGKLLPRDRIDRLLDPGASFLELSQLAGSDVYEEALPSAGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKISGVSDHFAQDEHHGLALGRNVVKNLHLAAKETSRHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4516 - protein, 572 aa, Oryza sativa
MLRRFAARRLRPPATAGYPSSAAAAAAAYAHGGGASVLPDGLDRASDAHARNAAAVGGLLSDLRARVSQVLAGGGAEAVRRNKARGKLLPRERIDRLLDPGASFLELSQLAGSGVYEEALPSGGIITGIGPVHGRLCMFVANDPTTKGGTYYPITVKKHLRAQEIASECKLPCIYLVDSGGANLPRQAEVFPDRDNFGRIFYNQAKMSSDSIPQIALVLGSCTAGGAYIPAMADESVIVKGNGTIFLAGPPLVKAATGEEISAEDLGGASVHCKISGVSDHFAQDELHGLTLGRNIVKNLHLAAKVPNVQNSACDYQEPLYDVQELRSIAPADMKQSFDIRQVIARIVDGSEFDEFKKLYGTTLVTGFARICGQPVGIIGNNGILFTESALKGSHFIELCAQRNIPLIFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDEEEAFKAKVVEAYDKEGSPYYSTARLWDDGIIDPADTRRVLSLCLSAAAKPVPEDTKYGVFRM

SEQ ID NO: 4517 - protein, 581 aa, Brachypodium distachyon
MLGRFVSRRLRPSSNTAPAVTAAAYHSSAAVRAHGGGSSSSSSSSVLPDSLDRSSDAYARNAAAVGGLLSELRSRVSQVLGGGGAEAVRRNTARGKLLPRERIDRLLDPGGSFLELSQLAGSDVYEEALPSGGIITGIGPVHGRLCMFVANDPTTKGGTYYPITVKKHLRAQEIAAECKLPCIYLVDSGGANLPKQAEVFPDRDNFGRIFYNQAKMSADGIPQIALVLGSCTAGGAYIPAMADESIIVKGNGTIFLAGPPLVKAATGEEISAEDLGGASVHCKISGVSDHFAQDELHGIALGRNIVKNLHLAAKVTNVQNSACDYEEPLYDVQELRSIAPADMKQSFDIRSVIALIVDGSEFDEFKKLYGTTLVTGFARICGQPVGIIGNNGILFTESALKGAHFIELCAQRNIPLVFLQNITGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDEEEAFRAKVVEAYDKEGSPYYSTARLWDDGIIDPADTRRVLSLCLSASAKPVPEDTKYGVFRM

SEQ ID NO: 4518 - protein, 246 aa, Panicum virgatum
MLARLAAGRRHLHLHPRAAPAYSSSAAAAARGGASVLPDTLDRGSDAYARNAAAVAALLADLRARVSQVLRGGGPEAVRRNASRGKLLPRDRIDRLLDPGASFLELSQLAGSDVYEEALPSAGIITGIGPVHGRLCMFVANDPTTKGGTYYPLTVKKHLRAQEIASECKLPCIYLVDSGGANLPRQAEVFPDRDNFGRIFYNQAKMSSNGIPQIALVLGSCTAGGAYIPAMADESVIVKGNGTIFF

SEQ ID NO: 4519 - protein, 544 aa, Pennisetum glaucum
GAAPASASVLPDTLDRGSDAYARNAAAVGGLLADLRARVSQVLRGGGPEAVKRNAARGKLLPRDRIDRLLDPGASFLELSQLAGSDVYEEALPSAGIITGIGPVHGRLCMFVANDPTTKGGTYYPLTVKKHLRAQEIASECKLPCIYLVDSGGANLPRQAEVFPDRDNFGRIFYNQAKMSADGIPQIALVLGSCTAGGAYIPAMADESVIVKGNGTIFLAGPPLVKAATGEEISAEDLGGASVHCKVSGVSDHFAQDELHGLALGRNIVKNLHLAAKGTHIQSSACDYQEPLYDIEELRSIAPSDLKQSFDIRSVIARIVDGSEFDEFKKLYGTTLVTGFARICGQPVGIIGNNGILFTESALKGSHFIELCTQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKKRQGVEWTKDEEEAFKAKVAEAYDREASPYYATARLWDDGVIDPADTRRVLSLCLSAAAKPVLEDTKYGVFRM

SEQ ID NO: 4520 - protein, 543 aa, Setaria italica
AAPASASVLPDTLDRGSDAYARNTAAVGGLLADLRARISQVMRGGGAEAVKRNAARGKLLPRDRIDRLLDPGASFLELSQLAGSDVYEEALPSAGIITGIGPVHGRLCMFVANDPTTKGGTYYPLTVKKHLRAQEIASECKLPCIYLVDSGGANLPRQAEVFPDRDNFGRIFYNQAKMSSDGIPQIALVLGSCTAGGAYIPAMADESVIVKGNGTIFLAGPPLVKAATGEEISAEDLGGASVHCKVSGVSDHFAQDELHGLALGRNIVKNLHLAAKGTNIQSSACDYQEPLYDIEELRSIAPSDLKQSFDIRSVIARIVDGSEFDEFKKLYGTTLVTGFARICGQPVGIIGNNGILFTESALKGSHFIELCTQRHIPLIFLQNITGFMVGSKSEASGIAKAGAKMVMAVSCAKVPKITIIVGGSFGAGNYGMCGRAYSPNFLFLWPTARISVMGGIQAAGVLSQIEKNNKKRQGVEWTKDEEEAFKAKVAEAYDREASPYYATARLWDDGIIDPADTRRVLSLCLSAAAKPVPEDTKYGVFRM

SEQ ID NO: 4521 - protein, 548 aa, Saccharum officinarum
VHGVAPAPASASVLPDTLDRGSDAYKRNAAAVGGLLTDLRARVSQVLRGGGAEAVRRNAARRKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIALVLGSCTAGGAYIPAMADESVIVKGNGTIFLAGPPLVKAATGEEISAEDLGGASVHCKVSGVSDHFAQDELHGLELGRNIVKNLHLAAKGTNIQSSTCGYQEPLYDVEELRSIAPADLKQSFDIRSVIARIVDGSEFDEFKKLYETTIVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKKRQGVEWSKDEEEAFKAKVVEAYDREGSPYYSTARLWDDGVIDPADTRRVLSLCLSASAKPVPEDTKYGVFRM

SEQ ID NO: 4522 - protein, 585 aa, Sorghum bicolor
MLSRLAAARRQQLLLPARGAPAVAFAYRSSSTAAAAVHGAAAPAPASASVLPDTLDRGSDAYQRNAAAVGGLLSDLRARVSQVLRGGGVEAVRRNAARGKLLPRDRIDRLLDPGASFLELSQLAGSDVYGEALPSAGIITGIGPVHGRLCMFVANDPTTKGGTYYPLTVKKHLRAQEIASECKLPCIYLVDSGGANLPRQADVFPDRENFGRIFYNQAKMSSDGIPQIALVLGSCTAGGAYIPAMADESVIVKGNGTIFLAGPPLVKAATGEEISAEDLGGASVHCKVSGVSDHFAQDELHGLELGRNIVKNLHLAAKGTNIQSSACGYQEPLYDVEELRSIAPADLKQSFDIRSVIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKKRQGVEWSKDEEEAFKAKVVEAYDREGSPYYSTARLWDDGVIDPADTRRVLSLCLSASAKPVPEDTKYGVFRM

SEQ ID NO: 4523 - protein, 578 aa, Zea mays
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQDEIHGLELGRNIVKNLHLAAKGTNIQSSACGYQEPLYDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKRRQGVEWSKDEEEAFKAKVVEAYDREGSPYYSTARLWDDGVIDPADTRRVLSLCLSASAKPVPEDTRYGVFRM

SEQ ID NO: 4524 - protein, 480 aa, Triticum aestivum
RIDRLLDPGASFLELSQLAGSDVYEEALPSGGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4525 - protein, 466 aa, Triticum aestivum
LSQLAGSDVYEEALPSAGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKISGVSDHFAQDEHHGLALGRNVVKNLHLAAKETSRHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4526 - protein, 435 aa, Triticum aestivum
MFVANDPTTKGGTYYPITVKKRLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4527 - protein, 535 aa, Triticum aestivum
MAPAAAAAPAPAATACSSSASSARPPSTASSSSQSPPRRTVPALLLFTSLAALLILSSGEAHDADADAASGRPLKDVSLENPEVTFAPSSMGGIFCERIRISGMPRWQFQSYANQIHVRMNVSHSMPEKFHWKIQICFHGNASTGLCQCEMGEWQVLQGGMWNAVKSPYVSRYVDVKLTDKKSTVFSLSIQEELQKWRLACLGIGFVLLFLSPIVSKWAPFYYSSSMALGILLVVLIVLFQGMKLLPMGKKGLFYLTIYGSVLGVGSYAAHYFSSMVASILENFGLSEEMHNPVSIFLLVAVVLTGAGFGYWMVRRFIISKDGSVDAGIAQFVKWAMRVVSMFFVMQSTLDPILASAALAASWWICSVLTAKKVHKPTAPKRKQSNVPSHRRFTQVSPNTRQVQFSSPSSGAGTGRATTTQYGWNNLANGGLVPKAVRKRVAPNQDEDYYSTFHNIEPRKYSKREWEEFTEESTRNALMEHTATPEFAQWAADNAHRLRVERDDVSEDESIESYSSSSEEAEKGGKASRLLSRFM

SEQ ID NO: 4528 - protein, 309 aa, Triticum aestivum
  misc_feature (115)..(115): Xaa can be any naturally occurring amino acid
  misc_feature (159)..(159): Xaa can be any naturally occurring amino acid
  misc_feature (165)..(165): Xaa can be any naturally occurring amino acid
MALGILLVVLIVLFQGMKLLPMGKKGLFYLTIYGSVLGVGSYAAHYFSSMVASILENFGLSEEMHNPVSIFLLVAVVLTGAGFGYWMVRRFIISKDGSVDAGIAQFVKWAMRVVXMFFVMQSTLDPILASAALAASWWICSVLTAKKVHKPTAPKRKQXNVPSHXRFTQVSPNTRQVQFSSPSSGAGTGRATTTQYGWNNLANGGLVPKAVRKRVAPNQDEDYYSTFHNIEPRKYSKREWEEFTEESTRNALMEHTATPEFAQWAADNAHRLRVERDDVSEDESIESYSSSSEEAEKGGKASRLLSRFM

SEQ ID NO: 4529 - protein, 293 aa, Hordeum vulgare
MDLTKMDPPTLTLLGAACCVMLSMHFTIQLVSQHLFYWKNPKEQKAILIIVLMPPLYAMTSFAGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILIIALQLIGLYPSWVSWTFTIILNLSVSMALYALVIFYHLFAKELAPHKPLAKFLCIKGIVFFSFWQGCALDVLAAVGFIQSHHFWLDVEHIQEAIQNVLIILEMVIFSVLQQYAYHVAPYSGADKAKFEKKNE

SEQ ID NO: 4530 - protein, 293 aa, Triticum aestivum
MDLTKMDPPTLTLLGAACCVMLSMHFTVQLVSQHLFYWKNPKEQKAILIIVLMPPLYAITSFAGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILIIALQLLGLYPSWVSWTFTIILNFSVSMALYALVIFYHLFAKELAPHKPLAKFLCIKGIVFFSFWQGCALDVLAGVGVIQSHHFWLDVEHIQEAIQNVLIILEMVIFSVLQQYAYHVAPYSGADKAKFEKKNE

SEQ ID NO: 4531 - protein, 293 aa, Triticum aestivum
MDLTKMDPPTLTLLGAACCVMLSMHFTVQLVSQHLFYWKNPKEQKAILIIVLMPPLYAITSFAGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILIIALQLLGLYPSWVSWTFTIILNFSVSMALYALVIFYHLFAKELAPHKPLAKFLCIKGIVFFSFWQGCALDVLAGVGVIQSHHFWLDVEHIQEAIQNVLIILEMVIFSVLQQYAYHVAPYSGADKVKFEKKNE

SEQ ID NO: 4532 - protein, 67 aa, Triticum aestivum
MDLTKMDAPTLTLLGAACCVMLSMHSQCSWITTSFLLEKCQRAEGHTHYCANASTVCHNFLCWSSGY

SEQ ID NO: 4533 - protein, 293 aa, Brachypodium distachyon
MDLTKMDPPTLTLLGAACCVMLSMHFTVQLVSQHLFYWKNPKEQKAILIIVLMPPLYAITSFVGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILMITLQLFGLYPSWVSWTFTIILNFSVSMALYALVIFYHLFAKELAPHKPLAKFLCIKGIVFFSFWQGCALDVLAAVGIIQSHHFWLDVEHIQEAIQNVLVILEMVIFSVLQQYAYHVAPYSGADRAKFEKKNE

SEQ ID NO: 4534 - protein, 293 aa, Leymus cinereus x Leymus triticoides
  misc_feature (140)..(140): Xaa can be any naturally occurring amino acid
  misc_feature (231)..(231): Xaa can be any naturally occurring amino acid
MDLTKMDPPTLTLLGAACCVMLSMHFTVQLVSQHLFYWKNPKEQKAILIIVLMPPLYAISSFVGLLDIKGSKTFFTCLESVKECYEALVIAKFLALMYGYLNISISKNIVPDEIKGRVLHHSFPVSLFLPRNVRLEHKTXKLLKYWTWQFVVVRPVCSILIITLQLLGLYPSWVSWTFTIILNFSVSMALYALVIFYHLFAKELAPHKPLAKFLCIKGIVFFSFWQGCALXVLAGVGVIQSHHFWLDVEHIQEAIQNVLIILEMVIFSVLQQYAYHVAPYSGADKAKFEKKNE

SEQ ID NO: 4535 - protein, 293 aa, Triticum aestivum
MDLTKMDAPTLTLLGAACCVMLSMHFTVQLVSQHLFYWKNAKEQKAILIIVLMPPLYAITSFVGLLDIKGSKAFFTCLESVKECYEALVIAKFLALMYSYLNISISKNIVPDEIKGRVLHHSFPVSLFLPRNVRLEHKTLKLLKYWTWQFVVVRPVCSILIIALQLLGLYPSWVSWTFTIILNFSVSMALYALVIFYHLFAKELAPHKPLAKFLCIKGIVFFSFWQGCALDILAAVGVIQSHHFWLDVEHIQEAIQNILIILEMVVFSVLQQYAYHVAPYSGADKAKFEKKNE

SEQ ID NO: 4536 - protein, 293 aa, Triticum aestivum
MDLTKMDAPTLTLLGAACCVMLSMHFTVQLVSQHLFYWKNAKEQKAILIIVLMPPLYAITSFVGLLDIKGSKAFFTCLESVKECYEALVIAKFLALMYSYLNISISKNIVPDEIKGRVLHHSFPVSLFLPRNVRLEHKTLKLLKYWTWQFVVVRPVCSILIITLQLLGLYPSWVSWTFTIILNFSVSMALYALVIFYHLFAKELAPHKPLAKFLCIKGIVFFSFWQGCALDILAAVGVIQSHHFWLDVEHIQEAIQNILIILEMVVFSVLQQYAYHVAPYSGADKAKFEKKNE

SEQ ID NO: 4537 - protein, 293 aa, Triticum aestivum
MDLTKMDAPTLTLLGAACCVMLSMHFTVQLVSQHLFYWKNAKEQKAILIIVLMPPLYAITSFVGLLDIKGSKAFFTCLESVKECYEALVIAKFLALMYSYLNISISKNIVPDEIKGRVLHHSFPVSLFLPRNVRLEHKTLKLLKYWTWQFVVVRPVCSILIITLQLLGLYPSWVSWTFTIILNFSVSMALYALVIFYHLFAKELAPHKPLAKFLCIKGIVFFSFWQGCALDVLAAVGVIQSHHFWLDVEHIQEAIQNILIILEMVIFSVLQQYAYHVAPYSGADKAKSVKKNE

SEQ ID NO: 4538 - protein, 293 aa, Hordeum vulgare
MDLTKMDPPTLTLLGAACCVMLSMHFTVQLVSQHLFYWKNPKEQKAILIIVLMAPLYAITSFVGLLDIKGSKTFFTCLESVKGCYEALVIAKFLALMYSYLNISISKNIVPDEIKGRALHHSFPVSLFLPRNVRLEHKTLKLLKYWTWQFVVVRPVCSILIIALQLIGLYPSWVSWTFTIILNLSVSMALYALVIFYHLFAKELAPHKPLAKFLCIKGIVFFSFWQGCALDVLAAVGVIQSHHFWLDVEHIQEAIQNVLIILEMVIFSVLQQYAYHVAPYSGADKAKSVKKNE

SEQ ID NO: 4539 - protein, 293 aa, Avena sativa
MDLSKMDPPTLTLLGAACCVMLSMHFTVQLVSQHLFYWKNSKEQKAILIIVLMPPLYAITSFVGLLDIKGSEAFFTCLESVKECYEALVIAKFLALMYSYLNISISKNIVPDEIKGRVLHHSFPMSLFLPRNVRLEHKTLKLLKYWTWQFVVVRPVCSILIIALQLLGMYPSWVSWTFTIILNFSVSMALYALVIFYHLFAKELAPHKPLSKFLCIKGIVFFSFWQGCALEILTAVGVIRSHHFWLDVEHIQEAIQNVLIILEMVVFSVLQQYAYHVAPYSGADRAKFEKKNE

SEQ ID NO: 4540 - protein, 293 aa, Oryza sativa
MDLTKMDAPTLTLLGAACCVMLSMHFTVQLVSQHLFYWKNPKEQKAILIIVLMAPLYAINSFVGLLDIKGSKTFFTFLDAVKECYEALAIAKFMALMYSYLNISISKNIVPDEIKGRVLHHSFPVSLFLPRNVRLEHKTLKLLKYWTWQFVVVRPICAILMITLQLLGLYPSWVSWTFTIILNFSVSMALYALVIFYHLFAKELAPHKPLAKFLCIKGIVFFSFWQGFALEVLAAVGIIQSHHFWLDVEHIQEAIQNVLVIIEMVFFSVLQQYAYHVAPYSGADRAKFEKKNE

SEQ ID NO: 4541 - protein, 293 aa, Pennisetum glaucum
MDLSKMDAPTLTLLGAAGCVMLSMHFTVQLVSQHLFYWKNPKEQKAILIIVLMAPLYAITSFVGLLDIQGSKTFFTFLEAVKECYEALVIAKFMALMYSYLNISISKNIVPDEIKGRELHHSFPVSLFLPRTVRLEHKTLKLLKYWTWQFVVIRPVCSVLIIALQLLGLYPSWVSWTFTIILNFSVSMALYALVLFYHLFAKELAPHKPLAKFLCIKGIVFFSFWQGLALKVLTEVGVIQSHHFWLDVEHIQEAIQNVLVILEMVVFSVIQQYAYHVAPYSGADKAKFEKKNE

SEQ ID NO: 4542 - protein, 293 aa, Setaria italica
MDLSKMDAPTLTLLGAAGGVMLSMHFTVQLVSQHLFYWKNPKEQKAILIIVLMAPLYAISSFVGLLDIQGSKTFFTFLDAVKECYEALVIAKFMALMYSYLNISISKNIVPDEIKGRVLHHSFPVSLFLPRTVRLEHKTLKLLKYWTWQFVVIRPVCSILIITLQLLGLYPSWVSWTFTIILNFSVSMALYALVLFYHLFAKELAPHKPLAKFLCIKGIVFFSFWQGIALNVLTEVGVIQSHHFWLDVEHIQEAIQNVLVILEMVVFSVIQQYAYHVAPYSGADRAKFEKKNE

SEQ ID NO: 4543 - protein, 293 aa, Zea mays
MDLSKMDPGTLTLLGAAGCVMLTMHFTVQLVSQHLFYWKNPKEQKAILIIVLMAPLYAISSFVGLLDIQGSKTFFTFLDAVKECYEALVIAKFMALMYSYLNISISKNIVPDEIKGRVLHHSFPVSLFLPRNVRLEHKTLKLLKYWTWQFVIVRPVCSILIIALQLLGLYPSWVSWTFSIILNFSVSMALYALVLFYHLFAKELAPHKPLAKFLCIKGIVFFSFWQGFALDVLTQAGVIKSHHFWLDVEHIQEAIQNVLVILEMVVFSVIQQYAYHVAPYSGADRAKFEKKNE

SEQ ID NO: 4544 - protein, 293 aa, Saccharum officinarum
MDLSKMDPATLTLLGAAGCVMLTMHFTVQLVSQHLFYWKNPKEQKAILIIVLMAPLYAISSFVGLLDIQGSKTFFTFLDAVKECYEALVIAKFMALMYSYLNISISKNIVPDEIKGRELHHSFPVSLFLPRNVRLEHKTLKLLKYWTWQFVVVRPVCSILIIALQLLGLYPSWVSWTFSIILNFSVSMALYALVLFYHLFAKELAPHKPLAKFLCIKGIVFFSFWQGFALDILTEAGVIKSHHFWLDVEHIQEAIQNVLIILEMVVFAVIQQYAYHVAPYSGADRAKFEKKNE

SEQ ID NO: 4545 - protein, 293 aa, Panicum virgatum
MDLSKMDAPTLTLLGAAGCVMLTMHFTVQLVSQHLFYWKNPKEQKAILIIVLMAPLYAISSFVGLLDIQGSKTFFTFLDAVKECYEALVIAKFMALMYSYLNISISKNIVPDEIKGRVLHHSFPVSLFLPHTVRLEHKTLKLLKYWTWQFVVIRPVCSILIIALQLLGMYPSWVSWTFTIILNISVSMALYALVLFYHLFAKELAPHKPLAKFLCIKGIVFFSFWQGLALDVLTEVGVIQSHHFWLDVEHIQEAIQNVLVILEMVVFSVIQQYAYHVAPYSGADRAKFEKKNE

SEQ ID NO: 4546 - protein, 293 aa, Panicum virgatum
MDLSKMDAPTLTLLGAAGCVMLTMHFTVQLVSQHLFYWKNPKEQKAILIIVLMAPLYAISSFVGLLDIQGSKTFFTFLDAVKECYEALVIAKFMALMYSYLNISISKNIVPDEIKGRVLHHSFPVSLFLPHTVRLEHKTLKLLKYWTWQFVVIRPVCSILIIALQLLGMYPSWVSWTFTIILNISVSMALYALVLFYHLFAKELAPHKPLAKFLCIKGIVFFSFWQGFALDVLTEVGVIQSHHFWLDVEHIQEAIQNVLVILEMVVFSVIQQYAYHVAPYSGADRAKFEKKNE

SEQ ID NO: 4547 - protein, 273 aa, Triticum aestivum
MLSMHFTVQLVSQHLFYWKNAKEQKAILIIVLMPPLYAITSFVGLLDIKGSKTFFTCLESVKECYEALVIAKFLALMYSYLNISISKNIVPDEIKGRVLHHSFPVSLFLPRNVRLEHKTLKLLKYWTWQFVVVRPVCSILIIALQLLGLYPSWVSWTFTIILNFSVSMALYALVIFYHLFAKELAPHKPLAKFLCIKGIVFFSFWQGCALDVLAAVGVIQSHHFWLDVEHIQEAIQNILIILEMVVFSVLQQYAYHVAPYSGADKAKSVKKNE

SEQ ID NO: 4548 - protein, 288 aa, Sorghum bicolor
MDPPTLTLLGAAGCVMLTLHFTVQLVSQHLFYWKNPKEQKAILIIVLMAPLYAISSFVGLLDIQGSKTFFTFLDAVKECYEALVIAKFMALMYSYLNISISKNIVPDEIKGRELHHSFPVSLFLPSKVRLEHKTLKLLKYWTWQFVIVRPVCSILIIALQLLGLYPSWVSWTFSIILNFSVSMALYALVLFYHLFAKELAPHKPLAKFLCIKGIVFFSFWQGFALDILTEAGVIKSHHFWLDVEHIQEAIQNVLIILEMVVFAVIQQYAYHVAPYSGADRAKFEKKNE

SEQ ID NO: 4549 - protein, 530 aa, Triticum aestivum
MDGAGMATLPEANTSPAPNGGGCGGIRVENCYVFKSRLQEYAQKAGLMTPEYQTLKEGPSHEPIFKSSVVINNTKYDSLPGFFSRKAAEQSAAEVALMEIGKSVVLPTNATIPAVQETGLCKNLLQEYAQKMNYAIPSYICNKQGPYICTVEIGGIQYIGATARTKKEAEIKAARTALLAIQVAGQSEGCANGTTKYIVVPGKRQGKEIEKKPVETPKSLKTKKGGFKKQRNKNKFIKKNGQEVNEEKDETGVPGDAHHSDVPMKPAVTTEDPVTNTVMIQPDEAWPFEHEPTGDTAMLQPIEDAWPSKHEPTGETAMLQPDGEATKVEQEQLSDTAMLQPDDEGGRVEHEPLSNAPMVLRNEEARNVKQEALISTAMPQPHMEDRRVGAEPPRDAAMVQPNDEARCIKQELLIDAAMPLPNEEAGAAANPVPLSDSITAQPNAVTTNINEESLRNAASVQHNEEARTVNQEPPSSASLQQPKEPRVENGEFVSENKDQTLGDASREANRSNEDVPEKCSDNSSAFTSVE

SEQ ID NO: 4550 - protein, 555 aa, Triticum aestivum
AGTPGTTRGRTKPSSLILQSGGAVGMDGAGMATLPEANTSPAPNGGGCGGIRVENCYVFKSRLQEYAQKAGLMTPEYQTLKEGPSHEPIFKSSVVINNTKYDSLPGFFSRKAAEQSAAEVALMEIGKSVVLPTNATIPAVQETGLCKNLLQEYAQKMNYAIPSYICNKQGPYICTVEIGGIQYIGATARTKKEAEIKAARTALLAIQVAGQSEGCANGTTKYIVVPGKRQGKEIEKKPVETPKSLKTKKGGFKKQRNKNKFIKKNGQEVNEEKDETGVPGDAHHSDVPMKPAVTTEDPVTNTVMIQPDEAWPFEHEPTGDTAMLQPIEDAWPSKHEPTGETAMLQPDGEATKVEQEQLSDTAMLQPDDEGGRVEHEPLSNAPMVLRNEEARNVKQEALISTAMPQPHMEDRRVGAEPPRDAAMVQPNDEARCIKQELLIDAAMPLPNEEAGAAANPVPLSDSITAQPNAVTTNINEESLRNAASVQHNEEARTVNQEPPSSASLQQPKEPRVENGEFVSENKDQTLGDASREANRSNEDVPEKCSDNSSAFTSVE

SEQ ID NO: 4551 - protein, 250 aa, Triticum aestivum
MELVSSSRSTLSSCSRLVAPSRSSSTTASAAARRHGKRLLCVLGGDRNGELKIGKRAALALLLATPTLSLPFSAHAKTKTINPYDERRLLQQNKKIQEANRAPDDFPNFIREGFQVKVVTPDNYITRDSGLIYEDVKVGTGDCPKDGQQVIFHYVGYNESGRRIDSTYIQGSPAKIRLGNKSLVPGFEEGIRDMKPGGKRRLIIPPELGPPVGPSTFFSAKQFEVFDVELLSVQDCQRRTIAFYSDVVCT

SEQ ID NO: 4552 - protein, 250 aa, Triticum aestivum
MELVSSSRSTLSSCSRLVAPSRSSSTTASAAARRHGKRLLCVLGGDRNGKLKIGKRAALALLLATPTLSLPFSAHAKTKTINPYDERRLLQQNKKIQEANRAPDDFPNFIREGFQVKVVTPDNYITRDSGLIYEDVKVGTGDCPKDGQQVIFHYVGYNESGRRIDSTYIQGSPAKIRLGNKSLVPGFEEGIRDMKPGGKRRLIIPPELGPPVGPSTFFSAKQFEVFDVELLSVQDCQRRTIAFYSDVVCT

SEQ ID NO: 4553 - protein, 247 aa, Brachypodium distachyon
MELLSSSRSMLSSCNRLVAPSRTASSAAKRDRKSGLVCVLGGERGSEGKIGKRSALALVLAIPALSVPLSAHGKTKSMTPYDERRLLQQNKKIQEANRAPDDFPNFIREGFQVKVVTPDNYVTRDSGLIYEDVKIGTGDCPKDGQQVTFHYIGYNESGRRIDSTYIQGSPAKIRLGNKSLVPGFEEGIRDMKPGGKRRLIIPPELGPPVGPSTFFSAKQFEVFDVELLSVKDCERRTIGFYSDVVCS

SEQ ID NO: 4554 - protein, 285 aa, Triticum aestivum
SIIPFFLVLLHSPATASECECGVGQSKCVGLEEKEMELVSSSRSTLSSCSRLVAPSRSSSTTASAAARRHGKRLLCVLGGDRNGELKIGKRAALALLLATPTLSLPFSAHAKTKTINPYDERRLLQQNKKIQEANRAPDDFPNFIREGFQVKVVTPDNYITRDSGLIYEDVKVGTGDCPKDGQQVIFHYVGYNESGRRIDNTYIQGSPAKIRLGNKSLVPGFEEGIRDMKPGGKRRLIIPPELGPPVGPSTFFSAKQFEVFDVELLSVQDCQRRTIAFYSDVVCT

SEQ ID NO: 4555 - protein, 105 aa, Triticum aestivum
MACAFFFDAEPLGEPGLRLHGPELELDACALCTKPLQSNSDIFMYKGDTPFCSEDCRYEQMHFDAAMARQQASARRKQQQQQAQAQPSVPAPAPVSAKADVSVAS

SEQ ID NO: 4556 - protein, 104 aa, Pseudoroegneria spicata
MACAFFFDAEPLGEPGLRLHGPELELDACALCTKPLQANSDIFMYKGDTPFCSEDCRYEQMHFDAAMARQQASARRKQQQQAQAQLSVPAPAPVSAKADVSVAS

SEQ ID NO: 4557 - protein, 132 aa, Triticum aestivum
HTHASLEFLFFFPPSKEEAASAQPCVMAACAFFFDAEPLGEPGLQLHGPELELDACALCTKPLQGNSDIFMYKGDTPFCSEDCRYEQMHFDAAMARQQASARRKQQQQQAQAQPSVPAPAPVSAKADVSVAS

SEQ ID NO: 4558 - protein, 110 aa, Triticum aestivum
MACAFFFDAEPLGEPGLRLHGPELELDACALCTKPLQGNSDIFMYKGDTPFCSEDCRYEQMHFDAAMARQQASARRKQQQQQAQAQLSVPGAPAPAPAPVSNKADVSVAS

SEQ ID NO: 4559 - protein, 106 aa, Triticum aestivum
MAACAFFFDAEPLGEPGLQLHGPELELDACALCTKPLQGNSDIFMYKGDTPFCSEDCRYEQMHFDAAMARQQASARRKQQQQQAQAQPSVPAPAPVSAKADVSVAS

SEQ ID NO: 4560 - protein, 108 aa, Secale cereale
MACAFFFDAEPLGEPGLRLHGPELELDACALCTKPLQSNSDIFMYKGDTPFCSEDCRYEQMHFDAAMARQQASARRKQQQQQQAQAQVSVPGAPAPVSAKPMCPWRAS

SEQ ID NO: 4561 - protein, 121 aa, Triticum aestivum
  misc_feature (71)..(71): Xaa can be any naturally occurring amino acid
  misc_feature (84)..(84): Xaa can be any naturally occurring amino acid
  misc_feature (87)..(88): Xaa can be any naturally occurring amino acid
  misc_feature (113)..(113): Xaa can be any naturally occurring amino acid
MACAFFFDAEPLGEPGLRLHGPELELDACALCTKPLQSNSDIFMYKGDTPFCSEDCRYEQMHFDAAMARQXASARRKQQQQQAXRSXXPAPAPCPQRRLSWELLRAPHRLLVXTITFFPGR

SEQ ID NO: 4562 - protein, 491 aa, Triticum aestivum
MTSKVANSSGSDNADAKLSPSGLPVREVPGGYGVPFLSPLRDRLDYYYFQGAEEYFRSRIARNGGATVLRVNMPPGPFITADSRVVAFLDARSFSVLLDDAKVDKTDTLDGTFMPSLALFGGYRPLAFLDAADPRHAALKRVMISLAAARMHHVAPVFRIAFGAVFDAADAGLGDGPVQFNKLNEHHMFDFTCSALFGGTPPSKAMGDGAVTKAIKWLGVQLHPLASKIIKPWLLEDLLLHTFRLPPLLVRRDYADLTAYFAEAAAGFLNDADKAQSGISRDELLHNLVFTAIFNAYGGFKIFLPHVIKWLARAGPALHARLASEVRAAVPNGSDITVSAVDKMPLVKSVVWEALRMNPPVEFQYGRARQDLVVESHDAAYQVRKGEMLFGYQPLATRDERVFKQAGEFVPDRFVGGEGRLLGNVVWSNGPENSEPAEGNKQCPGKDMVVAVGRLMVAELFRRYDTFTADVKEMPLEPVVTFTSLTRAKAE

SEQ ID NO: 4563 - protein, 515 aa, Triticum aestivum
  misc_feature (402)..(402): Xaa can be any naturally occurring amino acid
STHASDSLELSIAFGDRLALAHPAMTSKVANSSGSDNADAKLSPSGLPVREVPGGYGVPFLSPLRDRLDYYYFQGAEEYFRSRIARNGGATVLRVNMPPGPFITADSRVVAFLDARSFSVLLDDAKVDKTDTLDGTFMPSLALFGGYRPLAFLDAADPRHAALKRVMISLAAARMHHVAPVFRIAFGAVFDAADAGLGDGPVQFNKLNEHHMFDFTCSALFGGTPPSKAMGDGAVTKAIKWLGVQLHPLASKIIKPWLLEDLLLHTFRLPPLLVRRDYADLTAYFAEAAAGFLNDADKAQSGISRDELLHNLVFTAIFNAYGGFKIFLPHVIKWLARAGPALHARLASEVRAAVPNGSDITVSAVDKMPLVKSVVWEALRMNPPVEFQYGRARQDLVVESHXAAYQVRKGEMLFGYQPLATRDERVFKQAGEFVPDRFVGGEGRLLGNVVWSNGPENSEPAEGNKQCPGKDMVVAVGRLMVAELFRRYDTFTADVKEMPLEPVVTFTSLTRAKAE

SEQ ID NO: 4564 - protein, 301 aa, Triticum aestivum
MAAPRPQPLLLLLVSLLAASAPRRADAWGKEGHIMVCKIAEKYLSEEAAAAVQDLLPESAGGELSTMCPWADTMRFRYHWASPLHYANTPNVCNFNFSRDCHNSRGEQGMCVVGAINNYTDQLYTYGDSPKSSYNLTESLMFLAHFVGDVHQPLHVGYEEDEGGNTIMVRWYRRKANLHHVWDVSIIDTVMKDFYNKSMDTMVDALQTNLTEGWSDDVGHWENCANKKATCANDYAIESINLSCNYAYKDVVQNITLGDDYYFTRYPVVEKRLAQAGVRLALILNRIFDKKKADTTPLYIQ

SEQ ID NO: 4565 - protein, 301 aa, Leymus cinereus x Leymus triticoides
  misc_feature (88)..(88): Xaa can be any naturally occurring amino acid
  misc_feature (122)..(122): Xaa can be any naturally occurring amino acid
MAAPRPQPLLLLLLVLLLAASAPRRADAWGKEGHIMVCKIAEKYLSEDAAAAVQDLLPESAGGELSTMCPWADTMRFRYHWSSPLHYXNTPNVCNFKFSRDCHNSRGQQGMCVVGAINNYTXQLYTYGDSKSSYNLTESLMFLAHFVGDVHQPLHVGYEEDEGGNTIMVHWYRRKANLHHVWDVSIIDTVMKDFYNKSLDTMVNALQMNLTEGWSDDVGHWENCANKKATCANDYAIESIHLSCNYAYKDVVQNITLGDDYYFTRYPVVEKRLAQAGVRLALILNRIFDKKKADAMPLYVQ

SEQ ID NO: 4566 - protein, 302 aa, Pseudoroegneria spicata
  misc_feature (24)..(24): Xaa can be any naturally occurring amino acid
  misc_feature (108)..(108): Xaa can be any naturally occurring amino acid
  misc_feature (209)..(209): Xaa can be any naturally occurring amino acid
  misc_feature (293)..(293): Xaa can be any naturally occurring amino acid
  misc_feature (296)..(297): Xaa can be any naturally occurring amino acid
MAAPCPQPLLLLLLISLLAASAPXRAEAWGKEGHIMVCKIAEKYLSEDAAAAVQDLLPESAGGELSTMCPWADTMRFRYHWASPLHYANTPNVCNFKFSRDCHNSRGXQGMCVVGAINNYTDQLYTYGDSSKSSYNLTESLMFLAHFVGDVHQPLHVGYEEDEGGNTIMVHWYRRKANLHHVWDVSIIDTVMKDFYNKSLDTMVDALQXNLTEGWSDDVGHWENCANKKATCANDYAIESINLSCNYAYKDVVQNITLGDDYYFTRYPVVEKRLAQAGVRLALILNRIFDKKXADXXPLYVQ

SEQ ID NO: 4567 - protein, 296 aa, Triticum aestivum
PLLLLLLVALLAASAPRRADAWGKEGHIMVCKIAERYLSEEAAAAVQDLLPESAGGELSTMCPWADTMRFRYHWASPLHYANTPNVCNFKFSRDCHNSRGQQGMCVVGAINNYTDQLYTYGDSPKSSYNLTESLMFLAHFVGDVHQPLHVGYEEDEGGNTIMVHWYRRKANLHHVWDVSIIDTVMKDFYNKSLDTMVDALQTNLTEGWSDDVGHWENCANKEATCANDYAIESINLACNYAYKDVVQNITLGDDYYFTRYPVVEKRLAQAGVRLALILNRIFDKKKEADAMPLYIQ

SEQ ID NO: 4568 - protein, 298 aa, Triticum aestivum
MAAPRSQPLLLLLLVALLAASTDAWGKEGHIMVCKIAERYLSEEAAAAVQDLLPESAGGELSTMCPWADTMRFRYHWASPLHYANTPNVCNFKFSRDCHNSRGQRGMCVVGAINNYTDQLYTYGDSPKSSYNLTESLMFLAHFVGDVHQPLHVGYEEDEGGNTIMVRWYRRKANLHHVWDVSIIDTVMKDFYNKSLDTMVAALQTNLTEGWSDDVGHWENCANKKATCANDYAIESIHLSCNYAYKDVVQNITLGDDYYFTRYPVVEKRLAQAGVRLALILNRIFDKKKADTMPLYVQ

SEQ ID NO: 4569 - protein, 299 aa, Triticum aestivum
MAAPRPHPLLLLLLVALLAASADAWGKEGHIMVCKIAERYLTEEAAAAVQDLLPESAGGELSTMCPWADTMRFRYHWASPLHYANTPNICSFNFSRDCHNSRGEQGMCVVGAINNYTDQLYTYGDSPKSSSYNLTESLMFLAHFVGDVHQPLHVGYEEDEGGNTITVHWYRRKANLHHVWDVSIIDTVMKDFYNKSLDTMVAALQMNLTEGWSDDVAHWENCANKKATCANDYAIESISLSCNYAYKDVVQNITLGDDYYFTRYPVVEKRLAQAGVRLALILNRIFDKKEADTMPLYVQ

SEQ ID NO: 4570 - protein, 296 aa, Triticum aestivum
MAAPLLLLVALLAASAPRRADGWGKEGHIMVCKIAEKYLSEEAAAAVQELLPESAGGELSTMCPWADTMRFRYHWASPLHYANTPNVCNFKSSRDCHNSRGQQGMCVVGAINNYTDQLYTYGDSPKSSYNLTESLMFLAHFVGDVHQPLHVGYEEDEGGNTIMVRWYRRKANLHHVWDVSIIDTVMKDFYNKSLDTMVGALQTNLTEGWSDDVGHWENCANKRATCANDYAIESIHLSCNYAYKDVVQNITLGDDYYFTRYPVVEKRLAQAGVRLALILNRIFDKKKADTMPLYVQ

SEQ ID NO: 4571 - protein, 292 aa, Triticum aestivum
LLLLVALLAASAPRRADGWGKEGHIMVCKIAEKYLSEEAAAAVQELLPESAGGELSTMCPWADTMRFRYHWASPLHYANTPNVCNFKSSRDCHNSRGQQGMCVVGAINNYTDQLYTYGDSPKSSYNLTESLMFLAHFVGDVHQPLHVGYEEDEGGNTIMVRWYRRKANLHHVWDVSIIDTVMKDFYNKSLDTMVGALQTNLTEGWSDDVGHWENCANKRATCANDYAIESIHLSCNYAYKDVVQNITLGDDYYFTRYPVVEKRLAQAGVRLALILNRIFDKKKADTMPLYVQ

SEQ ID NO: 4572 - protein, 246 aa, Triticum aestivum
LLLLVALLAASAPRRADGWGKEGHIMVCKIAEKYLSEEAAAAVQELLPESAGGELSTMCPWADTMRLRDHWASPLHYANTPNVCNFKSSRDCHNSRGQQGMCVVGAINNYTDQLYTYGDSPKSSYNLTESLMFLAHFVGDVHQPLHVGYEEDEGGNTIMVHWYRRKANLHHVWDVSIIDTVMKDFYNKSLDTMVGALQTNLTDGPTMSATGRTAPTNGPPAQTTTRSRAYTCRATTHTRMWCRTLP

SEQ ID NO: 4573 - protein, 277 aa, Triticum aestivum
DAWGKEGHIMVCKIAEKYLSEEAAAAVQEGVPESAGGELSTMCPGADTMRFRYHWASPLHYANTPNVCNFNFSRDCHNSRGEQGMCVVGAINNYTDQLYTYGDSSKSSYNLTESLMFLAHFVGDVHQPLHVGYEEDEGGNTIMVHWYRRKANLHHVWDVSIIDTVMKDFYNKSLDTMVDALQTNLTEGRSDDVGHWKNCANKEATCANDYAIESINLACNYAYKDVVQNITLGDDYYFTRYPVVEKRLAQAGVRLALILNRIFDKKKEADAMPLYIQ

SEQ ID NO: 4574 - protein, 298 aa, Brachypodium distachyon
MAAPRARLPLLLLLVPLLDAGRAAAWGKEGHIMVCKIAEKYLSASAAAAVQELLPEAAGGELSTMCPWADQMRFRYHWASPLHYANTPNVCNFKFSRDCHNSRGQQGMCVVGAINNYTDQLYSYGDPKSSYNLTESLMFLAHFVGDVHQPLHVAFEKDEGGNTIMVHWYRRKANLHHVWDVSIIDTVMKNFYNRSLDTMVDALKGNLTNGWSDDVSHWENCENKRATCANDYAIESIHLSCNYAYKDVEQNVTLGDDYYFSRYPVVEKRLAQAGIRLALILNRIFDKDKADVIPLHVQ

SEQ ID NO: 4575 - protein, 364 aa, Triticum aestivum
MWAASPAFRRQLVLLRSLAPTTCADGGRASSSSLRPHAMSAAAGPVYEADAEAVVRRITPPLDRARHKGQAGKIAIIGGCREYTGAPYFAAISALKVGADLSHVFCTKDAATVIKSYSPELIVHPILEESYSVRDDERESVSSSILTEVIKWMERFDCIVVGPGLGRDSFLMDCVSNIMRHARQANIPTVVDGDGLFLITNNIGLVEDNSLAILTPNVYEYKRLVQKVLNCEVNEENASEQLTALCQKIGGVTIMRKGKADVISDGKKVTQVSTFGSPRRCGGQGDILSGSVAVFSSWARHFLLSNEQPKETSVNPMVLGCIAGSLLLRKAAALAFEKNKRSTVTTDIIEFLGQSLEDICPAGW

SEQ ID NO: 4576 - protein, 379 aa, Triticum aestivum
ACPHAWQQHHLHHRGRMWAASPAFRRQLFLLRSLAPTCADGGRASSSSLRPHLMYAAAGPVYEADAEAVVRRITPPLDRARHKGQAGKIAIIGGCREYTGAPYFAAISALRVGADLSHVFCTKDAATVIKSYSPELIVHPILEESYSVRDDERESVSSSILAEVIKWMERFDCIVVGPGLGRDSFLMDCVGNIMRHARQANIPTVVDGDGLFLITNNIGLVEDNSLAILTPNVYEYKRLVQKVLNCEVNEENASEQLTALCQKIGGVTIMRKGKADLISDGKKVTQVSTFGSPRRCGGQGDILSGSVAVFSSWARHFLLSNEQPKETSVNPMVLGCIAGSLLLRKAAALAFEKNKRSTVTTDIIEFLGQSLEDICPAGR

SEQ ID NO: 4577 - protein, 347 aa, Triticum aestivum
SLAPTCADGGRASSSSLRPHAMSAAAGPVYEADAEAVVRRITPPLDRARHKGQAGKIAIIGGCREYTGAPYFAAISALKVGADLSHVFCTKDAATVIKSYSPELIVHPILEESYSVRDDERESVSSSILTEVIKWVERFDCIVVGPGLGRDSFLMDCVSNIMRHARQANIPIVVDGDGLFLITNNIGLVEDNSLAILTPNVYEYKRLVQKILNCEVNEENASEQLTALCQKIGGVTIMKKGKADVISDGKKVTQVSTFGSPRRCGGQGDILSGSVAVFSSWARHFLLSNEQPKETSVNPMVLGCIAGSLLLRKAAALAFEKNKRSTVTTDIIEFLGQSLEDICPAGR

SEQ ID NO: 4578 - protein, 366 aa, Brachypodium distachyon
MWAASPAFRRQLFLLRSLAPSCTCVSGGRASSSSLRVHAMHAAAAGAVYEADAESVVRRITPPLDRARHKGQAGKIAVIGGCREYTGAPYFAAISALKVGADLSHVFCTKDAATVIKSYSPELIVHPILEESYSVRDDERESVSSIILTEVTKWMERFDCIVVGPGLGRDSFLLNCVSNIMRHARQANIPTVVDGDGLFLVTNNISLVEDNSLAILTPNVYEYKRLVQKVLNCDVDEENASEQLTTLCQKIGGVTIMKKGKADVISDGKQVTQVSTFGSPRRCGGQGDILSGSVALFSSWARHFLLSNDQPTEKSVNPMILGCIAGSLLLRKAAGLAFEKKKRSTVTTDIIEFLGKSLEDICPAEQ

SEQ ID NO: 4579 - protein, 371 aa, Oryza sativa
MWAASPAFRRRLFLLRSLSPSPCAALPGNAACSSSPSPSTSIRVNAMSASGPVYEADAEAVVRRITPPLDRARHKGQAGKIAVIGGCREYTGAPYFAAISALKVGADLSHVFCTRDAATVIKSYSPELIVHPILEESYSVSDGERESVSSRILTEVAKWMERFDCIVVGPGLGRDSFLLDCVSNIMRHARQANIPTVVDGDGLFLITNNLSLVEGNLLAILTPNVYEYKRLVQKVLNCEVNEENASEQLTALCQKIGGITIMRKGKADIISDGKTVTQVSTFGSPRRCGGQGDILSGSVAVFASWARHFLLTNEYPTEKSVNPMMLGCIAGSLLLRKAASHAFEKNKRSTVTTDIIELLGKSLEDICPAGH

SEQ ID NO: 4580 - protein, 374 aa, Panicum virgatum
MWAASPFFRRQLVLLRSLLPQSPPPSVAGCRFAHLSSPSGTSGSLRAARAMAAATVYEADAEAVVRRITPPLDRARHKGQAGKIAVIGGCREYTGAPYFAAISALKVGADLSHVFCTKDAATVIKSYSPELIVHPILEESYSVRDDERASVSSKILTEVAKWMERFDCIVVGPGLGRDSFLLDCVSNIMKHARQANIPTVVDGDGLFLITNNLGLVEGNPLAILTPNVYEYKRLVQKVLNCDVNEETASEQLMELCQKIGGVTIMQKGKADVICDGKTVTQVSTFGSPRRCGGQGDILSGSVAVFTSWAQHFILSNEQPTEKRVNPTTLGCIAGSLLLRKAASLAFEKNKRSTVTTDIIEFLGKSLEDICPAEH

SEQ ID NO: 4581 - protein, 375 aa, Sorghum bicolor
MWAASPAFRRQLVLLRSLLPSPPAPSSVAGFPPSCPSCSSFLRVRTNHAMAASAGTVYEADAEAVVRRITPPLDRARHKGQAGKIAVIGGCREYTGAPYFAAISALKVGADLSHVFCTKDAATVIKSYSPELIVHPILEESYSVRDDERASVSSKILTEVGKWMERFDCIVVGPGLGRDSFLLDCVSNIMRHARQANIPTVVDGDGLFLVTNNLSLVEGNPLAILTPNVYEYKRLVQKVLNCDVDEETASEQLITLCQKIGDVTIMQKGKADVISDGKTVTQVSTFGSPRRCGGQGDILSGSVAVFASWARHFVLTNEQPTEKRVNPMTLGCIAGSLLLRKAASHAFEKNKRSTVTSDIIEFLGKSLEDICPAEH

SEQ ID NO: 4582 - protein, 375 aa, Saccharum officinarum
MWAASPAFCRQLVLLRSLLPSPPAPSSVAGFPPSCPSCSSFLRVRTNHAMAASAGTVYEADAEAVVRRITPPLDRARHKGQAGKVAVIGGCREYTGAPYFAAISALKVGADLSHVFCTKDAATVIKSYSPELIVHPILEESYSVRDDERASVSSKILTEVAKWMERFDCIVVGPGLGRDSFLLDCVSNIMRHARQANIPTVVDGDGLFLVTNNLSLVEGNPLAILTPNVYEYKRLVLKVLNCDVDEETASEQLITLCQKIGDVTIMQKGKADVISDGKTVTQVSTFGSPRRCGGQGDILSGSVAVFASWARHFVLTNEQPTEKRVNPMTLGCIAGSLLLRKAASHAFEKNKRSTVTSDIIEFLGKSLEDICPAEH

SEQ ID NO: 4583 - protein, 376 aa, Pennisetum glaucum
MWAASQAFRRQLVLLRSLLPPPPSPCSPVASCFAPSPSLSSSSTSSSIRASHAMEATVYEADAEAVIHRITPPLDRARHKGQAGKIAVIGGCREYTGAPYFAAISALKVGADLSHVFCTKDAATVIKSYSPELIVHPILEESYSVREDERAPVSSKILTEVAKWMERFDCIVVGPGLGRDSFLLDCVSNIMKHARQANIPTVVDGDGLFLITNNLGLVEGNPLAILTPNVYEYKRLVQKVLNCDVNEENAAEQLTMLCQKIGGVTIMRKGKADVISDGKTVSQVSTFGSPRRCGGQGDILSGSVAVFTSWAQQFILSNEQPTGKRVNPMTLGCVAGSLLLRKAASLAFEENKRSTVTTDIIEFLGKSLEDICPAEH

SEQ ID NO: 4584 - protein, 398 aa, Zea mays
MSRPTGAWRLGMATCTIPAAPRAHVGRLPGIRQAARPALLLPSFSSSTLLCHRLPPILPLVLQLLRVRANHAMAASAGTVYEADAEAVVRRITPALDRARHKGQAGKIAVIGGCREYTGAPYFAAISALKVGADLSHVFCTKDAATVIKSYSPELIVHPILEESYSVRVDERASVSSKILTEVAKWMERFDCIVVGPGLGRDPFLLECVSNIMRHARQANIPTVVDGDGLFLVNNNLNLVEGNPLAILTPNVYEYKRLVQKVLNCDVDEESASEQLIALCQKIGDVTIMQKGKADVISDGKTVTQVSTFGSPRRCGGQGDILSGSVAVFASWARHFVLTNEEPTEKRVNPMTLGCIAASLLLRKAASHAFEKNKRSTVTSDIIEFLGKSLEDICPAEH

SEQ ID NO: 4585 - protein, 437 aa, Leymus cinereus x Leymus triticoides
MGSLRGGSGGEGRNEDGGKVGLPALEVALAFPQATPASLFPPAVSDYYQLDDLLTDEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSATKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 4586 - protein, 437 aa, Triticum aestivum
MGSLRGGSGGEGRNEDGGKVGLPALEVALAFPQATPASLFPPAVSDYYQLDDLLTNEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSATKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 4587 - protein, 437 aa, Triticum aestivum
MGSLRGGSGGEGRNEDGGKVGLPALEVALAFPQATPASLFPPAVSDYYQLDDLLTGEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSAIKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 4588 - protein, 437 aa, Brachypodium distachyon
MGSLRGSAGGEGRNEDGGKVGLPALEVALAFPQATPASLFPPSVSDYYQFDDLLSDEEKTLRKKVRAISEKEIAPIMTEYWEKAEFPFHAIPKLATLGLAGSTTKGYGCPGLSLTASAISIAEVARVDASCSTFILVHSSLAMSTIALCGSEAQKQKYLPSMAQLKTVGCWALTEPDYGSDASSLKTSATKVPGGWLLDGQKRWIGNSTFADVLIILARNADTKQLNGFIVKKGAPGLKATKIQNKIGLRMVQNGDILLNKVFVPEEDRLTGIDSFQDISKVLAMSRIMVAWQPIGIAMGVYDMCHRYLKERKQFGAPLAAFQLNQEKLVRMLGNIQAMVLIGWRLCKLYESDKMTPGHASLGKAWTSTKAREVVSLGRELLGGNGILADFLVAKAFCDLEPIYTYEGTYDINSLVTGREITGIASFKPAALAKSRL

SEQ ID NO: 4589 - protein, 439 aa, Avena sativa
MGSLGGGGSGGGEGSSQAGGKVGLPALEVSLAFPQATPASLFPPSVSDYYQLDDLLTDEEKALRKKVRAISEKEIAPIMTEFWEKAEFPYHAIPKLATLGLAGSTTKGYGCPGLSITASAISIAEVARVDASCSTFILVHSSLAMSTIALCGSEAQKQKYLPSLAQLKTVGCWALTEPDYGSDASSLKTSATKVPGGWHLDGQKRWIGNSTFADVLIILARNADTKQLNGFIVKKGAPGLKATKIQNKIGLRMVQNGDILMNKVFVPEEDRLTGIDSFQDISKVLAMSRIMVAWQPIGISMGVYDMCHRYLQERKQFGAPLAAFQLNQEKLVRMLGNIQAMLLVGWRLCKLYESGKMTPGHASLGKAWISSKSREVVSLGRELLGGNGILADFLVAKAFCDLEPIFTYEGTYDINALVTGREITGIASFKPAALAKARL

SEQ ID NO: 4590 - protein, 433 aa, Setaria italica
MGSLGGSGGAGAGSKVGLPALDVALAFPQATPASLFPPAVSDYYQFDDLLTDEEKALRKKVRGIMEKEIAPIMTEYWEKAEFPFHAIPNLASLGLAGGTIKGYGCPGLSLTASAISIAEVARVDASCSTFILVHSSLAMSTIALCGSEAQKQKYLPSLAQFKTVGCWALTEPDYGSDASSLRTAATKVPGGWHLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVFDICHRYLKERKQFGAPLAAFQLNQEKLVRMLGNIQAMLLIGWRLCKLYESGKMTPGHASLGKAWTSRKAREVVSLGRELLGGNGILADFLVAKAFCDLEPIFSYEGTYDINSLVTGREITGIASFKPAVVTKSRL

SEQ ID NO: 4591 - protein, 433 aa, Panicum virgatum
MGSLGGSGGAGAGGKVGLPALDVALAFPQATPASLFPPAVSDYYQFDDLLTDEEKALRKKVRGIMEKEIAPVMTEYWEKAEFPFHAIPNLATLGLAGGTIKGYGCPGLSLTASAICIAEVARVDASCSTFILVHSSLAMSTIALCGSEAQKQKYLPSLAQFKTVGCWALTEPDYGSDASSLRTAATKVPGGWHLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVFDMCHRYLKERKQFGAPLAAFQLNQEKLVRMLGNIQAMLLIGWRLCKLYESGKMTPGHASLGKAWTSRKAREVVSLGRELLGGNGILADFLVAKAFCDLEPIFSYEGTYDINSLVTGREITGIASFKPAVLTKSRL

SEQ ID NO: 4592 - protein, 433 aa, Panicum virgatum
MGSLGGNDGAGAGGKVGLPALDVALAFPQATPASLFPPAVSDYYQFDDLLTDEEKALRKKVRGIMEKEIAPIMTEYWEKAEFPFHAIPNLATLGLAGGTTKGYGCPGLSLTASAVCIAEVARVDASCSTFILVHSSLAMSTIALCGSEAQKQKYLPSLSQFKTVGCWALTEPDYGSDASSLRTAATKVPGGWHLDGQKRWIGNSTFADVLIILARNADTNQLNGFIVKKGAPGLKATKIENKIGLRMVQNGDIILNKVFVPEQDRLTGINSFQDINKVLAMSRIMVAWQPIGISMGVFDMCHRYLKERKQFGAPLAAFQLNQEKLVRMLGNIQAMLLIGWRLCKLYESGKMTPGHASLGKAWTSRKAREVVSLGRELLGGNGILADFLVAKAFCDLEPIFSYEGTYDINSLVTGREITGIASFKPAVLTKSRL

SEQ ID NO: 4593 - protein, 433 aa, Sorghum bicolor
MGSLGGSAGAGDGGKVGLPALDVALAFPQATPASLFPPAASDYYQFDDLLTEEEKALRKKVRGIMEKEIPPIMTEYWEKAEFPFHAIPSLASLGLAGGTIKGYGCPGLSLTASAISIAEVARVDASCSTFILVHSSLAMSTIALCGSEAQKQKYLPSLAEFKTIGCWALTEPDYGSDASSLRTAATKVPGGWQLDGQKRWIGNSTFADVLVILARNADTNQLNGFIVKKGAPGLKATKIQNKIGLRMVQNGDIILNKVFVPEEDRLTGINSFQDINKVLAMSRIMVAWQPIGISMGVFDICHRYLKERKQFGAPLAAFQLNQEKLVRMLGNIQAMLLVGWRLCKLYESGKMTPGRSSLGKAWTSQKAREVVSLGRELLGGNGILADFLVAKAFCDLEPIFSYEGTYDINSLVTGREITGIASFKPAMSAKSRL

SEQ ID NO: 4594 - protein, 434 aa, Saccharum officinarum
MGSLGGSAGAGGDGGKVGLPALDVALAFPQATPASLFPPAASDYYQFDDLLTDEEKALRKKVQGIMEKEIPPIMTEYWEKAEFPFHAIPSLASLGLAGGTIKGYGCPGLSLTASAISIAEVARVDASCSTFILVHSSLAMSTIALCGSEAQKQKYLPSLAEFKTIGCWALTEPDYGSDASSLRTAATKVPGGWQLDGQKRWIGNSTFADVLIILARNADTNQLNGFIVKKGAPGLKATKIQNKIGLRMVQNGDIILNKVFVPEEDRLTGINSFQDINKVLAMSRIMVAWQPIGISMGVFDICHRYLKERKQFGAPLAAFQLNQEKLVRMLGNIQAMLLVGWRLCKLYESGKMTPGRSSLGKAWTSKKAREVVSLGRELLGGNGILADFLVAKAFCDLEPIFSYEGTYDINSLVTGREITGIASFKPAVSAKSRL

SEQ ID NO: 4595 - protein, 473 aa, Triticum aestivum
LCPPSQLLLHLDREKLGSPEESRGEEPTLALGCAAAMGSLRGGSGGEGRNEDGGKVGLPALEVALAFPQATPASLFPPAVSDYYQLDDLLTDEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSAIKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 4596 - protein, 438 aa, Brachypodium distachyon
MGSLRGSAAGEGRSEDGGKVGLPALDVALAFPQATPASLLFPPAVSDYYQIDDLLTDEEKALRKKVRAISEKEIAPIMTEYWEKAEFPFHAIPKLATLGLVGSTMKGYGCPGLSLTASAVSIAEVSRVDASCSAFILVHSSLAMSTIALCGSEAQKQKYLPSMAQLKTVGCWALTEPDYGSDASSLKTSATKVPGGWHLDGQKRWIGNSTFADVLIILARNADTKQLNGFIVKKGAPGLKATKIQNKIGLRMVQNGDILLNKVFVPDEDRLTGIDSFQDINKVLGMSRVMVTWQPIGVAMGVYDMCHRYLGERKQFGAPLAAFQLNQEKLVRMLGDIQAMVLVGWRLCKLYESGKMTPGHASLGKAWTSTKAREVASVGRELLGGNGILADFLVAKAFCDLEPIFTYEGTYDINSLVTGREITGTASFKPAVLVKSRL

SEQ ID NO: 4597 - protein, 433 aa, Zea mays
MGSLGGSAGAGDGGKVGLPALDVTLAFPQATPASLFPPAVSDYYQFDDLLTDEEKALRKKVRGIMEKEIAPIMTEYWEKAEFPFHAIPSLASLGLAGGTIKGYGCPGLSLTASAISIAEVARVDASCSTFILVHSSLAMSTIALCGSEAQKQKYLPSLTQFKTIGCWALTEPDYGSDASSLRTAATKVPGGWHLDGQKRWIGNSTFADVLIILARNADTNQLNGFIVKKGAPGLKATKIENKIGLRMVQNGDIILNKVFVPEEDRLTGINSFQDINKVLAMSRIMVAWQPIGISMGVYDICHRYLKERKQFGAPLAAFQLNQEKLVRMLGNIQAMLLVGWRLCKLYESGKMTPGRSSLGKAWTSKKAREVVSLGRELLGGNGILVDFLVAKAFCDVEPIFSYEGTYDINSLVAGREITGIASFKPAVSAKSRL

SEQ ID NO: 4598 - protein, 433 aa, Pennisetum glaucum
MGSLGGGGGAGAGGKVGLPALDVALAFPQATPASLFPPAVSDYYQFDDLLTDEEKALRKKVRGIMEKEIAPITTEYWEKAEFPFHAIPNLASLGLAGGTIKGYGCPGLSITASAISIAEVARVDASCSTFILVHSSLAMSTIALCGSEAQKQKYLPSLSQFKTVGCWALTEPDYGSDASSLRTAATKVPGGWHLDGQKRWIGNSTFADVLIILARNADTNQLNGFIVKKGAPGLKATKIENKIGLRMVQNGDIILNKVFVSEEDRLTGINSFQDINKVLAMSRIMVAWQPIGISMGVFDICHRYLKERKQFGAPLAAFQLNQEKLVRMLGNIQAMLLIGWRLCKLYETSKMTPGHASLGKAWTSRKAREVVSLGRELLGGNGILADFLVAKAFCDLEPIFSYEGTYDINSLVTGREITGIASFKPAVLTKSRL

SEQ ID NO: 4599 - protein, 430 aa, Oryza sativa
MGSLAGGGGGGKVGLPALDVALAFPQATTASQFPPAVSDYYQFDDLLTDEEKTLRKKVRGIMEREIAPIMTEYWEKAEFPFHAIPKLATLGLAGGTTKGYGCPGLSLTASAISVAEVARVDASCSTFILVHSSLAMSTIALCGSEAQKQKYLPSLTQFRTIGCWALTEPDYGSDASSLRTAATKVPGGWHLDGQKRWIGNGTFADVLIILARNSDTNQLNGFIVKKGAPGLKCTKIENKIGLRMVQNADIVLNKVFVPDEDRLTGINSFQDINKVLAMSRIMVAWQPIGISMGVFDMCHRYLKERKQFGVPLAAFQLNQEKLVRMLGNIQAMLLVGWRLCKLYESGKMTPGHASLGKAWTSKKAREVVSLGRELLGGNGILADFLVAKAFCDLEPIFSYEGTYDINSLVTGREITGIASFKPAALTKSRL

SEQ ID NO: 4600 - protein, 423 aa, Setaria italica
GAGAKVGLPALDVTLAFPQATPASLFPPAVSDYYQFDDLLTDEDKALRKKVRGIMEKEIAPIMPEYWEKAEFPFHAIPKLATLGLAGGTTKGYGCPGLSLTASAISTAEVARVDASCSTFILVHASLVMPTIDLCGSEVQKQKYLPSLAEFKTLGCWALTEPDYGSDASSLRTAATKVPGGWHLDGQKRWIGNSTFADMLIILARNADTNQLNGFIVKKGAPGLKATKIENKIGLRMVQNGDIVLNKVFVPEEDRLPGINSFKDINKVFAMSRVMVAWQPIGISMGVFDMCHRYLKERKQFGAPLAAFQLNQEKLVRMLGNIQAMVLVGWRLCKLYESGKMTSGHSSLGKAWTSRKAREVVSLGRELLGGNGILADFLVAKAFCDLEPIFSYEGTYDINSLVTGREITGVASFKPAMLAKSRL

SEQ ID NO: 4601 - protein, 436 aa, Saccharum officinarum
MAGKRVTGGVGRDEDGAKVGLPSLDLSLAFPQATPASIFPPSASDYYQFDDLLTSEERSIRKKVRSIVEKEIAPIMAEYWEKAEFPFHAIPKLASLGVAGGTIKGYGCPGLSITASAVTMAEMARVDASCSTFILVHSSLAMVTIALCGSEAQKQKYLPSLAQLTTVGCWALTEPNYGSDASSLRTTATKAPGGWHIDGQKRWIGNSTFADVLVVLARNADTQQLNGFIVRKGAPGLKATKIENKIGLRMVQNGDIVFNKVFVPEEDRLPGITSFQDISKVLAISRIMVAWQPIGISMGVFDMCHRYLKERKQFGVPLASFQLNQEKLVRMLGNVQSMLLVGWRICKLYESGKMTPGHASLGKAWNSRMAREVVSLGRELLGGNGILADFLVAKAFCDLEPIYSYEGTYDINSLVTGREITGIASFKPAALAKARL

SEQ ID NO: 4602 - protein, 427 aa, Festuca arundinacea
  misc_feature (134)..(134): Xaa can be any naturally occurring amino acid
  misc_feature (426)..(426): Xaa can be any naturally occurring amino acid
ARGLLLHYYYSTSIGRSCSGPRTSSPRALGCAADMGSLRGGGGGAEGKSEGGGKVGLPALEVSLAFPQATPASLFPPAVSDYYQFDDLLTDEEKALRKKVRAISEKEIAPIMTEYWEKAEFPFHAIPKLATLGXAGSTTKGYGCPGLSITASAISIAEVARVDASCSTFILVHSSLAMSTIALCGSEAQKQKYLPSLAQLKTVGCWALTEPDYGSDASALKTSATKVPGGWQLDGQKRWIGNSTFADVLVILARNADTKQLNGFIVKKGAPGLKATKIQNKIGLRMVQNGDILLNKVFVPEEDRLTGINSFQDISKVLAMSRIMVAWQPIGISMGVYDMCHRYLQERKQFGAPLAAFQLNQEKLVRMLGNIQAMVLVGWRLCKLYESGKMTPGHASLGKAWISSKSREVVSLGRELLGGNGILADXL

SEQ ID NO: 4603 - protein, 433 aa, Oryza sativa
MAGKQGDGREEDGAKVGLPALDISLAFPQATPASIFPPSASDYYQIDDLLTTEEQSIRKNVRAIMEKEIAPIMATYWEKAEFPFHAIPKLSSLGVAGGTIKGYGCPGLSITASAITMAEIARVDASCSTFILVHSSLAMVTIALCGSEVQKQKYLPSLAQLTAVGCWALTEPNHGSDASSLITTATKVPGGWHIDGQKRWIGNSTFADVLVVLARNANTKQLNGFIVRKGAPGLKATKIENKIGLRMVQNGDIVFNKVFVPEEDRLPGVNSFQDISKVLAISRVMVAWQPIGISMGVFDVCHRYLKERKQFGVPLVAFQLNQEKLVRMLGNIQAMLLVGWRLCKLYESGKMTPGHASLGKGWTSRMAREVVSLGRELLGGNGILADFLVAKAFCDLEPIYSYEGTYDINSLVTGREITGIASFKPAALAKARL

SEQ ID NO: 4604 - protein, 437 aa, Sorghum bicolor
MAEKRVTGGDRREEDRAKVGLPALDLSLAFPQATPASIFPPSASDYYQFDDLLTSEERSIRKKVRGIVEKEIAPIMAAYWEKAEFPFDAIPKLASLGVAGGTIKGYGCPGLSITASAVTMAEMARVDASCSTFILVHSSLAMVTIALCGSEAQKQKYLPSLAQLTTVGCWALTEPNYGSDASSLRTTASKAPGGWHIDGQKRWIGNSTFADVLVVLARNADTQQLNGFIVRKGAPGLKATKIENKIGLRMVQNGDIVFNKVFVPEEDRLPGITSFKDISKVLAISRIMVAWQPIGISMGVFDMCHRYLKERKQFGVPLASFQLNQEKLVRMLGNIQSMLLVGWRLCKLYESGKMTPGHASLGKAWNSRMAREVVSLGRELLGGNGILADFLVAKAFCDLEPIYSYEGTYDINSLVTGREITGIASFKPAAALAKARL

SEQ ID NO: 4605 - protein, 426 aa, Pennisetum glaucum
GGGGDGAKVRLPALDVALAFPQATPASLFPPAVSDYYQFDDLLTDENKALRKKVRGIMEEEIAPIMTEYWEKAEFPFHYIPKLATLGLAGGTTKGYGCPGLSLTAIAISTAEVARVDASCSTFILVHASLVMPTIDLCGSEAQKQKYLPSLAQFKSLGCWALTEPDNGSDASFLMTTATKVPGGWHLDGQKRWIGNSTFADMFIILARNADTNQLNGFIVKKGAPGLKATKIENNIGLRMVQNGDIVLNEVFVPEEDRLPGINSFKDINKVFAISRVTGTWQLIGISMGVFDMCHRYLKERKQFGAPLAAFQLNQEKLVRMLGNIQAMVLVGWRLCKLYESGKMTSGHSSSGKAWISRMAREVVSLGRELLGGNGILTDFLVAKAFCDLEPIFSYEGTYDINSLVTGREITGVASFKPAMLAKSRL

SEQ ID NO: 4606 - protein, 436 aa, Zea mays
MAGKRVTGRDGQDEGGAKVGLPAMDLSLAFPQATPASIFPPSASDYYQSDDLLTSEERSIRMKVRGIMEKEIAPIMSAYWEKAEFPFNAIPKLASLGVAGGTIKGYGCPGLSITASAVTMSEIARVDASCSTFILVHSSLAMVTIALCGSEAQKQKYLPSLAQLTTVGCWALTEPNYGSDASSLRTIATKAPGGWHIDGQKRWIGNSTFADVLVVLARNADTQQLNGFIVRKGAPGLKATKIENKIGLRMVQNGDIVLNKVFVPDEDRLPGINSFQDISKVLAISRIMVAWQPVGISMGVFDMCHRYLKERKQFGVPLAAFQLNQEKLARMLGNVQSMVLVGWRLCKLYESGKMTPGHASLGKAWNSRTAREVVSLGRELLGGNGILADFLVAKAFCDLEPIYSYEGTYDINSLVTGREVTGIASFRPAAPAKARL

SEQ ID NO: 4607 - protein, 440 aa, Aristolochia fimbriata
MAAFSSSLIQGGNSKEQANSSVGLPALDVSKAFPQATPASNFPPAVSDYYQFDDLLTPEEQALRKKVQVIMEKEIAPIMTEYWEKAEFPFHVIPKLASLRIAGGTIKGYGCPGLSITGSAITVAEVARVDASCSTFILVHSSLAMLTIALCGSEEQKQKYLPSLANFDTVACWGLTEPDCGSDASSLRTTATKVDGGWLLDGQKRWIGNSTFADVLVIFARNTTTNQINGFIVKKGAPGLKATKMQNKIGLRMVQNGDILLQKTFVPDEDRLPGVNSFQDTSKVLAVSRVMVAWQPIGISMGVFDMCHRYLRERKQFGAPLAAFQLNQEKLVRMLGNIQAMVLVGWRLCKLYESQKMTAGHASMGKSWITLKARETVSLGRELLGGNGILADFLVAKAFCDLEPIYTYEGTYDINSMVTGRELTGIASFKPAVLAKQSRL

SEQ ID NO: 4608 - protein, 862 aa, Triticum aestivum
RHFKQERENVWKDNPRRPPASAGEGGEGNGWQPFATENLAFEAYYKGQQIVPEEEWDAFMSMLRKPLPAAFRINASSQFCQDICSQLENDFRKSLETEVNDDHEKEAIRPLAWYPGNLAWHLNFSRMQLRRNQALESFHEFLKQENEVGNITRQEAVSMVPPLFLNVQPDHHILDMCAAPGSKTFQLLEMIHQSTKPGVLPTAMVVANDVDVQRCNLLIHQTKRMCTANLIVTNHEAQNFPGCSLAKFCPEAYIDESKPQRLEFDRILCDVPCSGDGTARKAPDMWRTWNIGMGNGLHRLQVEIAMRGIGLLKVGGRMVYSTCSMNPVENEAVVGEILRRCGDSVELLDVSNELPELIRRPGLKTWKVRDRASWLGSHNDVLHYRKNAILPSMFPSGKGTTDSCTAGGSVEVNINAVDADMNESGDMVEGKEETKIATNDSNNGDNGKTEEIKQDESESVKVSRGSNEKTDSASIVTEHSNLPLHRCMRIIPHDQNSGAFFIAVLQKLSPLNESLVVEVMKGERSTSKDKALKCSNGQGSDTVPAEEISVQQPGVDDTHVLVEQQNRDMDTEISKDKSSEEAKVVAGEVQNDQATRRDKRKTQNQGRWRGVDPVIFFKDEATIRSIVSFYGIKDSFTLEGHLVTRNPDTNHVKRIYYVSKSVKEVLDLNLKVGERLKITSLGLKIFERQSSKEGSPCTFRLSSEGLPLLLPYITKQILYASAIDFQHLLQYRIIKFPDFVDVKFGEQASALLQGCCVVILREGHEDLESIGMDPSAIAVVCWKGKTNLCVMVTPMDGRELLERISFRFGLKIPKLDDGKPDLKCDDGSDEQPDGGAETVDPDCVPESKASEDMDISDVKDTE

SEQ ID NO: 4609 - protein, 902 aa, Brachypodium distachyon
MGGGRKRGRSQRRHFKQGRENVWKDNPQRPPAGGGGGDQGAAGSGEGREGNDSWQPFSTENPAFEAYYKEQQIVPEEEWNDFMSMLRKPLPAAFRINASCQFYQDICSQLENDFRKSLETEVSDEHEKDAIRPLPWYPGNLAWHLNFSRMQLRRNQALESFHEFLKQENEVGNITRQEAVSMVPPLFLNVQPDHHILDMCAAPGSKTFQLLEMIHQSTKPGVLPNAMVVANDVDVQRCNLLIHQTKRMCTANLIVTNHEAQNFPGCSLTKFCPETYLDESKPQRLEFDRVLCDVPCSGDGTVRKAPDMWRKWNAGMGNGLHRLQVEIAMRGIALLKVGGRMVYSTCSMNPVENEAVVAEILRRCGDSVELLDVSNELPELVRRPGLSTWKVGICVSLSCIFLVYGISFCPSGVRDRGSWLGTHEDVLHYRKNAISPSMFPSGKGSTDNRKVGGSGELNMDVADADMDSGDMVERKEESRIAINGSNNGETNIEEINQVESESGEVPRDSEKKSDSTSICTEHSNLPLHRCMRIVPHDQNSGAFFIAVLQKLSVLNENQVVEVMKGEHSILKDRAVKPVDSPGSDKVPSEEIPVHQQGVEGSHVSGKQQNGDMDAISKDKASEEGSVIVNETQNDEAATRDKRKTQNQGRWRGVDPVIFFRDEATITSIVSFYGIKDSFTLEGHLVTRNPDTNHVKRIYYVSKSVQDVLELNVKVGERLKITSLGLKIFERQSSKDGSPCTFRLSSEGLPLLLPYITKQILYASALDFQHLLQYRIIKFPDFVDAKFGEEASALLPGCCVVVLREGHQHIDSIATDPSAIAIVCWKGKTNLCVMVSPLDGKELLERVSLRFGLKVPKADDRKTKLKVDGSDEQLDCGAETVDPECKPESKASDMDISDVKEVE

SEQ ID NO: 4610 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDATLGEGASESLHVKDYKY

SEQ ID NO: 4611 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDATLGEGASESLHVKDYKY

SEQ ID NO: 4612 - protein, 358 aa, Leymus cinereus x Leymus triticoides
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATQNLNAMNKLQTKKPWNLSFSFGRALQQSTLKAWSGKAENEEKARKAFLVRCKANSEATLGTYKGDATLGEGASESLHVKDYKY

SEQ ID NO: 4613 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLETKKPWNLSFSFGRALQQSTLKAWAGKVENEEKARKAFLVRCKANSEATLGTYKGDATLGEGASESLHVKDYKY

SEQ ID NO: 4614 - protein, 358 aa, Pseudoroegneria spicata
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGPTEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKAENEEKARTAFLVRCKANSEATLGTYKGDATLGEGASESLHVKDYKY

SEQ ID NO: 4615 - protein, 358 aa, Secale cereale
  misc_feature (23)..(23): Xaa can be any naturally occurring amino acid
MSAYCGKYKDELIKNAAYIGTPXKGILAADESTGTIGKRFASINVENVEDNRRALRELLFCTPGALQYLSGVILFEETLYQSTKGGKPFVDILKEGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 4616 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 4617 - protein, 223 aa, Hordeum vulgare
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKPSTTSMSSLRAPS

SEQ ID NO: 4618 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 4619 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 4620 - protein, 358 aa, Triticum aestivum
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEVVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 4621 - protein, 356 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDANLAEGASREPPTSKD

SEQ ID NO: 4622 - protein, 341 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDA

SEQ ID NO: 4623 - protein, 341 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGNNGETTTQGFDDLGKRCAKYYEAGARFAKWRAVLKIGPTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLETKKPWNLSFSFGRALQQSTLKAWAGKVENEEKARKAFLVRCKANSEATLGTYKGDA

SEQ ID NO: 4624 - protein, 358 aa, Avena sativa
MSAYCGKYKDELIKNAAYIGTPGKGILAADESTGTIGKRFASINVENVEDNRRALRELLFCTPGALQYISGVILFEETLYQSTKAGKPFVEVLKEANVLPGIKVDKGTIELAGTDKETTTQGHDDLGKRCAKYYEAGARFAKWRAVLKIGPNEPSQLSIDQNAQGLARYAIICQENGLVPIVEPEILVDGPHDIDRCAYVTEVVLAACYKALNDQHVLLEGTLLKPNMVTPGSDSKKVAPEVIAEYTVRTLQRTVPPAVPAIVFLSGGQSEEEATKNLNAMNKLQTKKPWSLSFSFGRALQQSTLKAWGGKAENVANAQKAFLVRCKANSEATLGKYQGDATLGEGASESLHVKDYKY

SEQ ID NO: 4625 - protein, 341 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDA

SEQ ID NO: 4626 - protein, 358 aa, Brachypodium distachyon
MSAYCGKYKDELIKNAAYIGTPGKGILAADESTGTIGKRFASINVENVEDNRRALRELLFCTPGALQYISGVILFEETLYQSTKAGKPFVDVLKENNVLPGIKVDKGTIEIAGTDKETTTQGHDDLGKRCAKYYEAGARFAKWRAVLKIGPNEPSQLSIDLNAQGLARYAIICQENGLVPIVEPEILVDGPHDIDRCAHVTEVVLAACYKALNEHHVLLEGTLLKPNMVTPGSDSKKVAPEVIAEYTVRTLQRTVPPAVPAIVFLSGGQSEEEATLNLNAMNKLQTKKPWFLSFSFGRALQQSTLKAWAGKEENIEKARQAFLVRCKSNSEATLGTYKGDATLAEGASESLHVKDYKY

SEQ ID NO: 4627 - protein, 358 aa, Oryza sativa
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 4628 - protein, 358 aa, Panicum virgatum
MSAYCGKYKDELIKNAAYIGTPGKGILAADESTGTIGKRLSSINVENVEENRRALRELLFCCPGALQYISGVILFEETLYQKTKDGKPFVDVLKEGGALPGIKVDKGTIEVAGTDKETTTQGHDDLGKRCAKYYEAGARFAKWRAVLKIGPNEPSQLAIDLNAQGLARYAIICQENGLVPIVEPEILVDGPHDIERCAYVTEVVLAACYKALNEHHVLLEGTLLKPNMVTPGSDSKKVTPEVIAEYTVRTLQRTVPAAVPAIVFLSGGQSEEEATLNLNAMNKLNTKKPWSLSFSFGRALQASTLKAWLGKVENVEKARAAFLARCKANSEATLGTYKGDAAAGEGVSESLHVKDYKY

SEQ ID NO: 4629 - protein, 358 aa, Oryza sativa
MSAYCGKYKDELIKNAAYIGTPGKGILAADESTGTIGKRFASINVENVEDNRRAFRELLFCTPGALQYISGVILFDETLYQKTKDGKPFVDVLKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 4630 - protein, 358 aa, Sorghum bicolor
MSAYCGKYKDELIKNAAYIGTPGKGILAADESTGTIGKRLSSINVENIEENRRALRELLFCAPGALQYLSGVILFEETLYQKTKDGKPFVDVLNEGGVLPGIKVDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEMVLAACYKALNEHHVLLEGTLLKPNMVTPGSDSKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 4631 - protein, 358 aa, Panicum virgatum
MSAYCGKFKDELIKNAAYIGTPGKGILAADESTGTIGKRLSSINVENIEENRRALRELLFCAPGALQYLSGVILFEETLYQKTKDGKPFVDVLKEGGVLPGIKVDKGTIEVAGTNKETTTQGHDDLGKRCAKYYEAGARFAKWRAVLNIGPNQPSQLAIDLNAQGLARYAIICQENGLVPIVEPEILVDGPHDIERCAYVTEMVLAACYKALNEHHVLLEGTLLKPNMVTPGSDAKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 4632 - protein, 358 aa, Saccharum officinarum
MSSYCGKYKDELIKNAAYIGTPGKGILAADESTGTIGKRLSSINVENIEENRRALRELLFCAPGALQYLSGVILFEETLYQKTKDGKPFVDVLNEGGVLPGIKVDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEMVLAACYKALNEHHVLLEGTLLKPNMVTPGSDSKKVAPEVIAEYTVRALQRTVPAAVPAIVFLSGGQSEEEATLNLNAMNKLNTKKPWSLSFSFGRALQASTLKAWAGKEENVEKARAAFLTRCKANSEATLGTYKGDAAAGEGVSESLHVKDYKY

SEQ ID NO: 4633 - protein, 358 aa, Oryza sativa
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 4634 - protein, 338 aa, Panicum virgatum
MSAYCGKYKDELIKNAAYIGTPGKGILAADESTGTIGKRLSSINVENIEENRRALRELLFCTPGALQYLSGVILFEETLYQKTKDGKPFVDVLKEGGVLPGIKVDKGTIEIAGTNKETTTQGHDDLGKRCAKYYEAGARFAKWRAVLNIGPNQPSQLAIDLNAQGLARYAIICQENGLVPIVEPEILVDGPHDIERCAYVTEMVLAACYKALNEHHVLLEGTLLKPNMVTPGSDAKKVAPEVIAEYTVRALQRTVPAAVPAIVFLSGGQSEEEATLNLNAMNKLNTKKPWSLSFSFGRALQRAPSRPGLARRRMWRKARTAFLTSARPTQRPPLARTR

SEQ ID NO: 4635 - protein, 358 aa, Manihot esculenta
MSCFKGKYADELIANAAYIGTPGKGILAADESTGTIGKRLASINVENVEDNRRALRELLFTTPGALQYLSGVILFEETLYQKSKSGKPFVDILKEGGVLPGIKVDKGTVELAGTNGETTTQGLDGLAQRCQKYYEAGARFAKWRAVLKIGPNEPSQLAINENANGLARYAIICQENGLVPIVEPEILVDGPHDINKCAEVTERVLAACYKALNDHHVLLEGTLLKPNMVTPGSESKKVAPEVIAEYTVRALQRTVPAAVPAIVFLSGGQSEEEATLNLNAMNKLKTKKPWSLSFSFGRALQQSTLKAWAGKEENVKKAQDSFIVRCKANSEATLGTYKGDATLGEGASESLHVKDYKY

SEQ ID NO: 4636 - protein, 355 aa, Sorghum bicolor
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVAGTDKETTTQGHDDLGKRCAKYYEAGARFAKWRAVLKIGPNEPSQLAIDLNAQGLARYAIICQENGLVPIVEPEILVDGPHDIDRCAYVTEVVLAACYKALNEHHVLLEGTLLKPNMVTPGSDSKKVTPELIAEYTVRTLQRTVPAAVPAVVFLSGGQSEEEATLNLNAMNKLNTKKPWSLSFSFGRALQASTLKAWAGKVENIEKARAAFLARCKANSEATLGTYKGDAAADTESLHVKDYKY

SEQ ID NO: 4637 - protein, 358 aa, Manihot esculenta
MSCYKGKYADELIANAAYIGTPGKGILAADESTGTIGKRLASINVENVEDNRRALRELLFTTPGALQYLSGVILFEETLYQKSKSGKPFVDILKEGGVLPGIKVDKGTVELAGTNGETTTQGLDGLAQRCQKYYEAGARFAKWRAVLKIGPNEPSQLAINENANGLARYAIICQENGLVPIVEPEILVDGPHDINKCAEVTERVLAACYKALNDHHVLLEGTLLKPNMVTPGSESKKVAPEVIAEYTVLALQRTVPAAVPAIVFLSGGQSEEEATLNLNAMNKLKTKKPWSLSFSFGRALQQSTLKAWAGKEENVKKAQDAFIVRCKANSEATLGAYKGDATLGEGAAESLHVKDYKY

SEQ ID NO: 4638 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 4639 - protein, 358 aa, Elaeis guineensis
MSAYCGKYHDELIKNAAYIGTPGKGILAADESTGTIGKRLASINVENVEENRRALRELLFCTPGALQYLSGVILFEETLYQKTKDGKPFVEVLKEGGVLPGIKVDKGTIELAGTNGETTTQGHDDLAKRCQKYYEAGARFAKWRAVLKIGPTEPSQLAIDLNAHGLARYAIICQENGLVPIVEPEILVDGPHDIKRCADVTERVLAACYKALNDHHVLLEGTLLKPNMVTPGSESAKVAPEVVAEYAVRALQRTVPAAVPAIVFLSGGQSEEEATLNLNAMNKLGGKKPWSLSFSFGRALQQSTLKAWAGKVENVEKARAAFLARCKANSEATLGKYEGDAAGGEGVSESLHVKDYKY

SEQ ID NO: 4640 - protein, 358 aa, Zingiber officinale
MSAYCGQYHDELIANATYIGTPGKGILAADESTGTIGKRLASINVENVEENRRALRELLFLTPGALQYLSGVILFEETLYQKTADGKPFVDVLKEGGVLPGIKVDKGTVGLAGTNGETTTQGHDDLGKRCKKYYEAGARFAKWRAVLNIGPNEPSQLSIDANANGLARYAIICQENGLVPIVEPEILVDGSHDIEKCAYVTERVLAACYKALNDHHVLLEGTLLKPNMVTPGSESKKVAPEVVAEYTVRALQRTVPAAVPAIVFLSGGQSEEEATLNLNAMNKLKGKKPWSLSFSFGRALQQSTLKAWQGKAENVEKARTAFLGRCKANSEATLGVYKGDAAGGEGVSESLHVKDYKY

SEQ ID NO: 4641 - protein, 358 aa, Vitis vinifera
MTCYKGKYHDELIANAAYIGTPGKGILAADESTGTIGKRLASINVENVEGNRRALRELLFCTPGALQYLSGVILFEETLYQKTASGKPFVDVMKEGGVLPGIKVDKGTVVLTGTDGETTTQGLDGLGERCAKYYAAGARFAKWRAVLKIGPTEPSELAIHENAYGLARYAMICQENGLVPIVEPEILVDGPHDIEKCAYVTERVLAACYKALNDHHVLLEGTLLKPNMVTPGSEAKKVSPEVVAEYTVRTLQRTVPAAVPAIVFLSGGQSEEEATLNLNAMNKLKGKKPWNLSFSFGRALQQSTLKAWSGKEENVVKARGAFLVRCKANSEATLGTYKGDAKLGEGAAESLHVKDYKY

SEQ ID NO: 4642 - protein, 355 aa, Zea mays
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 4643 - protein, 358 aa, Elaeis guineensis
MSAYCGKYRDELIANAAYIATPGKGILAADESTGTIGKRLASINVENVEANRRALRELLFCTPGALQYLSGVILFEETLYQKTADGKPFVEVLKEGGVLPGIKVDKGTVELAGTNGETTTQGHDDLGKRCAKYYEAGARFAKWRAVLKIGPTEPSQLAINENANGLARYAIICQENGLVPIVEPEILVDGPHDINRCAEVTERVLAACYKALNDHHVLLEGSLLKPNMVTPGSDSKKVAPKVVAECTVRALLRTVPAAVPAIVFLSGGQSEEEATLNLNAMNQLKGKKPWSLSFSFGRALQQSTLKTWAGKQENVEKARAAFLSRCKANSEATLGAYEGDAAKGEGVSESLHVKDYKY

SEQ ID NO: 4644 - protein, 359 aa, Cynodon dactylon
MAGSAYNGKYAEELIKNAAYIGTPGKGILAADESTGTIGKRLSSINVENVEENRRALRELLFCTPGALQYLSGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIERCAYVTEMVLAACYKALNEHHVLLEGTLLKPNMVTPGSDAKKVTPEVIAEYTVRALQRTVPAAVPAIVFLSGGQSEEEATLNLNAMNKLNTKKPWALSFSFGRALQASTLKAWAGKEENLEKARAVFLTRCKANSEATLGTYQGGSAAGEALESLHVKDYKY

SEQ ID NO: 4645 - protein, 281 aa, Platanus occidentalis
MSCYKGKYHDELIANAAYIGTPGKGILAADESTGTIGKRLSSINVENVESNRRALRELLFCAPGALQYLSGVILFEETLYQKTASGKPFVDVLKEGGVLPGIKVDKGTVELAGTNGETTTQGLDGLAQRCQQYYAAGARFAKWRAVLKIGPNEPSQLAINENANGLARYAIICQENGLVPIVEPEILVDGPHDIDRCADVTERVLAACYKALNDHHVLLEGTLLKPNMVTPGSDAKKVTPEVVAEYTVRALQRTMPPAVPAVVFLSGGQSEEEATLEPEMP

SEQ ID NO: 4646 - protein, 295 aa, Saccharum officinarum
MLTWCPQYISGVILFEETLYQKTKDGKPFVDVLKEGGVLPGIKVDKGTIEVAGTDKETTTQGHDDLGKRCAKYYEAGARFAKWRAVLKIGPNEPSQLAIDLNAQGLARYAIICQENGLVPIVEPEILIDGPHDIDRCAYVTETVLAACYKALNEHHVLLEGTLLKPNMVTPGSDSKKVTPEVIAAYTVRTLQRTVPAAVPAVVFLSGGQSEEEATLNLNAMNKLSTKKPWSLSFSFGRALQASTLKAWAGKVENIEKARAAFLARCKANSEATLGTYKGDAAADTESLHVKDYKY

SEQ ID NO: 4647 - protein, 357 aa, Platanus occidentalis
SCFKGKYADELITNAAYIGTPGKGILAADESTGTIGKRLSSINVENVETNRRALRELLFCTPGALQYLSGVILFEETLYQKTASGKPFVEVMKEGGVLPGIKVDKGTVELAGTNGETTTQGLDGLAQRCQQYYAAGARFAKWRAVLKIGPTEPSQLAINENANGLARYAIICQENGLVPIVEPEILVDGPHDIDRCADVTERVLAACYKALNDHHVLLEGTLLKPNMVTPGSDAKKVSPEVIAEYTVRALQRTVPAAVPAVVFLSGGQSEEEATRNLNAMNKLKGKKPWSLSFSFGRALQQSTLKAWAGKEENVKKARAAFLTRCKANSEATLGTYKGDAVLGEGVSESLHVKDYKY

SEQ ID NO: 4648 - protein, 358 aa, Musa acuminata
MSAYCSQFHDELIANAAYIGTPGKGILAADESTGTIGKRLASINVENVEENRRALRELLFCTPGSLQYLSGVILFEETLYQKTADGKLFVEVLKEGGVLPGIKVDKGTVELAGTNGETTTQGHDDLGKRCKKYYEAGARFAKWRAVLKISPNEPSQLSIDANANGLARYAIICQENGLVPIVEPEILVDGPHDIAKCAEVTERVLAACYKALNDHHVLLEGSLLKPNMVTPGSESKKVAPEVVAEYTVRALQRTVPAAVPAIVFLSGGQSEEEATLNLNAMNKLQGKKPWSLSFSFGRALQQSTLKAWAGKVENVEKARTAFLTRCKANSEATLGTYKGDAAGGVGVSESLHVKDYKY

SEQ ID NO: 4649 - protein, 358 aa, Citrus clementina
MSCFKGKYADELIKNAAYIGTPGKGILAADESTGTIGKRLSSINVENVESNRRALRELLFCTPGALQYLSGVILFEETLYQKTAAGKPFVDVLKEGGVLPGIKVDKGTVELAGTNGETTTQGLDGLAQRCQKYYEAGARFAKWRAVLKIGPNEPSQLAINENANGLARYAIICQENGLVPIVEPEILVDGPHDIKKCADVTERVLAACYKALNDHHVLLEGTLLKPNMVTPGSEAPKVTPDVIAEHTVRALQRTMPAAVPAVVFLSGGQSEEEATRNLNAMNQLKTKKPWSLSFSFGRALQQSTLKAWAGKEENVQKAQAAFLVRCKANSEATLGTYKGDAQLGEGAAESLHVKDYKY

SEQ ID NO: 4650 - protein, 358 aa, Cucurbita pepo
MSSFKSKYQDELIANAAYIGTPGKGILAADESTGTIGKRLASINVENVESNRRALRELLFLTPGALQYLSGVILFEETLYQKTAAGKPFVDVLKEGGVLPGIKVDKGTVELAGTNGETTTQGLDGLAQRCQKYYEAGARFAKWRAVLKIGPTEPSQLSINENAYGLARYAAICQENGLVPIVEPEILVDGSHSIDKCAEVTERVLAACYKALNDHHVLLEGTLLKPNMVTPGSEAAKVAPEVIAEYTVRALQRTVPAAVPAIVFLSGGQSEEEATLNLNAMNKLKGKKPWSLSFSFGRALQQSTLKAWAGKDDNVEKARAAFLTRCKANSEATLGTYKGDAVIGEGAAESLHEKDYKY

SEQ ID NO: 4651 - protein, 358 aa, Unknown
  Sequence found in Organisms: Citrus sinensis, Citrus sinensis
MSCFKGKYADELIKNAAYIGTPGKGILAADESTGTIGKRLSSINVENVESNRRALRELLFCTPGALQYLSGVILFEETLYQKTAAGKPFVDVLKEGGVLPGIKVDKGTVELAGTNGETTTQGLDGLAQRCQKYYEAGARFAKWRAVLKIGPNEPSQLAINENANGLARYAIICQENGLVPIVEPEILVDGPHDINKCADVTERVLAACYKALNDHHVLLEGTLLKPNMVTPGSEAPKVTPDVIAEHTVRALQRTMPAAVPAVVFLSGGQSEEEATRNLNAMNQLKTKKPWSLSFSFGRALQQSTLKAWAGKEENVQKAQAAFLVRCKANSEATLGTYKGDAQLGEGAAESLHVKDYKY

SEQ ID NO: 4652 - protein, 358 aa, Cucumis sativus
MSSFKSKYQDELIANATYIGTPGKGILAADESTGTIGKRLASINVENVESNRRALRELLFLTPGALQYLSGVILFEETLYQKTAAGKPFVDVLKEGGVLPGIKVDKGTVELAGTNGETTTQGLDGLAQRCQKYYEAGARFAKWRAVLKIGPTEPSQLSINENAYGLARYAAICQENGLVPIVEPEILVDGPHSIEKCAEVTERVLAACYKALNDHHVLLEGTLLKPNMVTPGSEAAKVAPEVIAEYTIRALQRTVPAAVPAIVFLSGGQSEEEATLNLNAMNKLKGKKPWSLSFSFGRALQQSTLKAWAGKEENVEKARAAFLTRCKANSEATLGTYKGDAELSEGAAESLHVKDYKY

SEQ ID NO: 4653 - protein, 358 aa, Aristolochia fimbriata
MSAYRGKYADELIKNAAYIGTPGKGILAADESTGTIGKRLSSINVENVETNRRALRELLFCTPGALQYLSGVILFEETLYQKTASGKPFVDVMKEGGVLPGIKVDKGTVELAGTNGETTTQGHDGLAQRCQQYYAAGARFAKWRAVLKIGPNEPSQLAINENANGLARYAIICQENGLVPIVEPEILVDGPHDIKRCAEVTERVLAACYKALNDHKVLLEGTLLKPNMVTPGSESKKVAPEVVAEYTVSALQRTVPAAVPAIVFLSGGQSEEEATLNLNAMNQYQGKKPWSLSFSFGRALQQSTLKTWAGKEENVEKARAAFLSRCKANSEATLGTYKGDAAKGEGVSESLHVKDYKY

SEQ ID NO: 4654 - protein, 358 aa, Chelidonium majus
MSCYKGKYHDELIANAAYIGTPGKGILAADESTGTIGKRLSSINVENVESNRRALRELLFCTPGALQYLSGVILFEETLYQKTAAGKPFVDVLKEGGVLPGIKVDKGTVELAGTNGETTTQGLDGLAQRCQQYYAAGARFAKWRAVLNIGPNEPSQLAINENANGLARYAIICQENGLVPIVEPEILVDGSHDIDRCADVTERVLAACYKALNDHHVLLEGTLLKPNMVTPGSDSKKVSPDVIAEYTVRTLQRTMPAAVPAVVFLSGGQSEEEATLNLNAMNKLNAKKPWSLSFSFGRALQQSTLKTWGGKDENLEKAQAAFLARCKANSEATLGTYKGDAAKVEGASESLHVKDYKY

SEQ ID NO: 4655 - protein, 358 aa, Humulus lupulus
MSCFKSKYQDELIANAAYIGTPGKGILAADESTGTIGKRLSSINVENVESNRRALRELLFTTPGGLECLSGVILFEETLYQSTAAGKPFVDVLKEGGVLPGIKVDKGTVELAGTNGETTTQGLDGLGARCQKYYEAGARFAKWRAVLKIGPNEPSQLSINENANGLARYAAICQENGLVPIVEPEILVDGPHSIEQCADVTERVLAACYKALNDHHVLLEGTLLKPNMVTPGSEAKKVAPEVIAEYTVRALQRTVPPAVPAIVFLSGGQSEEEATVNLNAMNKLQTKKPWSLSFSFGRALQQSTLKAWAGKEENIPKAQAAFLTRAKANSQATLGTYKGDATLGEGASESLHVKGYKY

SEQ ID NO: 4656 - protein, 358 aa, Curcuma longa
MSAYCGQYHDELIATAAYIGTPGKGILAADESTGTIGKRLASINVENVEENRRALRELLFLTPGALQYLSGVIFFEETLYQKTADGTPFVDVLKKGGVIPGIKVDKGTVELAGTNGETTTQGHDDLGKRCKKYYEAGARFAKWRAVLNIGPNEPSQLSIDANANGLARYAIICQENGLVPIVEPEILVDGPHDIAKCADVTERVLAACYKALNDHHVLLEGTLLKPNMVTPGSESAKVAPEVIAEFTVRALQRTVPPAVPAIVFLSGGQSEEEATLNLNAMNKLKGKKPWSLSFSFGRALQKSTLKAWQGKAENVEKARIAFLARCKANSEATLGVYKGDAAGGEGVSESLHVKDYKY

SEQ ID NO: 4657 - protein, 358 aa, Prunus persica
MSAFRGKYADELIANAAYIGTPGKGILAADESTGTIGKRFASINVENVESNRRALRELLFTAPDVLQYLSGVILFEETLYQKTASGKPFVDVLKEGGVLPGIKVDKGTVELAGTNGETTTQGLDGLAQRCQKYYEAGARFAKWRAVLKIGPNEPSQLSINENANGLARYAIICQENGLVPIVEPEILVDGPHDIEKCADVTERVLAACYKALNDHHVLLEGTLLKPNMVTPGSDAKKASPEVIAEYTVRALLRTTPAAVPAVVFLSGGQSEEEATLNLNAMNKLKGKKPWSLSFSFGRALQQSTLKAWAGKEENIGKAQAALLTRAKANSEATLGTYKGDAKLGEGAAESLHVKDYKY

SEQ ID NO: 4658 - protein, 358 aa, Aristolochia fimbriata
MSAYRGKYADELIKNAAYIGTPGKGILAADESTGTIGKRLASINVENVESNRRALRELLFCAPGALQYLSGVILFEETLYQKTASGKPFVDVLKEGGVLPGIKVDKGTVELAGTNGETTTQGHDGLAQRCQQYYAAGARFAKWRAVLKIGPYEPSQLAINENANGLARYAIICQENGLVPIVEPEILVDGPHDINRCAEVTERVLAACYKALNDHKVLLEGTLLKPNMVTPGSESKKVTPEVVAEYTVRALLRTVPAAVPAIVFLSGGQSEEEATLNLNAMNQFEGKKPWSLSFSFGRALQQSTLKTWQGKEENVGKARAALLSRCKANSEATLGKYKGDAATVEGASESLHVKDYKY

SEQ ID NO: 4659 - protein, 358 aa, Euonymus alatus
MSCFKGKYTDELIANAAYIGTPGKGILAADESTGTIGKRLASINVENVEANRRALRELLFTAPGALQCLSGVILFEETLYQNTAAGKPFVDVLKEGGVLPGIKVDKGTVELAGTNGETTTQGLDGLAQRCQKYYEAGARFAKWRAVLKIGPTEPSQLAINENANGLARYAIICQENGLVPIVEPEILVDGPHSIEKCADVTERVLAACYKALNDHHVLLEGTLLKPNMVTPGSDAPKVAPEVIAEHTVRALQRTVPAAVPAIVFLSGGQSEEEATVNLNAMNKLKGKKPWSLSFSFGRALQQSTLKAWAGKEENVKAAQAALLTRCKANSEATLGTYKGDSKLGEGASESLHVKDYKY

SEQ ID NO: 4660 - protein, 358 aa, Lippia dulcis
MSCYRGKYADELIANAAYIGTPGKGILAADESTGTIGKRLSSINVENVESNRRALRELLFTTPGALQYLSGVILFEETLYQSTAAGKPFVEVLKEGGVLPGIKVDKGTVELAGTNGETTTQGLDGLAQRCQKYYEAGARFAKWRAVLKIGPNEPSQLAINENANGLARYAIICQENGLVPIVEPEILVDGPHDINKCADVTERVLAACYKALNDHHVLLEGTLLKPNMVTPGSDAAKVAPEVIAEYTVRALQRTMPAAVPAVVFLSGGQSEEEATVNLNAMNKLKTKKPWSLSFSFGRALQQSTLKAWAGKEENVPKAQAAFLARAKANSEATLGTYQGSSSLSEGASESLHVKDYKY

SEQ ID NO: 4661 - protein, 358 aa, Malus domestica
MSAYRGKYADELIANAAYIGTPGKGILAADESTGTIGKRFASINVENVESNRRALRELLFTAPDVLQYLSGVILFEETLYQKTASGKPFVDVLKEGGVLPGIKVDKGTVELAGTNGETTTQGLDGLAQRCQKYYEAGARFAKWRAVLKIGPNEPSQLSIQENANGLARYAIICQENGLVPIVEPEILVDGPHSIDKCADVTERVLAACYKALNDHHVLLEGTLLKPNMVTPGSDAKKASPEVIAEYTVRALLRTTPAAVPAVVFLSGGQSEEEATLNLNAMNQLKGKKPWSLSFSFGRALQQSTLKAWAGKEENIPKAQAALLTRAKANSEATLGTYKGDAKLGEGAAESLHVKDYKY

SEQ ID NO: 4662 - protein, 358 aa, Persea americana
MSAFCGKYQDELIANAAYIGTPGKGILAADESTGTIGKRLASINVENVESNRQALRELLFCTPGALECLSGVILFEETLYQKTASGKPFVDVLNERGVLPGIKVDKGTVELAGTNGENTTQGLDGLAQRCQQYYSAGARFAKWRAVLKISPNEPSQLAINENANGLARYAIICQENGLVPIVEPEILVDGSHDIDRCADVTERVLAACYKALNDHHVLLEGTLLKPNMVTPGSDAKKVTPEVIAEYTVRALQRTTPAAVPAIVFLSGGQSEEEATLNLNAMNKLKGKKPWSLSFSFGRALQQSTLKTWAGKEENVKKAQSAFLSRCKANSEATLGTYKGDAAKGEGVSESLHVKDYKY

SEQ ID NO: 4663 - protein, 337 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTSSLVRQTENERCQTAFLVKCKSTPAHLALKAKP

SEQ ID NO: 4664 - protein, 225 aa, Setaria italica
MSAYCGKYKDELIKNAAYIGGILAADESTGTIGKRLSSINVENIEENRRALRELLFCCPGALPCLSGVILFEETLYQKTKDGKPFVDVLNEGGVLPGIKVDKGTIEVAGTDKETTTQGHDDLGKRCAKYYEAGARFAKWRAVLKIGPNEPSQLAIDLNAQGLARYAIICQENGLVPIVEPEILVDGSHDIERCAYGPCCLLQGSQRAPCPPRGYPPEAQHGDPWV

SEQ ID NO: 4665 - protein, 358 aa, Euonymus alatus
MSSFKGKYADELIANAAYIGTPGKGILAADESTGTIGKRLASINVENVETNRRDLRELLFTAPGALQYLSGVILFEETLYQKTAAGKPFVDVLKEGGVLPGIKVDKGTVVLAGTNGETTTQGLDGLAQRCQKYYEAGARFAKWRAVLNIGPTEPSQLSINENANGLARYAIICQENGLVPIVEPEILVDGSHSIEKCADVTERVLAACYKALNDHHVLLEGTLLKPNMVTPGSDAPKVAPEVIAEHTVRALQRTVPAAVPAIVFLSGGQSEEEATINLNAMNKLKGKKPWNLSFSFGRALQQSTLKAWAGKEDNVKAAQNALLARCKANSEATLGTYKGDAQLGEGASESLHVKDYKY

SEQ ID NO: 4666 - protein, 358 aa, Tripterygium wilfordii
MSSFKGKYADELIANAAYIGTPGKGILAADESTGTIGKRLASINVENVETNRRALRELLFTAPGALQYLSGVILFEETLYQKTAEGKPFVDVLKEGGVLPGIKVDKGTVELAGTNGETTTQGLDGLAQRCQKYYEAGARFAKWRAVLNIGPTEPSQLSINENANGLARYAIICQENGLVPIVEPEILVDGTHSIEKCADVTERVLAACYKALNDHHVLLEGTLLKPNMVTPGSEAPKVAPEVIAEHTVRALQRTVPAAVPAIVFLSGGQSEEEATINLNAMNKLKGKKPWSLSFSFGRALQQSTLKAWAGKEENVKAAQAALLTRCKANSEATLGTYKGDAKLGEGAAESLHVKDYKY

SEQ ID NO: 4667 - protein, 358 aa, Aquilegia formosa
MSCYKGKYADELIANAAYIGTPGKGILAADESTGTIGKRLSSINVENVETNRRALRELLFCTPGALNYLSGVILFEETLYQKSAAGKPFVDILKEGGVLPGIKVDKGTVELAGTDGETTTQGLDGLAQRCAQYYSAGARFAKWRAVLKIGPNEPSQLAINENANGLARYAIICQENGLVPIVEPEILVDGSHDIDRCADVTERVIAACYKALNDHHVLLEGTLLKPNMVTPGSESKKVAPEVIAEYTVRALQRTMPAAVPAVVFLSGGQSEEEATLNLNAMNQLKGKKPWSLSFSFGRALQQSTLKAWSGKEENVEKAQAAFLARCKANSEATLGTYKGDAPVGDGASESLHVSNYKY

SEQ ID NO: 4668 - protein, 358 aa, Ricinus communis
MTAYKGKYADELIANAAYIGTPGKGILAADESTGTIGKRLSSINVENVEENRRALRELLFTAPGALQYLSGVILFEETLYQKTKSGKPFAELLKENGVLPGIKVDKGTVEIAGTDGETTTQGHDGLAQRCQKYYEAGARFAKWRAVLKIGPNEPSQLSINLNAEGLARYAIICQENGLVPIVEPEILVDGPHDINKCAEVTERVLAACYKALNDHHVLLEGTLLKPNMVTPGSDSPKVAPEVVAEYTVRALQRTMPAAVPAVVFLSGGQSEEEATLNLNAMNKLKTKKPWTLSFSFGRALQASTLKAWAGKEENVKKAQEALLVRCKANSEATLGTYKGDATLGEGAAESLHVKDYKY

SEQ ID NO: 4669 - protein, 358 aa, Castanea mollissima
MSAYQGKYADELCANAAYIGTPGKGILAADESTGTIGKRLSSINVENVEENRRALRELLFTTPGALQYLSGVILFEETLYQKTHDGKPFVDLLKENGVLPGIKVDKGTVELAGTNGETTTQGLDGLAQRCQKYYEAGARFAKWRAVLKIGPTEPSQLAINENANGLARYAIICQENGLVPIVEPEILVDGPHDILKCADVTERVLAAVYKALNDHHVLLEGTLLKPNMVTPGSEAPKVAPEVIAEHTVRALQRTMPAAVPAVVFLSGGQSEEQATINLNAMNKYKGKKPWTLSFSFGRALQQSTLKAWGGKKENVQKAQAAFLARAKANSEATLGTYKGDATLGEGASESLHVKDYKY

SEQ ID NO: 4670 - protein, 358 aa, Eucalyptus grandis
MSCYKGKYTDELIANAAYIGTPGKGILAADESTGTIGKRLASINVENVETNRRILRELLFTAPGALPCLSGVILFEETLYQKTASGKPFVDVLKEGGVLPGIKVDKGTVELAGTNGETTTQGLDGLAQRCQQYYKAGARFAKWRAVLKISPTEPSQLAINENANGLARYAIICQENGLVPIVEPEILVDGPHSIDKCADVTERVLAACYKALNDHHVLLEGTLLKPNMVTPGSDAPKVAPEVIAEYTVRALQRTVPPAVPAIVFLSGGQSEEEATLNLNAMNKLKGKKPWSLSFSFGRALQQSTLKAWAGKEENIPKAQAALLRRCKANSDATLGTYKGDAQLGEGASESLHVKDYKY

SEQ ID NO: 4671 - protein, 358 aa, Eucalyptus grandis
  misc_feature (245)..(245): Xaa can be any naturally occurring amino acid
  misc_feature (331)..(331): Xaa can be any naturally occurring amino acid
MSCYKGKYTDELIANAAYIGTPGKGILAADESTGTIGKRLASINVENVETNRRILRELLFTAPGALPCLSGVILFEETLYQKTASGKPFVDVLKEGGVLPGIKVDKGTVELAGTNGETTTQGLDGLAQRCQKYYTAGARFAKWRAVLKISPTEPSQLAINENANGLARYAIICQENGLVPIVEPEILVDGPHSIDKCADVTERVLAACYKALNDHHVLLEGTLLKPNMVTPGSDAPKVAPEVIAXYTVRALQRTVPPAVPAIVFLSGGQSEEEATLNLNAMNKLKGKKPWSLSFSFGRALQQSTLKAWAGKEENIPKAQAALLRRCKANSXATLGTYKGDAQLGEGASESLHVKDYKY

SEQ ID NO: 4672 - protein, 358 aa, Populus trichocarpa
MSCFKSKYADELIKNAAYIGTPGKGILAADESTGTIGKRLSSINVENVEENRRALRELLFCAPGALQYLSGVILFEETLYQKTASGKPFVDVLKEGGVLPGIKVDKGTVELAGTNGETTTQGLDGLGQRCAKYYEAGARFAKWRAVLNIGANEPSELAIHENAYGLARYAVICQENGLVPIVEPEILVDGSHDIEKCAAVTERVLAACYKALNDHHAILEGTLLKPNMVTPGSEAPKVAHEVIAEYTVRALQRTVPPAVPAIVFLSGGQSEEEATLNLNAMNKLNTKKPWSLSFSFGRALQQSTLKAWAGKPENVGKARAALLARCKANSEATLGTYKGDATLGEGASESLHVKDYKY

SEQ ID NO: 4673 - protein, 358 aa, Aquilegia formosa
MSCYKGKYHDELIANAAYIGTPGKGILAADESTGTIGKRLASINVENVETNRRALRELLFCTPGALQYLSGVILFEETLYQKTAAGKPFVEVLKEGGVLPGIKVDKGTVELAGTNGETTTQGLDGLAQRCQQYYAAGARFAKWRSVLKIGPTEPSQLAINENANGLARYAIICQENGLVPIVEPEILVDGSHDIDRCADVTERVVAACYKALNDHHVLLEGTLLKPNMVTPGSDAKKVAPEVVAEYTVRALQRTMPPAVPAVVFLSGGQSEEEATLNLNAMNQLKGKKPWALSFSFGRALQQSTLKTWAGKEENLEKAQAAFLSRCKANSEATLGTYKGDAAQVEGASESLHVKDYTY

SEQ ID NO: 4674 - protein, 358 aa, Euonymus alatus
MSSFKGKYADELIANAAYIGTPGKGILAADESTGTIGKRLASINVENVETNRRALRELLFTAPGALPCLSGVILFEETLYQKTAAGKPFVDVLKESGVLPGIKVDKGTVELAGTNGETTTQGLDGLAQRCQKYYEAGARFAKWRAVLKISATEPSQLAINENANGLARYAIICQENGLVPIVEPEILVDGPHSIEKCADVTERVLAACYKALNDHHVLLEGTLLKPNMVTPGSDAPKVAPEVIAEHTVRALQRTVPAAVPAIVFLSGGQSEEEATINLNAMNKLKGKKPWNLSFSFGRALQQSTLKAWAGKEENVKAAQAALLARCKANSEATLGTYKGDAQLGEGASESLHVKDYKY

SEQ ID NO: 4675 - protein, 358 aa, Malus domestica
MSAYRGKYADELIANAAYIGTPGKGILAADESTGTIGKRFASINVENVESNRRALRELLFTAPDVLQYLSGVILFEETLYQKTASGKPFVDVLKEGGVLPGIKVDKGTVELAGTNGETTTQGLDGLAQRCQKYYEAGARFAKWRAVLKIGPNEPSQLSIQENANGLARYAIICQENGLVPIVEPEILVDGPHSIDKCADVTERVLAACYKALNDHHVLLEGTLLKPNMVTPGSDAKKVSPEVIAKYTVRALLRTTPAAVPAVVFLSGGQSEEEATLNLNAMNQLKGKKPWSLSFSFGRALQQSTLKAWAGKEGNIPKAQAALLTRAKANSEATLGIYKGDAKLGEGAAESLHVKDYKY

SEQ ID NO: 4676 - protein, 358 aa, Aquilegia formosa
MSCYKGKYHDELIANAAYIGTPGKGILAADESTGTIGKRLASINVENVETNRRALRELLFCTPGALQYLSGVILFEETLYQKTAAGKPFVEVLKEGGVLPGIKVDKGTVELAGTNGETTTQGLDGLAQRCQQYYAAGARFAKWRSVLKIGPTEPSQLAINENANGLARYAIICQENGLVPIVEPEILVDGSHDIDRCADVTERVVAACYKALNDHHVLLEGTLLKPNMVTPGSDAKKVAPEVVAEYTVRALQRTMPPAVPAVVFLSGGQSEEEATLNLNAMNQLKGKKPWALSFSFGRALQQSTLKTWAGKEENLEKAQAAFLSRCKANSEATLGTYKGDAAQVEGASESLHVKGYTY

SEQ ID NO: 4677 - protein, 358 aa, Quercus alba
MSAYQGKYADELCANAAYIGTPGKGILAADESTGTIGKRLSSINVENVEENRRALRELLFTTPGALQYLSGVILFEETLYQKTHDGKPFVNLLKENGVLPGIKVDKGTVELAGTNGETTTQGLDGLAQRCQKYYEAGARFAKWRAVLKIGPTEPSQLAINENANGLARYAIICQENGLVPIVEPEILVDGPHDILKCADVTERVLAAVYKALNDHHVLLEGTLLKPNMVTPGSEAPKVAPEVIAEHTVRALQRTMPAAVPAVVFLSGGQSEEQATVNLNAMNKYKGKKPWTLSFSFGRALQQSTLKAWGGKKENVPKAQAAFLARAKANSEATLGTYKGDATLGEGASESLHVKDYKY

SEQ ID NO: 4678 - protein, 358 aa, Fragaria vesca
MTAYKGKYHDELIKNAAYIGTPGKGILAADESTGTIGKRFDSIKVENVEENRRALRELLFTAPGVLQYLSGVILFEETLYQKTAEGKPFVEVLKEGGVLPGIKVDKGVVELAGTNSETTTQGLDGLGARCAKYYEAGARFAKWRAVLKIGPNEPSQLSINENANGLARYAIICQENGLVPIVEPEILVDGPHDINKCADVTERVLAACYKALNDHHVLLEGTLLKPNMVTPGSEAKKASPEVIAEYTVRALQRTTPAAVPAVVFLSGGQSEEEATLNLNAMNQLKGKKPWTLSFSFGRALQASTLKAWSGKKENVKAAQEALLTRAKANSEATLGTYKGDAKLGEGAAESLHVKDYKY

SEQ ID NO: 4679 - protein, 358 aa, Eucalyptus grandis
MSCFKGKYHDELIANAAYIGTPGKGILAADESTGTIGKRLSSINVENVEENRRALRELLFTAPGALQYLSGVILFEETLYQKTAAGKPFVEVLKEGGVLPGIKVDKGTVELAGTNGETTTQGLDGLAQRCQKYYEAGARFAKWRAVLKIGPTEPSQLAINENANGLARYAIICQENGLVPIVEPEILVDGPHDIEKCADVTERVLAACYKALNDHHVLLEGTLLKPNMVTPGSEAPKVAPEVIAEYTVRALQRTMPPAVPAVVFLSGGQSEEEATLNLNAMNKLKGKKPWSLSFSFGRALQQSTLKSWAGKEENVPKAQAALFTRCKANSEATLGTYKGDAKLGEGAAESLHVKDYKY

SEQ ID NO: 4680 - protein, 358 aa, Euphorbia peplus
MSCYRGKYADELIANAAYIGTPGKGILAADESTGTIGKRLSSINVENVEENRRALRELLFTAPGALQYLSGVILFEETLYQKTKSGKPFAELLKENGVLPGIKVDKGTVVLAGTNGETTTQGLDGLAQRCQKYYEAGARFAKWRAVLNIGPTEPSQLAINENANGLARYAIICQENGLVPIVEPEILVDGSHDINKCADVTERVLAACYKALNDHHVLLEGTLLKPNMVTPGSEAPKVSPEVIAEYTVRALQRTMPVAVPAVVFLSGGQSEEEATVNLNAMNKLKTKKPWTLSFSFGRALQASTLKAWAGKEENVKKAQEALLVRCKANSEATLGIYKGDATLGEGASESLHVKDYKY

SEQ ID NO: 4681 - protein, 357 aa, Olea europaea
MSCYKGKYADELIANAAYIGTPGKGILAADESTGTIGKRLASINVENVETNRRALRELLFTTPGALQYLSGVILFEETLYQKTATGKPFVDVMKEAGVLPGIKVDKGTVELAGTNGETTTQGLDGLAQRCQQYYAAGARFAKWRAVLKIGPTEPSQLAINENANGLARYAIICQENGLVPIVEPEILVDGSHDINKCADVTERVLAACYKALNDHHVLLEGTLLKPNMVTPGSDSAKVAPEVIAEHTVRALQRTMPAAVPAVVFLSGGQSEEEATRNLNAMNKLKTKKPWSLSFSFGRALQQSTLKAWAGKEENIGKAQAAFLARCKANSEATLGTYQGGALSEGASESLHVKDYKY

SEQ ID NO: 4682 - protein, 358 aa, Mimulus guttatus
MSCYKGKYADELIANAAYIGTPGKGILAADESTGTIGKRFESINVENVESNRRALRELLFTTPGALQHLSGVILFEETLYQKTAAGKPFVDVMKEGGVLPGIKVDKGTVELAGTNGETTTQGLDGLAQRCQQYYKAGARFAKWRAVLKIGPNEPSQLAINENANGLARYAIICQENGLVPIVEPEILVDGSHDIDRCADVTERVLAACYKALNDHHVLLEGTLLKPNMVTPGSDAKKVAPEVIAEYTVRALQRTMPPAVPAVVFLSGGQSEEEASVNLNAMNKLKAKKPWTLTFSFGRALQQSTLKAWAGKEENVGKAQAAFLTRCKANSEATLGTYKGSSSLSEGASESLHVKDYKY

SEQ ID NO: 4683 - protein, 358 aa, Cajanus cajan
MSSFKSKYQDELIANAAYIGTPGKGILAADESTGTIGKRLASINVENVETNRRALRELLFTTPGAFECLSGVILFEETLYQKTASGKPFVDLLKEGGVLPGIKVDKGTVELAGTNGETTTQGLDGLGQRCQKYYEAGARFAKWRAVLKIGPNEPSELAIHENAYGLARYAAICQENGLVPIVEPEILVDGPHDINKCAEVTERVLAACYKALSDHHVLLEGTLLKPNMVTPGSESPKVTPEVIAKYTVTALQRTVPAAVPAIVFLSGGQSEEEATLNLNAMNKFQGKKPWSLSFSFGRALQQSTLKAWSGKDENIKKAQDAFIVRCKANSHATLGTYKGDATLAEGASESLHVKDYKY

SEQ ID NO: 4684 - protein, 211 aa, Malus domestica
MSAFKGKYHDELIANAAYIGTPGKGILAADESTGTIGKRLSSIGVENTETNRRALRELLFTTPGALQYLSGVILFEETLYQKTAAGKPFVDVLKEGGVLAGIKVDKGTVELAGTNGETTTQGLDGLGERCKKYYEAGARFAKWRAVLKIGPTEPSQLAINENANGLARYAIICQENGLVPIVEPEILVDGSHDIQKCACDRTCSCRMLQGT

SEQ ID NO: 4685 - protein, 362 aa, Euonymus alatus
MSSFKGKYADELIANAAYIGTPGKGILAADESTGTIGKRLASINVENVETNRRDLRELLFTAPGALQYLSGVILFEETLYQKTAAGKPFVDVLKEGGVLPGIKVDKGTVVLAGTNGETTTQGLDGLAQRCQKYYEAGARFAKWRAVLNIGPTEPSQLSINENANGLARYAIICQENGLVPIVEPEILVDGSHSIEKCADVTERVLAACYKALNDHHVLLEGTLLKPNMVTPGSDAPKVAPEVIAEHTVRALQRTVPPAVPAIVFLSGGQSEEEATVNLNAMNKLKGKKPWSLSFSFGRALQQSTLKAWAGKEENVKAAQAALLASARLTLRQPLVPTRVMPSLVRVPLKASMSRTTNTRKCQ

SEQ ID NO: 4686 - protein, 92 aa, Arachis hypogaea
MSSFKSKYQDELIANAAYIGTPGKGILAADESTGTIGKRLASINVENVETNRRALRELLFTTPGALECLSGVILFEETLYQSTAAGNLLSRC

SEQ ID NO: 4687 - protein, 358 aa, Ocimum basilicum
MSAYRGKYADELIANAAYIGTPGKGILAADESTGTIGKRLSSINVENVETNRRALRELLFTAPGALQYLSGVILFEETLYQKTAAGKPFVDVLNEGGVLPGIKVDKGTVELAGTDGETTTQGLDGLAQRCQKYYEAGARFAKWRAVLKIGPNEPSQLAINENANGLARYAIICQENGLVPIVEPEILVDGSHDINKCADVTERVLAAVYKALNDHHVLLEGTLLKPNMVTPGSLSAKVAPEVVAEYTVRALQRTMPAAVPAVVFLSGGQSEEEATLNLNAMNKLKTKKPWTLSFSFGRALQQSTLKAWAGKEENIGKAQAALLARCKANSEATLGTYKGDAVLGEGASESLHVANYKY

SEQ ID NO: 4688 - protein, 358 aa, Solanum melongena
MSCYKGKYADELIKNAAYIGTPGKGILAADESTGTIGKRLSSINVENVESNRRALRELLFCTPGCLQYLSGVILFEETLYQKTAAGKPFVDVLKEGGVLPGIKVDKGTVELPGTNGETTTQGLDGLAERCKKYYEAGARFAKWRAVLKIGANEPSQLAINENANGLARYAIICQQNGLVPIVEPEILVDGSHDINKCADVTERVLAACYKALNDHHVLLEGTLLKPNMVTPGSDSAKVAPEVIAEYTVRVLQRTMPAAVPAVVFLSGGQSEEEATVNLNAMNKLQTKKPWSLSFSFGRALQQSTLKAWAGKEENVQKAQAAFLTRCKANSEATLGKYAGATNLSEGASESLHVKDYTY

SEQ ID NO: 4689 - protein, 358 aa, Eschscholzia californica
MSCYKGKYADELIANAAYIGTPGKGILAADESTGTIGKRLSSINVENVEANRRALRELLFCTPGCLQYLSGVILFEETLYQKTAAGKPFVDVLKEAGVLPGIKVDKGTVELAGTNGETTTQGLDGLAQRCQQYYAAGARFAKWRAVLNIGPNEPSQLAINENANGLARYAIICQENGLVPIVEPEILVDGTHDIDRCADVTERVLAACYKALNDHHVLLEGTLLKPNMVTPGSEAKKVAPEVIAEYTVRALQRTMPPAVPAVVFLSGGQSEEEATVNLNAMNKLKGKKPWSLSFSFGRALQSSTLKAWAGKDENIEKAQTAFLTRCKANSEATLGTYKGDAVIGDGASESLHVAGYKY

SEQ ID NO: 4690 - protein, 358 aa, Arachis hypogaea
MSNFKSKYHDELIANAAYIGTPGKGILAADESTGTIGKRLSSINVENVETNRRALRELLFTTPGALQYLSGVILFEETLYQSTAAGKPFVEVLKEGGVLPGIKVDKGTVELAGTNGETTTQGLDGLGQRCAKYYEAGARFAKWRAVLKIGPTEPSELAIHENAYGLARYAAICQENGLVPIVEPEILVDGPHDIHKCAAVTERVLAACYKALNDHHVLLEGTLLKPNMVTPGSDSAKVAPEVVAEHTVRALQRTVPSAVPAVVFLSGGQSEEEATLNLNAINQVKGKKPWSLSFSFGRALQQSTLKAWSGKEENVKKAQEAFLTRAKANSEATLGTYKGSANLGEGASESLHVKDYKY

SEQ ID NO: 4691 - protein, 358 aa, Arachis hypogaea
MSSFKSKYQDELIANAAYIGTPGKGILAADESTGTIGKRLASINVENVETNRRALRELLFTTPGALECLSGVILFEETLYQSTAAGKPFVEVLKDGGVLPGIKVDKGTVELPGTNGETTTQGLDGLGQRCAKYYEAGARFAKWRAVLKIGPNEPSELAIHENAYGLARYAAICQENGLVPIVEPEILVDGSHDINKCAAVTERVLAACYKALNDHHVLLEGTLLKPNMVTPGSDSPKVAPEVTAEYTVRTLQRTVPAAVPAIVFLSGGQSEEEATLNLNAMNKLKGKKPWSLSFSFGRALQQSTLKAWAGKDENIKKAQDALFTRCKANSQATLGTYKGDATLGDGASESLHVKDYKY

SEQ ID NO: 4692 - protein, 358 aa, Prunus persica
MSAFKGKYHDELIANATYIGTPGKGILAADESTGTIGKRLSSINVENSETNRRALRELLFTTPGALQYLSGVILFEETLYQKTAAGKPFVDVLREGGVLPGIKVDKGTVELAGTNGETTTQGLDGLGERCKKYYEAGARFAKWRAVLNIGPSEPSQLSINENANGLARYAIICQENGLVPIVEPEILVDGSHDIHKCAEVTERVLAACYKALNDHHVLLEGTLLKPNMVTPGSDSPKVAPEVIAEHTVRSLQRTMPVAVPAVVFLSGGQSEEEATLNLNAMNKLKGKKPWTLSFSFGRALQQSTLKAWAGKEENIKAAQEAFLTRAKANSEATLGTYKGDAKLGEGAAESLHVKDYKY

SEQ ID NO: 4693 - protein, 358 aa, Fragaria vesca
MTAYRGKYADELIKNAAYIGTPGKGILAADESTGTIGKRFDSIKVENVEENRRALRELLFTAPGVLQYLSGVILFEETLYQKTAEGKPFVDVLNEGGVLPGIKVDKGVVELKGTDGETTTQGLDGLGARCAKYYEAGARFAKWRAVLKIGPNEPSQLSINENANGLARYAIICQENGLVPIVEPEILVDGPHSIDKCADVTERVLAACYKALNDHHVLLEGTLLKPNMVTPGSEAKKASPEVIAEYTVRALQRTTPAAVPAVVFLSGGQSEEEATLNLNAMNQLKGKKPWTLSFSFGRALQASTLKAWSGKKENVKAAQQALLTRAKANSEATLGIYKGDAKLGEGAAESLHVKDYKY

SEQ ID NO: 4694 - protein, 152 aa, Musa acuminata
MSAYCGQYHDELIANATYIGTPGKGILAADESTGTIGKRLASINVENVEENRRSLRELLFCAPGALQYLSGVILFEETLYQKTASGKPFVEVLKEGGVLPGIKVDKGTIELAGTNGETTTQGHDDLGKRCKKYYEAGGSLCQVACRSEDWSK

SEQ ID NO: 4695 - protein, 199 aa, Euonymus alatus
MSSFKGKYADELIANAAYIGTPGKGILAADESTGTIGKRLASINVENVETNRRALRELLFTAPGALPCLSGVILFEETLYQKTAAGKPFVDVLKESGVLPGIKVDKGTVELAGTNGETTTQGLDGLAQRCQKYYEAGARFAKWRAVLKMVQLSHLSWLSMRMPTVWLDMLSSARRMALFQLLSLRSWLMVPIALRSVLM

SEQ ID NO: 4696 - protein, 358 aa, Parthenium argentatum
MSCYRGKYADELIANAAYIGTPGKGILAADESTGTIGKRLSSINVENVESNRRALRELLFCTPGALQYLSGVILFEETLYQKTAAGKPFVDVMKEAGVLPGIKVDKGTVELAGTNGETTTQGLDGLAQRCAQYYSAGARFAKWRAVLKIGPNEPSQLAINENANGLARYAIICQENGLVPIVEPEILVDGPHDINKCADVTERVLAACYKALNDHHVLLEGTLLKPNMVTPGSDAKKVAPEVVAEYTVRALQRTMPAAVPAVVFLSGGQSEEEATVNLNAMNQYKGKKPWTLSFSFGRALQQSTLKAWAGKEENVQKAQAAFLARCKANSEATLGKYQGGSGLSEGASESLHVKDYKY

SEQ ID NO: 4697 - protein, 353 aa, Thalictrum flavum
GKYHDQLIANAAYIGTPGKGILAADESTGTIGKRLASINVENVETNRRALRELLFCTPGALQYLSGVILFEETLYQKTAAGKPFVEVLKEGGVLPGIKVDKGTVELAGTNGETTTQGLDGLAQRCQQYYAAGARFAKWRAVLKIGPTEPSQLAINENANGLARYAIICQENGLVPIVEPEILVDGSHDIDRCADVTERVLAACYKALNDHHVLLEGTLLKPNMVTPGSDAKKVTPDVVAEYTVRALQRTMPSAVPAVLFLSGGQSEEQATLNLNAMNKLKGKKPWSLSFSFGRALQQSTLKAWAGKEVNLEKAQAAFLSRCKANSEATLGIYKGDAAQGEGASESLHVKGYTY

SEQ ID NO: 4698 - protein, 358 aa, Tripterygium wilfordii
MSCFKGKYADELIANAAYIGTPGKGILAADESTGTIGKRLSSINVENVETNRRALRELLFTAPGALQYLSGVILFEETLYQKTAAGKPFVDVLKEGGVLPGIKVDKGTVELAGTNGETTTQGLDGLAQRCQKYYEAGARFAKWRAVLKIGLTEPSQLAINENANGLARYAIICQENGLVPIVEPEILVDGSHSIEKCADVTERVLAACYKALNDHHVLLEGTLLKPNMVTPGSEAPKVAPEVIAEHTVRALQRTVPPAVPAIVFLSGGQSEEEATINLNAMNKLKGKKPFSLSFSFGRALQQSTLKAWAGKEENVKAAQAALLARCKANSEATLGTYKGDAKLGEGASESLHVADYKY

SEQ ID NO: 4699 - protein, 358 aa, Amborella trichopoda
  misc_feature (336)..(336): Xaa can be any naturally occurring amino acid
MSAFCGKYTDELIKNAAYIGTPGRGILAADESTGTIGKRLSSINVENVESNRRALRELLFCTPGALQCLSGVILFEETLYQKSSSGKPFVEILKEGGVLPGIKVDKGTVELAGTNGETTTQGLDGLAARCQQYYAAGARFAKWRAVLKIGPTEPSPLSILENANGLARYAIICQENGLVPIVEPEILVDGSHSIEVCAAATERVLAAVYKSLNDHHVLLEGTLLKPNMVTPGSDAPKVAPEVIAEHTIRALQRTVPAAVPAIVFLSGGQSEEEATLNLNAMNKLKTNKPWNLSFSFGRALQQSTLKTWAGKEENIPAAQKSFLARCKANSEATLGXYKGDAPVGEGASESLHVKDYKY

SEQ ID NO: 4700 - protein, 358 aa, Helianthus annuus
MSCYRGKYADELIANAAYIGTPGKGILAADESTGTIGKRLSSINVENVESNRRALRELLFCTPGALQYLSGVILFEETLYQKTAAGKPFVDVMKEAGVLPGIKVDKGTVELAGTNGETTTQGLDGLAQRCAQYYSAGARFAKWRAVLKIGPNEPSQLAINENANGLARYAIICQENGLVPIVEPEILVDGPHDINKCADVTERVLAACYKALNDHHVLLEGTLLKPNMVTPGSDAKKVAPEVVAEYTVRALQRTMPAAVPAVVFLSGGQSEEEATVNLNAMNQYKGKKPWSLSFSFGRALQQSTLKAWAGKEENVQKAQAAFLARCKANSEATLGKYQGGSGLSEGASESLHVKDYKY

SEQ ID NO: 4701 - protein, 358 aa, Nicotiana tabacum
MSCYKGKYADELIANAAYIGTPGKGILAADESTGTIGKRFSSINVENVESNRRALRELLFTTPGAVQYLSGVILFEETLYQKTASGKPFVDVLKEGGVLPGIKVDKGTVELPGTNGETTTQGLDGLAERCQKYYEAGARFAKWRAVLKIGANEPSQLAINENANGLARYAIICQQNGLVPIVEPEILVDGSHDINKCADVTERVLAACYKALNDHHVLLEGTLLKPNMVTPGSEAAKVAPEVIAEYTIRALQRTMPAAVPAVVFLSGGQSEEEATVNLNAMNKLQTKKPWSLSFSFGRALQQSTLKAWAGKEENVQKAQAAFLTRCKANSEATLGKYAGATNLSEGASESLHVKDYKY

SEQ ID NO: 4702 - protein, 358 aa, Solanum lycopersicum
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYEAGARFAKWRAVLKIGANEPSQLAINDNANGLARYAIICQQNGLVPIVEPEILVDGSHDINKCADVTERVLAACYKALNDHHVLLEGTLLKPNMVTPGSDAPKVAPEVIAEYTVRALQRTMPAAVPAVVFLSGGQSEEEATRNLNAMNKLQTKKPWTLSFSFGRALQQSTLKAWSGKVENIGKAQAALLTRCKANSEATLGKYAGSSNLGDGASESLHVKDYKY

SEQ ID NO: 4703 - protein, 146 aa, Cynara scolymus
MSCYKGKYADELIANAAYIGTPGKGILAADESTGTIGKRLSSINVENVESNRRALRELLFCTPGALQYLSGVILFEETLYQKTAAGKPFVDVMKEAGVLPGIKVDKGTVELAGTMGRPQPKVLTVLPSDVPSTIQLVLDLPSGVQS

SEQ ID NO: 4704 - protein, 358 aa, Euonymus alatus
MSSFKGKYADELIANAAYIGTPGKGILAADESTGTIGKRLASINVENVETNRRALRELLFTAPGALPCLSGVILFEETLYQKTAAGKPFVDVLKESGVLPGIKVDKGTVELAGTNGETTTQGLDGLAQRCQKYYEAGARFAKWRAVLKISATEPSQLAINENANGLARYAIICQENGLVPIVEPEILVDGPHSIEKCADVTERVLSACYKALNDHHVLLEGTLLKPNMVTPGSEAPKVAPEVIAEHTVRALQRTVPPAVPAIVFLSGGQSEEEATVNLNAMNKLKGKKPWSLSFSFGRALQQSTLKAWAGKEENVKAAQAALLARCKANSEATLGTYKGDAQLGEGASESLHVKDYKY

SEQ ID NO: 4705 - protein, 358 aa, Humulus lupulus
MSCYKGKYHDELIANAAYIGTPGKGILAADESTGTIGKRLSSINVENVETNRRALRELLFTTPGALQYLSGVILFEETLYQSTAAGKPFVEVMKEGGVLPGIKVDKGTVELAGTNGETTTQGLDGLAQRCQKYYEAGARFAKWRAVLKIGPNEPSQLAINENANGLARYAIICQENGLVPIVEPEILVDGSHDINKCAEVTERVLAACYKALNDHHVLLEGTLLKPNMVTPGSDSPKVAPEVIAEYTVRALQRTMPPAVPAVVFLSGGQSEEQATVNLNAMNKLKGKKPWSLSFSFGRALQQSTLKAWSGKEENLAKAQAAFLTRCKANSEATLGTYKGSENLDDGASESLHVKNYTY

SEQ ID NO: 4706 - protein, 358 aa, Momordica charantia
MSCYRGKYADELIANAAYIGTPGKGILAADESTGTIGKRLSSINVENVETNRRALRELLFTAPGALQYLSGIILFEETLYQKTAAGKPFVDVMKEGGVLPGIKVDKGTVELAGTNGETTTQGLDGLAQRCQKYYEAGARFAKWRAVLKIGDNEPSQLAINENANGLARYAIICQENGLVPIVEPEILVDGPHDIHKCADVTERVLAACYKALNDHHVLLEGTLLKPNMVTPGSQSAKVAPEVIAEHTVRALQRTVPAAVPAVVFLSGGQSEEEATINLNAMNKLKGKKPWSLSFSFGRALQQSTLKAWAGKDENIPKAQGALLVRCKANSEATLGTYKGDAKLSEGASESLHQDNYKY

SEQ ID NO: 4707 - protein, 358 aa, Tabernaemontana elegans
MSCYKGEYADELIANAAYIATPGKGILAADESTGTIGKRLASIKVENVETNRRALRELLFTTPGALQYLSGVILFEETLYQKTAAGKPFVDVLKEGGVLPGIKVDKGTVELPGTNGETTTQGLDGLAQRCQQYYKAGARFAKWRAVLNIGPNEPSQLAINENANGLARYAIICQQNGLVPIVEPEILVDGSHDINKCADVTERVLAACYKALNDHHVLLEGTLLKPNMVTPGSDSPKVAPEVIAEYTVRALQRTMPAAVPAVVFLSGGQSEEEASLNLNAMNKLQTKKPWTLSFSFGRALQQSTLKAWSGKEENIPKAQAAFLARCKANSEATLGKYAGGASLGDGASESLHVKDYKY

SEQ ID NO: 4708 - protein, 358 aa, Artemisia annua
MSCYRGKYADELIANAAYIGTPGKGILAADESTGTIGKRLSSINVENVESNRRALRELLFCTPGALQYLSGVILFEETLYQKTAAGKPFVDVMKEAGVLPGIKVDKGTVELAGTNGETTTQGLDGLAQRCAQYYTAGARFAKWRAVLKIGPNEPSQLAINENANGLARYAIICQENGLVPIVEPEILVDGPHDINKCADVTERVLAACYKALNDHHVLLEGTLLKPNMVTPGSDSKKVAPEVVAEYTVRALQRTMPSAVPAVVFLSGGQSEEEATVNLNAMNQYKGKKPWSLSFSFGRALQQSTLKAWSGKEENVKKAQAAFLARCKANSEATLGKYVGGSGLSEGASESLHVKDYKY

SEQ ID NO: 4709 - protein, 357 aa, Mesembryanthemum crystallinum
MTAYRGKYADELIANAAYIGTPGKGILAADESTGTIGKRFAGINVENVESNRRALRELLFTTPGAVQYLSGVILFEETLYQKTAAGKPFVEVLKEGNVLPGIKVDKGVVELAGTNGETTTQGLDGLGARCAQYYAAGARFAKWRAVLKIGPTEPSPLAILENANGLARYAIICQENGLVPIVEPEILVDGPHDIDRCAEVTERVLAACYKALNDHHVLLEGTLLKPNMVTPGSESKKVAPEVIAEYTVRALQRTVPPAVPAVMFLSGGQSEEEATVNLNAMNKLQGKKPWTLSFSYGRALQSSTLKAWSGKEENVEKAQAVFLARAKGNSEATLGKYQGGAGGADASESLHVKDYKY

SEQ ID NO: 4710 - protein, 358 aa, Lotus japonicus
MSNFKGKYHDELIANAAYIGTPGKGILAADESTGTIGKRLASINVENVETNRRALRELLFTTPGALQYISGVILFEETLYQSTAAGKPFVDVLKEAGVLPGIKVDKGTVELAGTDGETTTQGLDGLGARCAKYYEAGARFAKWRAVLKIGPNEPSELSIHENAYGLARYAVICQENGLVPIVEPEILVDGPHDIHKCAAITERVLAACYKALNDHHVLLEGTLLKPNMVTPGSDSPKVTPEVVAEHTVRALQRTVPAAVPAVVFLSGGQSEEQASVNLNAINQVKGKKPWTLSFSFGRALQQSTLKAWSGKEENVKKAQAAFLTRAKANSEATLGTYKGDSQLGEGASESLHVKDYKY

SEQ ID NO: 4711 - protein, 358 aa, Cucumis melo
MSCYRGKYADELIANAAYIGTPGKGILAADESTGTIGKRLSSINVENVETNRRALRELLFTAPNVLQYLSGVILFEETLYQKTAAGKPFVDVLKEGGVLPGIKVDKGTVELAGTDGETTTQGLDGLAQRCQKYYEAGARFAKWRAVLKIGPNEPSQLSINENANGLARYAIICQENGLVPIVEPEILVDGPHDIKKCADVTERVLAACYKALNDHHVLLEGTLLKPNMVTPGSQSAKVAPEVIAEHTVLALQRTVPAAVPAIVFLSGGQSEEEATVNLNAMNKLKGKKPWSLSFSFGRALQQSTLKAWAGKDENIPKAQAALLVRCKANSEATLGTYKGDAKISEGAAESLHVDNYKY

SEQ ID NO: 4712 - protein, 357 aa, Orobanche aegyptiaca
MSCYRGKYADELIANAAYIGTPGKGILAADESTGTIGKRLSSINVENVESNRRALRELLFTTPGALQYLSGVILFEETLYQKTAAGKPFVEVMKEGGVLPGIKVDKGTVELAGTNGETTTQGLDGLAQRCQKYYEAGARFAKWRAVLKIGPNEPSQLAINENANGLARYAIICQENGLVPIVEPEILVDGTHDIKKCADVTERVLAACYKALNDHHVLLEGTLLKPNMVTPGSDSAKVAPEVVAEYTVRALQRTMPPAVPAVVFLSGGQSEEEATVNLNAMNKLKAKKPWSLSFSFGRALQQSTLKAWAGKEENIPKAQAAFLTRCKANSEATLGTYQGGDLSEGASESLHVKDYKY

SEQ ID NO: 4713 - protein, 358 aa, Orobanche aegyptiaca
MSCYRGKYADELIANAAYIGTPGKGILAADESTGTIGKRLSSINVENVESNRRALRELLFTTPGALQYLSGVILFEETLYQNTAAGKPFVEVLKEGGVLPGIKVDKGTVELAGTNGETTTQGLDGLAQRCQQYYAAGARFAKWRAVLKIGPNEPSQLAINENANGLARYAIICQENGLVPIVEPEILVDGPHDINRCADVTERVLAACYKALNDHHVLLEGTLLKPNMVTPGSDSAKVAPEVVAEYTVRALQRTMPAAVPAVVFLSGGQSEEEATVNLNAMNKLKGKKPWSLSFSFGRALQQSTLKAWAGKEEYIPKAQAAFLARCKANSEATLGTYQAGSGLSEGASESLHVKDYKY

SEQ ID NO: 4714 - protein, 358 aa, Unknown
  Sequence found in Organisms: Solanum tuberosum, Solanum phureja
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYAAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVAPEVIAEYTVRALQRTMPAAVPAVVFLSGGQSEEEATRNLNAMNKLQTKKPWTLSFSFGRALQQSTLKAWSGKEENIGKAQAALLTRCKANSEATLGKYAGSSNLGDGASESLHVKDYKY

SEQ ID NO: 4715 - protein, 358 aa, Helianthus annuus
MSCYRGKYADELIANAAYIGTPGKGILAADESTGTIGKRLSSINVENVESNRRALRELLFCTPGALQYLSGVILFEETLYQKTAAGKLFVDVMKEAGVLPGIKVDKGTVELAGTNGETTTQGLDGLAQRCAQYYTAGARFAKWRAVLKIGPNEPSQLAINENANGLARYAIICQENGLVPIVEPEILVDGPHDINKCADVTERVLAACYKALNDHHVLLEGTLLKPNMVTPGSDAKKVAPEVVAEYTVRALQRTMPPAVPAVVFLSGGQSEEEATVNLNAMNQYKGKKPWSLSFSFGRALQQSTLKAWAGKEENVAKAQAAFLARCKANSEATLGTYQGGSGLSEGASESLHVKDYKY

SEQ ID NO: 4716 - protein, 358 aa, Nicotiana tabacum
MSCYKGKYADELIANAKYIGTPGKGILAADESTGTIGKRFSSINVENVESNRRALRELLFTTPGAVQYLSGVILFEETLYQKTASGKPFVDVLKEGGVLPGIKVDKGTVELPGTNGETTTQGLDGLAERCQKYYEAGARFAKWRAVLKIGANEPSQLAINENANGLARYAIICQQNGLVPIVEPEILVDGSHDINKCADVTERVLAACYKALNDHHVLLEGTLLKPNMVTPGSEAAKVAPEVIAEYTIRALQRTMPAAVPAVVFLSGGQSEEEATVNLNAMNKLQTKKPWSLSFSFGRALQQSTLKAWAGKEENVQKAQAAFLTRCKANSEATLGKYAGATNLSEGASESLHVKDYKY

SEQ ID NO: 4717 - protein, 358 aa, Amsonia hubrichtii
MSCYRGEFADELIANAAYIGTPGKGILAADESTGTIGKRLSSINVENVETNRRALRELLFTTPGAVQYLSGVILFEETLYQKTAAGKPFVDVLKEGGVLPGIKVDKGTVELPGTNGETTTQGLDGLAQRCQQYYKAGARFAKWRAVLKIGPNEPSQLAINDNANGLARYAIICQQNGLVPIVEPEILVDGSHDINKCADVTERVLAACYKALNDHHVLLEGTLLKPNMVTPGSDSPKVAPEVIAEYTIRALQRTMPAAVPAVVFLSGGQSEEEATLNLNAMNKLQTKKPWSLSFSFGRALQQSTLKAWSGKEENVKKAQAAFLTRCKANSEATLGKYAGSSELSEGASESLHVKDYKY

SEQ ID NO: 4718 - protein, 358 aa, Euonymus alatus
MSSFKGKYADELIANAAYIGTPGKGILAADESTGTIGKRLASINVENVETNRRALRELLFTAPGALPCLSGVILFEETLYQKTAAGKPFVDVLKESGVLPGIKVDKGTVELAGTNGETTTQGLDGLAQRCQKYYEAGARFAKWRAVLKISATEPSQLAISENANGLARYAIICQENGLVPIVEPEILVDGPHSIEKCADVTERVLSACYKALNDHHVLLEGTLLKPNMVTPGSEAPKVAPEVIAEHTVRALQRTVPPAVPAIVFLSGGQSEEEATVNLNAMNKLKGKKPWSLSFSFGRALQQSTLKAWAGKEENVKAAQAALLARCKANSEATLGTYKGDAQLGEGASESLHVKDYKY

SEQ ID NO: 4719 - protein, 357 aa, Beta vulgaris
MTAYRGKYADELIANAAYIATPGKGILAADESTGTIGKRFASINVENVEDNRRALRELLFTTPGALQYLSGVILFEETLYQKTAAGKLFVDVMKEGGVLPGIKVDKGTIELAGTNGETTTQGLDNLGKRCAEYYAAGARFAKWRAVLKIGPNEPSPLAILENANGLARYAIICQENGLVPIVEPEILVDGSHDIDRCAEVSERVLAACYKSLNDHHVLLEGTLLKPNMVTPGSDSKKVANDVIAEYTVRTLQRTVPPAVPGIMFLSGGQSEEEATLNLNAMNKLQAKKPWTLSFSYGRALQQSTLKAWSGKEENVSKAQEVFLARAKANSEATLGKYQGGAAGADASESLHVKDYKY

SEQ ID NO: 4720 - protein, 358 aa, Vigna unguiculata
MSSFKTKYQDELIANAAYIGTPGKGILAADESTGTIGKRLASISVENVETNRRALRELLFTTPGAFDCLSGVILFEETLYQKTASGKPFVELLKEGGVLPGIKVDKGTVELAGTNGETTTQGLDGLGQRCQKYYEAGARFAKWRAVLKIGPNEPSELAIHENAYGLARYALICQENGLVPIVEPEILVDGPHDINRCAAVTERVLAACYKALNDHHVVLEGTLLKPNMVTPGSESPKVAPEVIAEYTVAALQRTVPAAVPAIVFLSGGQSEEEATLNLNAMNKFQGKKPWSLSFSFGRALQQSTLKAWGGKDENIKKAQDAFIARCKANSEATLGTYKGDATLSQAASESLHVKDYKY

SEQ ID NO: 4721 - protein, 358 aa, Cucumis sativus
MSCYRGKYADELIANAAYIGTPGKGILAADESTGTIGKRLSSISVENVETNRRALRELLFTAPNVLQYLSGVILFEETLYQKTAAGKPFVDVLKEGGVLPGIKVDKGTVELAGTNGETTTQGLDGLAQRCQKYYEAGARFAKWRAVLKIGPNEPSQLSINENANGLARYAIICQENGLVPIVEPEILVDGPHDIKKCADVTERVLAACYKALNDHHVLLEGTLLKPNMVTPGSQSAKVAPEVIAEHTVLALQRTVPAAVPAVVFLSGGQSEEEATINLNAMNKLKGKKPWSLSFSFGRALQQSTLKAWAGKDENIPKAQAALLVRCKANSEATLGTYKGDAKISEGAAESLHVDNYKY

SEQ ID NO: 4722 - protein, 358 aa, Nicotiana benthamiana
MSCYKGKYADELIANAKYIGTPGKGILAADESTGTIGKRFSSINVENVESNRRALRELLFTTPGAVQYLSGVILFEETLYQKTASGKPFVDVLKEGGVLPGIKVDKGTVELPGTNGETTTQGLDGLAERCQKYYEAGARFAKWRAVLKIGANEPSQLAINENANGLARYAIICQQNGLVPIVEPEILVDGSHDINKCADVTERVLAACYKALNDHHVLLEGTLLKPNMVTPGSEAAKVAPEVIAEYTIRALQRTMPAAVPAVVFLSGGQSEEEATVNLNAMNKLQTKKPWSLSFSFGRALQQSTLKAWAGKEENVQKAQAAFLTRCKANSEATLGKYAGATNLSDGASESLHVKDYKY

SEQ ID NO: 4723 - protein, 358 aa, Capsicum annuum
MSCYKGKYADELIKNAAYIGTPGKGILAADESTGTIGKRLSSIKVENVESNRRALRELLFCTPGCLQYLSGVILFEETLYQKTAAGKPFVDVLKEGGVLPGIKVDKGTVELPGTDGETTTQGLDGLAERCQKYYEAGARFAKWRAVLKIGANEPSQLAINENANGLARYAIICQQNGLVPIVEPEILVDGAHDINKCADVTERVLAACYKALNDHHVLLEGTLLKPNMVTPGSESAKVAPEVIAEYTVRALQRTMPAAVPAVVFLSGGQSEEEATVNLNAMNKLETKKPWSLSFSFGRALQQSTLKAWAGKEENVQKAQAAFLTRCKANSEATLGKYAGASNLSEGASESLHVKDYKY

SEQ ID NO: 4724 - protein, 358 aa, Glycine max
MSSFKSKYQDELIANAAYIGTPGKGILAADESTGTIGKRLASINVENVEANRRALRELLFTTPGAFECLSGVILFEETLYQKTASGKPFVELMKEGGVLPGIKVDKGTVELAGTNGETTTQGLDGLGARCQKYYEAGARFAKWRAVLKIGPNEPSELAIHENAYGLARYAVICQENGLVPIVEPEILVDGPHDINKCAEVTERVLAACYKALNDHHVLLEGTLLKPNMVTPGSESKKVTPEVIAQYTVTALQRTVPAAVPAIVFLSGGQSEEEATLNLNAMNKSQGKKPWSLSFSFGRALQQSTLKAWGGKDENIKKAQDALFARCNANSHATLGTYKGDATLAEGASESLHVKDYKY

SEQ ID NO: 4725 - protein, 358 aa, Arnica chamissonis
MSCYRGKYADELIANAAYIGTPGKGILAADESTGTIGKRLSSINVENVESNRRALRELLFCTPGALQYLSGVILFEETLYQKTAAGKPFVDVMKEVGVLPGIKVDKGTVELAGTNSETTTQGLDGLAQRCAQYYSAGARFAKWRAVLKIGTNEPSQLAINENAYGLARYAIICQENGLVPIVEPEILVDGPHDISKCADVTERVLAACYKALNDHHVLLEGTLLKPNMVTPGSDAKKVAPEVVAEYTVRALQRTMPAAVPAVVFLSGGQSEEEATVNLNAMNQYKGKKPWSLSFSFGRALQQSTLKAWAGKEENVKKAQDAFLARCKANSEATLGKYQGGSGLSEGASESLHVKDYNY

SEQ ID NO: 4726 - protein, 358 aa, Gossypium hirsutum
MSCFISKYADELAKNAAYIGTPGKGILAADESTGTIGKRLSSINVENVEDNRRALRELLFTTPGALQYLSGVILFEETLYQKTASGKPFVDVLKEGGVLPGIKVDKGTVELNGTNGETFTQGLDGLAQRCQKYYEAGARFAKWRAVLKISANEPTELAIQENANGLAMYAAICQQCGLVPIVEPEILVDGSHDIKKCAAVTERVLAACYKALNDHHVMLEGTLLKPNMVTPGSDSLKVAPEVIAEYTVRALQRTVPAAVPAIVFLSGGQSEEEATLNLNAMNKLQTKKPWSLSFSFGRALQQSTLKAWAGKEENVKKAQDAFLVRCKANSEATLGTYKGDAKISEGAAESLHVKDYKY

SEQ ID NO: 4727 - protein, 358 aa, Gossypium hirsutum
MSCFISKYADELAKNAAYIGTPGKGILAADESTGTIGKRLSSINVENVEDNRRALRELLFTTPGALQYLSGVILFEETLYQKTASGKPFVDVLKEGGVLPGIKVDKGTVELNGTNGETFTQGLDGLAQRCQKYYEAGARFAKWRAVLKISANEPTELAIQENANGLAMYAAICQQCGLVPIVEPEILVDGSHDIKKCAAVTERVLAACYKALNDHHVMLEGTLLKPNMVTPGSDSPKVAPEVIAEYTVRALQRTVPAAVPAIVFLSGGQSEEEATLNLNAMNKLQTKKPWSLSFSFGRALQQSTLKAWAGKEENVKKAQDAFLVRCKANSEATLGTYKGDAKISEGAAESLHVKDYKY

SEQ ID NO: 4728 - protein, 358 aa, Euphorbia peplus
MSCYKGKYADELIANAAYIGTPGKGILAADESTGTIGKRLSSINVENVEENRRALRELLFTAPGALQYLSGVILFEETLYQKTKSGKPFAELLKENGVLPGIKVDKGTIVLAGTNGETTTQGLDDLAKRCQKYYEAGARFAKWRAVLNIGANEPSQLAINENANGLARYAIICQENGLVPIVEPEILVDGSHDINKCADVTERVLAACYKALNDHKVLLEGTLLKPNMVTPGSDAPKVSPDVIAEYTVRALQRTMPPAVPAVVFLSGGQSEEEATINLNAMNKLKTKKPWTLTFSFGRALQASTLKAWGGKEENVQKAQEALFTRCKANSEATLGTYKGDATLGAGASESLHVKDYKY

SEQ ID NO: 4729 - protein, 358 aa, Plantago ovata
MSCYRGKYADELIANAAYIGTPGKGILAADESTGTIGKRFSSINVENVESNRRALRELLFTTPGVLQYLSGVIFFEETLYQKTAAGKLFVDVLKEGGVLPGIKVDKGTVELAGTNGETTTQGLDDLAQRCQKYYAAGARFAKWRAVLKIGPNEPSQLAINENANGLARYAIICQENGLVPIVEPEVLVDGSHDIEKCADVTERVLAACYKALNDHHVLLEGTLLKPNMVTPGSDSPKVAPEVIAEYTVRALQRTMPCAVPAVVFLSGGQSEEEATINLNAMNKLKSKKPWSLSFSFGRALQQSTLKAWAGKDENIKKAQAAFLARATANSEATLGTYAGSSSLTEGASESLHVKDYKY

SEQ ID NO: 4730 - protein, 358 aa, Primula obconica
MSCYKGKYHDELIANATYIGTPGKGILAADESTGTIGKRLSSINVENVETNRRALRELLFCTPGALQYLSGVILYEETLYQSTAAGKPFVEVLKEGGVLPGIKVDLGTVELAGTNGETTTQGLDGLAARCQKYYKAGARFAKWRAVLKIGPNEPSQLAINENANGLARYAIICQENGLVPIVEPEILVDGSHSIDTCADVTERVLAACYKALNDHKVLLEGTLLKPNMVTPGSDAPKVTPEVIAEYTVRALQRTMPPAVPAVVFLSGGQSEEQATRNLNAMNQLKATKPWSLTFSFGRALQQSTLKAWAGKEENLEKAQAAFLTRCKANSEATLGTYQGSDTLVEGAAESLHVKDYKY

SEQ ID NO: 4731 - protein, 359 aa, Zostera marina
MSAYVGKYADELITNAAYIGTPGKGILAADESTGTIGKRLSSINVENIESNRQALRELLFCTPGALKNHISGVILFEETLYQSTVSGKPFVDVLKEAGALPGIKVDKGVVELAGTCGETTTQGLDDLGKRCKKYYEAGARFAKWRSVLKITANEPSQLSINENANGLARYAIICQENGLVPIVEPEILVDGPHDIDRCADVTERVLAACYKALNDHHVLLEGSLLKPNMVTPGSDAAKVAPKVVAEYTVRTLQRTVPPAVPAVVFLSGGQSEEEATLNLNAMNQLKGKKPWSLSFSFGRALQASTLKTWGGKVENKEKAQTAFYARCKANSEATLGTYKGDAIKGAGVDESLHVKDYKY

SEQ ID NO: 4732 - protein, 358 aa, Cleome spinosa
MSAFTSKYADELIANAAYIGTPGKGILAADESTGTIGKRLASINVENVESNRRALRELLFTAPGALPCLSGVILFEETLYQKASNGKPFVDILKEGGVLPGIKVDKGTVELPGTNGETTTQGLDGLGDRCKKYYEAGARFAKWRSVLKIGQNEPSELAIHENAYGLARYAVICQENGLVPIVEPEILVDGPHDINKCAAVTERVLAACYKALSDHHVLLEGTLLKPNMVTPGSESAKVAPEVIAEHTVRALQRTVPAAVPAIVFLSGGQSEEEATLNLNAMNQLKGKKPWSLSFSFGRALQQSTLKAWAGKDENVAKAQEALLVRCKANSEATLGTYKGDAKRGEGADESLHVKDYKY

SEQ ID NO: 4733 - protein, 358 aa, Vigna unguiculata
MSHFKGKYHDELIANAAYIGTPGKGILAADESTGTIGKRLASINVENVESNRRTLRELLFTAPGALQYLSGVILFEETLYQSTASGKPFVELLKEAGVLPGIKVDKGTVELAGTDGETTTQGLDGLGQRCAKYYEAGARFAKWRAVLKIGPNEPSELSIHENAYGLARYAVICQENGLVPIVEPEILVDGPHDINKCAAVTERVLAACYKALNDHHVLLEGTLLKPNMVTPGSKSAKVTPEVVAEHTVRALQRTVPAAVPAVVFLSGGQSEEEATLNLNAINQVKGKKPWTLSFSFGRALQQSTLKAWGGKDENVKKAQEALLVRAKANSEATLGTYKGDSALGEGASESLHVENYKY

SEQ ID NO: 4734 - protein, 358 aa, Ipomoea nil
MSCYRGKYADELIANAAYIGTPGKGILAADESTGTIGKRFASINVENVESNRRALRELLFTTPGALQYLSGVILFEETLYQKTASGKPFVEVMKEGGVLPGIKVDKGVVELPGTNGETTTQGLDGLAERCKKYYEAGARFAKWRAVLKIGATEPSQLAINENANGLARYAIICQQNGLVPIVEPEILVDGPHDIDKCADVTERVLAACYKALNDHHVLLEGTLLKPNMVTPGSECAKVAPEVIAEYTVRALQRTMPAAVPAVVFLSGGQSEEEATVNLNAMNKLKTKKPWNLSFSFGRALQASTLKIWGGKEENVKNAQANFLERCKANSEATLGTYAGSSNLSAAASESLHVKDYKY

SEQ ID NO: 4735 - protein, 358 aa, Populus trichocarpa
MSCFKNKYADELVKNAAYIGTPGKGILAADESTGTIGKRLSSINVENVEENRRALRELLFCTPGALQHLSGVIFYEETLYQKTASGKPFVDVLKKGGVLPGIKVDKGTVELPGTNGETTTQGLDGLGQRCAKYYEAGARFAKWRAVLKIGLTEPSELAIHENAYGLARYAAICQENGLVPIVEPEILIDGSHSIEKCAAVTERVLAACYKALNDHHVMLEGTLLKPNMVTPGSDAPKVANEVIAKFTVRALQRTVPAAVPAIVFLSGGQSEEEATRNLNAINKLKTKKPWSLSFSFGRALQQSTLKAWAGKTENVEKARAAFLCRCKANSEATLGTYQGDAAPGEGASESLHVKDYKY

SEQ ID NO: 4736 - protein, 358 aa, Nicotiana tabacum
MSCYKGKYADELIANASYIATPGKGILAADESTGTIGKRLSSINVENVEENRRALRELLFLTPGALQYLSGVILFEETLYQKTASGKPFVDVLKEGGVLPGIKVDKGTVELPGTDGETTTQGLDGLAERCQKYYAAGARFAKWRAVLKIGANEPSQLAINDNANGLARYAIICQQNGLVPIVEPEILVDGGHDINKCADVTERVLAACYKALNDHHVLLEGTLLKPNMVTPGSESPKVAPEVIAEYTVRALQRTMPAAVPAVVFLSGGQSEEEATRNLNAMNKLQTKRPWTLSFSFGRALQQSTLKAWGGKVENVEKARAAFLTRCKANSEATLGKYAGSSNLSEGASESLHVKDYKY

SEQ ID NO: 4737 - protein, 265 aa, Silene vulgaris
MKEGGVLPGIKVDKGVVELAGTNGETTTQGLDDLGKRCAQYYSAGARFAKWRAVLKIGPTEPSALSILENANGLARYAIICQENGLVPIVEPEILVDGSHDIDRCAEVTERVLAACYKALNDHHVLLEGTLLKPNMVTPGSDSKKVAPEVIAEYTVRTLQRTVPPAVPGIMFLSGGQSEEEATLNLSAMNKLQTKKPWTLSFSYGRALQSSTLKAWQGKEENVKKAQEVFLARAKGNSEATLGKYVGGAGGADAAESLHVKDYTY

SEQ ID NO: 4738 - protein, 147 aa, Pennisetum glaucum
MASPSSMSSTREDKGTIEVAGTNKETTTQGHDDLGKRCAKYYEAGARFAKWRAVLNIGPNEPSQLAIDLNAQGLARYAIICQENGLVPIVEPEILVDGPHDIERCAYVTEVVLAACYKALNEHHVLLEGTLLKPNMVTPGSDRWPLR

SEQ ID NO: 4739 - protein, 358 aa, Chelidonium majus
MSCYKGKYHDELIANATYIGTPGKGILAADESTGTIGKRLSSINVENNESNRRALRELLFCTPGAFDCLSGVILFEETLYQKTAAGKPFVEVMKEAGVLPGIKVDKGTVELAGTNGETTTQGLDGLAQRCQQYYTAGARFAKWRAVLKIGANEPSQLAINENANGLARYAIICQENGLVPIVEPEILVDGSHDIDRCADVTERVLAACYKALNDHKVLLEGTLLKPNMVTPGSDSKKVSPDVIAAYTVRTLLRTMPPAVPAVVFLSGGQSEEEATLNLNAMNKLKGKKPWSLTFSFGRALQQSTLKAWAGKEENVEKAQAAFLTRCKANSEATLGTYKGDAVIGEGASESLHVKDYKY

SEQ ID NO: 4740 - protein, 358 aa, Zostera marina
MSAFTGKYADELIANAASIGTPGKGILAADESTGTIGKRLASINVENTESNRQALRELLFCTPGALMCISGVILYEETLYQSTAAGKPFVDVLNEAGVLPGIKVDQGVVELSGTNGETTTQGLDNLGKRCKKYYDAGARFAKWRAVLKIGPTEPSQLSIQENANGLARYAIICQENGLVPIVEPEILVDGPHDIERCADVSERVLAACYKALNDHHVLLEGTLLKPNMVTPGSDAKKVAPDVIAVYTVRTLQRTVPPAVPAVVFLSGGQSEEEATRNLNAMNQLKGKKPWALSFSFGRALQASTLKTWGGKVENKEKAQAAFLARCKANSEATLGTYKGDAAQADGVSESLHVKDYKY

SEQ ID NO: 4741 - protein, 358 aa, Raphanus sativus
MSAFTSKYADELIANAAYIGTPGKGILAADESTGTIGKRLASINVENVESNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSELSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 4742 - protein, 358 aa, Triphysaria pusilla
MSCYKGKYADELITNAKYIGTPGKGILAADESTGTIGKRLSSINVENVESNRRALRELLFTTPGALQYLSGVILYEETLYQKTAAGKPFVDVMKEGGVLPGIKVDSGTVELAGTNGETTTQGLDGLAQRCQKYYAAGARFAKWRAVLKIGANEPSQLAINENANGLARYAIICQENGLVPIVEPEILVDGTHDINKCADVTERVLAACYKALNDHHVLLEGTLLKPNMVTPGSDSAKVAPEVVAEYTVRALQRTMPAAVPAVVFLSGGQSEEEATVNLNAMNKLKANKPWSLSFSFGRALQQSTLKAWSGKEENVAKAQAAFLARAKANSEATLGTYKGSGSLSEGASESLHVKDYKY

SEQ ID NO: 4743 - protein, 297 aa, Primula obconica
MSCYKGKYHDELIANATYIGTPGKGILAADESTGTIGKRLSGINVENVETNRRALRELLFCTPGALQYLSGVILYEETLYQSTAAGKPFVEVLKEGGVLPGIKVDLGTVELAGTNGETTTQGLDGLAARCQKYYKAGARFAKWRAVLKIGPNEPSQLAINENANGLARYAIICQENGLVPIVEPEILVDGSHSIDTCADVTERVLAACYKALNDHKVLLEGTLLKPNMVTPGSDRPQGDPGGDSGVHGEGPAEDDAASCPGSGVSLRRPKRGTSYPKPQRHEPAQGHQAMEPYFLLR

SEQ ID NO: 4744 - protein, 92 aa, Gossypium hirsutum
MSCFISKYADELAKNAAYIGTPGKGILAADESTGTIGKRLSSINVENVEDNRRALRELLFTTPGALQYLSGVILFEETLYQKTASASPSLMF

SEQ ID NO: 4745 - protein, 358 aa, Theobroma cacao
MSCFISKYAEELAKNAAYIGTPGKGILAADESTGTIGKRLSSINVENVEDNRRALRELLFTTPGALQYLSGVILFEETLYQKASSGKPFVEILKEGGVLPGIKVDKGTVELNGTNGETFTQGLDGLAQRCQKYYEAGARFAKWRAVLKIAVNEPTELAIQENANGLAMYAAICQQCGLVPIVEPEILVDGPHDIKKCAEVTERVLAACYKALNDHHVMLEGTLLKPNMVTPGSESPKVAPEVIAEYTVRALQRTVPAAVPAIVFLSGGQSEEEATLNLNAMNKLKTKKPWSLSFSFGRALQQSTLKAWAGKEENVKKAQAALLVRCKANSEATLGTYKGDAQLGEGAAESLHVKDYKY

SEQ ID NO: 4746 - protein, 358 aa, Gossypium hirsutum
MSCFISKYADELAKNAAYIGTPGKGILAADESTGTIGKRLSSINVENVEDNRRALRELLFTTPGALQHLSGVILFEETLYQKTASGKPFVDVLKEGGVLPGIKVDKGTVELNGTHGETFTQGLDGLAQRCQKYYEAGARFAKWRAVLKISANEPTELAIQENANGLAMYAAICQQCGLVPIVEPEILVDGSHDIKKCAAVTERVLAACYKALNDHHVMLEGTLLKPNMVTPGSDSPKVAPEVIAEYTVRALQRTVPAAVPAIVFLSGGQSEEEATLNLNAMNKLQTKKPWSLSFSFGRALQQSTLKAWAGKEENVKKAQDAFLVRCKANSEATLGTYKGDAKISEGAAESLHVKDYKY

SEQ ID NO: 4747 - protein, 349 aa, Cucurbita pepo
DELIANAAYIGTPGKGILAADESTGTIGKRFASINVENVETNRRALRELLFTAPNALQYLSGVILFEETLYQKTSAGKPFVDVLKEGGVLPGIKVDKGTVELAGTNGETTTQGLDGLAQRCQKYYEAGARFAKWRAVLKIGANEPSQLAINENANGLARYAIICQENGLVPIVEPEILVDGSHDINKCADVTERVLAACYKALNDHHVLLEGTLLKPNMVTPGSQSAKVAPEVVAEYTVRALQRTVPAAVPAVVFLSGGQSEEEATVNLNAMNKLKGKKPWSLSFSFGRALQQSTLKAWSGKEENIPKAQAALLVRCKANSEATLGTYKGDAKISEGASESLHVDNYSY

SEQ ID NO: 4748 - protein, 357 aa, Silene vulgaris
MTAYRGKYADELIANAAYIATPGKGILAADESTGTIGKRFAGINVENVENNRRALRELLFTTPGAFEYLSGVILFEETLYQKSAAGKPFVEILKEGGVLPGIKVDKGVVELAGTDGETTTQGLDDLGKRCAQYYSAGARFAKWRAVLKIGPTEPSALSILENANGLARYAIICQENGLVPIVEPEILVDGSHDIDRCAEVSERVLAACYKALNDHHVLLEGTLLKPNMVTPGSDSKKVANEVIAEYTVRTLQRTVPPAVPGIMFLSGGQSEEEATLNLNAMNKLETKKPWTLSFSYGRALQSSTLKTWQGKEENVGKAQEVFLARAKGNSEATLGKYTGGAGGADASESLHVKDYKY

SEQ ID NO: 4749 - protein, 357 aa, Artemisia annua
MSCYKGKYADELIANAAYIGTPGKGILAADESTGTIGKRFDSIKVENVESNRRALRELLFCTPGALDYLSGIILFEETLYQKTASGKPFVDVMKEANVLPGIKVDKGTVELAGTNGETTTQGLDGLGARCAQYYAAGARFAKWRAVLKIGANEPSQLAINENANGLARYAIICQENGLVPIVEPEILVDGPHDINKCADVTERVLAACYKALNDHHVLLEGTLLKPNMVTPGSDAKKVAPEVVAEYTVRALQRTMPPAVPAVVFLSGGQSEEEATVHLNAMNQLKGKKPWTLTFSFGRALQQSTLKAWAGKEENVKKAQEVFLIRCKANSEATLGKYTGGAAVEGATESLHVKDYKY

SEQ ID NO: 4750 - protein, 358 aa, Unknown
  Sequence found in Organisms: Brassica napus, Brassica oleracea
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSELSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 4751 - protein, 358 aa, Brassica rapa
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSELSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWGGKEENVKAAQEALYVRCKANSEATLGTYKGDAKLGDGAAESLHVKDYKY

SEQ ID NO: 4752 - protein, 358 aa, Manihot esculenta
MSCFKGKYHDELIANAAYIGTPGKGILAADESTGTIGKRLASINVENVESNRRAYRELLFCAPGVLQFLSGVILFEETLYQKTTDGKLFVDILKGGGVLPGIKVDKGIVELPGTNGETSTLGLDGLAERCQKYYEAGARFAKWRAVLKIGPTEPSQLAISENANGLARYAIICQENGLVPIVEPEILVDGSHDINRCADVTERVLAACYKALNDNHVLLEGTLLKPNMVTPGSDSAKVKPEVVAEYTVRALQRTVPPAVPAIVFLSGGQSEEEATINLNAMNKLKCKTPWSLTFSFGRALQQSTLKAWAGKEENVKPAQAALHVRCKANSEATLGSYKGDATLGEGAAESLHVKDYKY

SEQ ID NO: 4753 - protein, 357 aa, Cichorium intybus
MSCYKGKYADELIANAAYIGTPGKGILAADESTGTIGKRLSSINTENNETNRRALRELLFCTPGALQYLSGIILFEETLYQKTAAGKPFVEIMKEAKVLPGIKVDKGTVELAGTNGETTTQGLDGLGQRCAQYYAAGARFAKWRAVLKIGPNEPSQLAINENANGLARYAIICQENGLVPIVEPEILVDGTHDINKCADVTERVLAACYKALNDHHVLLEGTLLKPNMVTPGSDSKKVSPEVVAEYTVRALQRTMPCAVPAVVFLSGGQSEEEATVNLNAMNQYTGKKPWSLTFSFGRALQQSTLKAWGGKEENVKKAQEAFLARCKANSEATLGKYKGGAAFEGASESLHVKDYKY

SEQ ID NO: 4754 - protein, 358 aa, Ipomoea batatas
MSCYRGKYADELIANAAYIGTPGKGILAADESTGTIGKRFASINVENVETNRRALRELLFTTPGALKYLSGVILFEETLYQKTASGKPFVEVMKEGGVLPGIKVDKGVVELPGTNGETTTQGLDGLAERCKKYYEAGARFAKWRAVLKIGATEPSQLAINENANGLARYAIICQQNGLVPIVEPEILVDGPHDIDKCADVTERVLAACYKALNDHHVLLEGTLLKPNMVTPGSECAKVSAEVIAEYTVRALQRTMPAAVPAVVFLSGGQSEEEATVNLNAMNKLKTKKPWNLSFSFGRALQASTLKIWGGKEENVKAAQANFLERCKANSEATLGTYAGSANISAAASESLHVKDYKY

SEQ ID NO: 4755 - protein, 358 aa, Lactuca sativa
MSCYRGKYADELIANAAYIGTPGKGILAADESTGTIGKRLSSINVENVESNRRALRELLFCTPGALQYLSGVILYEETLYQKTAAGKPFVDVMKEAGVLPGIKVDKGTVELAGTDGETTTQGLDGLAQRCAQYYTAGARFAKWRAVLKIGPNEPSQLAINENANGLARYAIICQENGLVPIVEPEILVDGSHDINKCADITERVLAACYKALNDHKVLLEGTLLKPNMVTPGSDAKKVAPEVVAEYTVRALQRTMPPAVPAVVFLSGGQSEEEATVNLNAMNQFKGKKPWTLTFSFGRALQQSTLKAWSGKEENVGKAQAAFLARCKANSEATLGIYKGGSGLSEGASESLHVKDYKY

SEQ ID NO: 4756 - protein, 68 aa, Pennisetum glaucum
MSPLAPLASVSQASTLRTSRRTVVPSVSSPGALPCLSGVILFEETLYQKTKDGKPFVDVLKEGGQGHH

SEQ ID NO: 4757 - protein, 358 aa, Solanum lycopersicum
MSCYKGKYADELIKNATYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIKKCADVTERVLAACYKALNDHHVLLEGTLLKPNMVTPGSESPKVAPEVIAEYTVRALQRTMPPAVPAVVFLSGGQSEEEATVNLNAMNKLQTKKPWSLSFSFGRALQQSTLKAWGGKEENVQKAQAAFLTRCKANSEATLGKYAGASNLSEGASESLHVKDYKY

SEQ ID NO: 4758 - protein, 358 aa, Triphysaria pusilla
MSCYKGKYADELIANAKYIGTPGKGILAADESTGTIGKRLSSINVENVESNRRALRELLFTTPGALQYLSGVILYEETLYQKTAAGKPFVDVMKEGGVLPGIKVDSGTVELAGTNGETTTQGLDGLAQRCQKYYSAGARFAKWRAVLKIGPNEPSQLAINENANGLARYAIICQENGLVPIVEPEILVDGTHDINKCADVTERVLAACYKALNDHHVLLEGTLLKPNMVTPGSDSAKVAPEVVAEYTVRALQRTMPPAVPAVVFLSGGQSEEEATVNLNAMNKLKANKPWSLSFSFGRALQQSTLKAWGGKEENVGKAQAAFLARAKANSEATLGTYKGSGSLSEGASESLHVKDYKY

SEQ ID NO: 4759 - protein, 328 aa, Catharanthus roseus
MSCYRGQYADELIANATYIGTPGKGILAADESTGTIGKRLASINVENVESNRRALRELLFTTPGALQYLSGVILFEETLYQKTADGKPFVDVMKEAGVLPGIKVDKGTVELPGTNGETTTQGLDGLAQRCQEYYKAGARFAKWRAVLKIGPNEPSQLAINENANGLARYAIICQQNGLVPIVEPEILVDGSHDINKCADVTERVLAACYKALNDHHVLLEGTLLKPNMVTPGSDSPKVAPEVIAEYTVRALQRTMPAAVPAVVFLSGGQSEEEATVNLNAMNKLQTKKPWSLSFSFGRALQQSTLKTWAGKEENSSEGTGCIPHQVQG

SEQ ID NO: 4760 - protein, 92 aa, Fagopyrum esculentum
MSAYRGKYADELIANAAYIGTPGKGILAADESTGTIGKRLSSINVENVETNRRALRELLFTTPGAFECLSGVILFEETLYQKTASGKLLLML

SEQ ID NO: 4761 - protein, 275 aa, Taraxacum officinale
MSCYRGKYADELIANAAYIGTPGKGILAADESTGTIGKRLSSINVENIESNRRALRELLFCTPGALQYLSGVILFEETLYQKTAAGKPFVDVMKEAGVLPGIKVDKGTVELAGTDGETTTQGLDGLAQRCAQYYTAGARFAKWRAVLKIGPNEPSQLAITENANGLARYAIICQENGLVPIVEPEILVDGSHDIAKCADVTERVLAACYKALNDHKVLLEGTLLKPNMVTPGSDSKRSHRRSWPSTRSEPCNGPCRPRFQPSCFCPVGRVRKRRL

SEQ ID NO: 4762 - protein, 277 aa, Lactuca sativa
MSCYRGKYADELIANAAYIGTPGKGILAADESTGTIGKRLSSINVENIESNRRALRELLFCTPGALQYLSGVILYEETLYQKTAAGKPFVDVMKEAGVLPGIKVDKGTVELAGTDGETTTQGLDGLAQRCAQYYTAGARFAKWRAVLKIGPNEPSQLAINENANGLARYAIICQENGLVPIVEPEILVDGSHDINKCADVTERVLAACYKALNDHKVLLEGTLLKPNMVTPGSDAKKVAPEVVAEYTVRALQRTMPPAVPAVVFLSGGQSEEKRRLI

SEQ ID NO: 4763 - protein, 223 aa, Raphanus sativus
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSELSIHENAYGLARYAVICQENGLVPIVEPEILVDGSHDIHKCAAVTERVLAACYKLLATTTFCSRGLS

SEQ ID NO: 4764 - protein, 350 aa, Malus domestica
TDELVANATYIGTPGKGILAADESTGTIGKRLSSINVENTENNRRALRELLFCAPGALQYLSGVILFEETLYQKTAGGKPFVDILKDGGVLPGIKVDKGTVELAGTNGETTTQGLDGLAQRCQQYYEAGARFAKWRAVLKIGPNEPTQLAIHENANGLARYAVICQENGLVPIVEPEILVDGSHDIERCADVTERVLAACYKALNDHHVLLEGTLLKPNMVTPGSDAKKVSPEVVSYHTLRALQRTMPPAVPAVVFLSGGQSEEEATLNLNAMNKLNTKKPWSLSFSFGRALQQSTLKAWAGKDENVEKARAAFLARCKANSDATLGTYKGDAALGDGASESLHVKDYKY

SEQ ID NO: 4765 - protein, 358 aa, Plantago ovata
MSCYRGKYADELIANATYIGTPGKGILAADESTGTIGKRLSSINVENVETNRRALRELLFTTPDVLQYLSGVILFEETLYQKTAAGKPFVDVLKEGGVLPGIKVDKGTVELAGTNGETTTQGLDGLAQRCQQYYAAGARFAKWRAVLKIGPNEPSQLAINDNANGLARYAIICQENGLVPIVEPEILVDGSHDIEKCADVTERVLAACYKALNDHHVLLEGTLLKPNMVTPGSDSPKVAPEVIAEYTVRALQRTMPPAVPAVVFLSGGQSEEEATVNLNAMNKLKGKKPWSLSFSFGRALQQSTLKAWAGKEENIGKAQAAFYARAKANSEATLGTYQGSSSLSEGAGESLHVKDYKY

SEQ ID NO: 4766 - protein, 357 aa, Vinca minor
MSCYRGEYADELIANASYIGTPGKGILAADESTGTIGKRLSSINVENVETNRRALRELLFTTPGCLQYLSGVILFEETLYQKTADGKPFVDVMKEGGVLPGIKVDKGTVELPGTNGETTTQGLDGLAQRCQQYYKAGARFAKWRAVLKIGPNEPSQLAINDNANGLARYAIICQQNGLVPIVEPEILVDGSHDINKCADVTERVLAACYKALNDHHVLLEGTLLKPNMVTPGSDSPKVTPEVIAEHTVRALQRTMPAAVPAVVFLSGGQSEEEASVNLNAMNKLQTKKPWSLSFSFGRALQQSTLKAWSGKEENVKKAQEVFLARCKANSEATLGKYAGGASGGAASESLHVKDYKY

SEQ ID NO: 4767 - protein, 358 aa, Arabidopsis lyrata
MSCFTTKFADELIANAAYIGTPGKGILAADESTGTIGKRLASINVENVESNRRALRELLFTTPGALPCLSGVILFEETLYQKSSNGTPFVDMLKSAGVLPGIKVDKGTVELAGTNAETTTQGLDGLGDRCKKYYEAGARFAKWRAVLKIGQNEPSELAIHENAYGLARYAVICQENGLVPIVEPEILVDGSHDIHKCAAVTERVLAACYKALSDHHVLLEGTLLKPNMVTPGSESAKVAPEVIAEHTVRALQRTVPAAVPAIVFLSGGQSEEEATRNLNAMNKLKTKKPWSLSFSFGRALQQSTLKTWGGKEENVKKAQEAFLVRCKANSEATLGTYKGDAKLGEGAAESLHVKDYKY

SEQ ID NO: 4768 - protein, 358 aa, Arabidopsis lyrata
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTNGETTTQGLDGLGDRCKKYYEAGARFAKWRAVLKIGENEPSELSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 4769 - protein, 358 aa, Arabidopsis thaliana
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAVICQENGLVPIVEPEILVDGSHDIQKCAAVTERVLAACYKALSDHHVLLEGTLLKPNMVTPGSESAKVAPEVIAEHTVRALQRTVPAAVPAIVFLSGGQSEEEATRNLNAMNQLKTKKPWSLSFSFGRALQQSTLKTWGGKEENVKKAQEAFLVRCKANSEATLGAYKGDAKLGEGAAESLHVKDYKY

SEQ ID NO: 4770 - protein, 358 aa, Brassica juncea
MSAFTSKFADELIANAAYIGTPGKGILAADESTGTIGKRLASINVENVESNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 4771 - protein, 358 aa, Unknown
  Sequence found in Organisms: Brassica napus, Brassica rapa
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 4772 - protein, 358 aa, Brassica napus
MSAFTSKYADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPPAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 4773 - protein, 357 aa, Catharanthus roseus
MSCYRGQYADELIANATYIGTPGKGILAADESTGTIGKRLASINVENVESNRRALRELLFTTPGALQYLSGVILFEETLYQKTADGKPFVDVMKEAGVLPGIKVDKGTVELPGTNGETTTQGLDGLAQRCQEYYKAGARFAKWRAVLKIGPNEPSQLAINENANGLARYAIICQQNGLVPIVEPEILVDGSHDINKCADVTERVLAACYKALNDHHVLLEGTLLKPNMVTPGSDSPKVAPEVIAEYTVRALQRTMPAAVPAVVFLSGGQSEEEATVNLNAMNKLQTKKPWSLSFSFGRALQQSTLKTWAGKEENVQKAQAAFLTRCKANSEATLGKYAGGAAGGAAAESLHVKDYKY

SEQ ID NO: 4774 - protein, 358 aa, Actinidia deliciosa
MSCFKGKYHDELIANAAYIGTPGKGILAADESTGTMGKRLSSINVENVESNRQAFRELLFTTPGALQHLSGVILFEETLYQKTSDGKPFVELLKENGVLPGIKVDKGVVELPGTNGETTTQGLDDLGKRCQQYYAAGCRFAKWRAVLKIGVTEPSQLAINENANGLARYAIICQENGLVPIVEPEILVDGNHSIDKCADATERVLAAVYKALNDHHVLLEGTLLKPNMVTPGSDAPKVAPEVVAEYTVRALQRTMPAAVPAVVFLSGGQSEEEATLNLNAMNKLKTKKPWTLTFSFGRALQASTLKAWLGKAENVEKAKAVFLQRCKANSEATLGTYKGSGSLSEGASESLHVKDYKY

SEQ ID NO: 4775 - protein, 358 aa, Tropaeolum majus
MSCFQSKYADELIANAAYIGTPGKGILAADESTGTIGKRLSSINVENTEANRRALRELLFCAPGALQYLSGIILFEETLYQKTADGKPFVDVMKEAGVLPGIKVDKGTVELAGTNGETTTQGLDGLGARCAKYYEAGARFAKWRAVLKISETEPSELAIHENAYGLARYAVICQENGLVPIVEPEILVDGSHDIEKCAAVTERVLAACYKALSDHHVILEGTLLKPNMVTPGSDSPKVSPQKIAEYTVRALQRTTPAAVPAIVFLSGGQSEEEATLNLNAMNQLQGKKPWSLSFSFGRALQQSTLKAWAGKEEFIGKAQAALLTRCKANSEATLGTYKGDATLAEGAAESLHVKDYKY

SEQ ID NO: 4776 - protein, 357 aa, Helianthus annuus
MSCYKGKYADELIANATYIGTPGKGILAADESTGTIGKRLSSINVENVESNRRALRELLFCTPGALQYLSGIILFEETLYQKTADGKLFVDVMKEANVLPGIKVDKGTVELAGTNGETTTQGLDGLAQRCAKYYEAGARFAKWRAVLKIGPNEPSQLAINENANGLARYAIICQENGLVPIVEPEILVDGPHDINKCADVTERVLAACYKALNDHHVLLEGTLLKPNMVTPGSDSNKVAPQVVAEYTVRALQRTMPAAVPAVVFLSGGQSEEEATVHLNAINQYQGKKPWSLTFSFGRALQQSTLKAWGGKEENVNKAQEAFLTRCKANSEATLGKYQGGAAVEGATESLHVKDYKY

SEQ ID NO: 4777 - protein, 358 aa, Glycine max
MSSFKSKYQDELIANATYIGTPGKGILAADESTGTIGKRLASINVENVETNRRILRELLFTAPGCLECLSGVILFEETLYQKSAAGVPFVDILKKGGVLPGIKVDKGTVELAGTNGETTTQGLDDLAQRCKKYYEAGARFAKWRAVLKIGPNEPSPLSIHENANGLARYAAICQENGLVPIVEPEILSDGPHDIAKCADVTERVLAACYKALNDHHVLLEGTLLKPNMVTPGSEAARVTAEVIAEHTVRALQRTVPPAVPAIVFLSGGQSEEEATVNLNAMNQLKGKKPWSLTFSYGRALQQSTLKAWGGKDENIPKAQSALLVRCKANSEATLGTYKGDATLGEGASESLHVKDYKY

SEQ ID NO: 4778 - protein, 357 aa, Arnica chamissonis
MSCYKGKYADELIANAAYIGSPGKGILAADESTGTIGKRLSSINVENVESNRRALRELLFCTPGALQYLSGIILFEETLYQKTAAGKPFVDVMKEANVLPGIKVDKGTVELAGTDGETTTQGLDGLAQRCAKYYEAGARFAKWRAVLKIGPNEPSQLSINENANGLARYAIICQENGLVPIVEPEILVDGSHDINKCADVTERVLAACYKALNDHHVLLEGTLLKPNMVTPGSESKKVAPEVVGEYTVRALQRTMPAAVPAVVFLSGGQSEEEATVNLNAINQYKGKKPWSLTFSFGRALQQSTLKAWGGKEENVKKAQEAFLARCKANSEATLGKYQGGAAVEGATESLHVKGYKY

SEQ ID NO: 4779 - protein, 358 aa, Arnica chamissonis
MSCYRGKYADELIANAAYIGTPGKGILAADESTGTIGKRLSSINVENVESNRRALRELLFCTPGALQYLSGVILFEETLYQKTAAGKPFVDVMKEAGVLPGIKVDKGTVELAGTDGETTTQGLDGLAQRCAQYYSAGARFAKWRAVLKIGPNEPSQLAINENANGLARYAIICQENGLVPIVEPEILVDGPHDINKCADVTERVLAACYKALNDHHVLLEGTLLKPNMVTPGSDAEKVTPEVVAEYTVRALQRTMPPAVPAVVFLSGGQSEEQASINLNAINQYKGKKPWSLTFSFGRALQQSTLKAWGGKEENVKKAQDAFLTRCKANSEATLGKYQGSSGLSEGASESLHVKGYKY

SEQ ID NO: 4780 - protein, 357 aa, Fagopyrum esculentum
MSAFRGKYADELIANATYIGTPGKGILAADESTGTIGKRLSSINVENVESNRRALRELLFTTPGALKFLSGVILFEETLYQKTADGKPFVDLLKENGVLPGIKVDKGTVELAGTDGETTTQGLDGLAQRCQQYYAAGARFAKWRAVLKIGPTEPSQLSINENANGLARYAIICQENGLVPIVEPEILVDGSHSIERCAAITENVLAACYKALNDHHVLLEGTLLKPNMVTPGSDSPKVSPEVIAEHTVRALQRTVPAAVPAIVFLSGGQSEEQATINLNAMNKLQTKKPWSLTFSFGRALQQSTLKAWAGKEENVKHAQEVFYGRCKANSEATLGKYEGGAAVEGATESLHVKDYKY

SEQ ID NO: 4781 - protein, 357 aa, Silene vulgaris
MTAYRGKYADELIANAAYIATPGKGILAADESTGTIGKRFAGINVENVENNRRALRELLFTTPGAFEYLSGVILFEETLYQKSAAGKPFVEILKEGGVLPGIKVDKGVVELAGTDGETTTQGLDDLGKRCAQYYSAGARFAKWRAVLKIGPTEPSALSILENANGLARYAIICQENGLVPIVEPEILVDGSHDIDRCAEVSERVLAACYKALNDHHVLLEGTLLKPNMVTPGSDSKKVANEVIAEYTVRTLQRTVPPAVPGIMFLSGGQSEEEATLNLNAMNKLETKKPWTLSFSYGRALQSSTLKTWQGKEENVGKAQEVFLARAKGNSEATLGKYTGGAGGADSSESLHIKDYKY

SEQ ID NO: 4782 - protein, 358 aa, Brassica rapa
MSAFTSKYADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGLARYAVICQENGLVPIVEPEILVDGSHDIHKCAAVTERVLVACYKALSDHHVLLEGTLLKPNMVTPGSDSAKVAPEVIAEHTVRSLQRTVPPAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 4783 - protein, 358 aa, Ricinus communis
MSCFKGKYHDELIANATYIGTPGKGILAADESTGTIGKRLASINVENIEPNRRAFRELLFCTPGALECLSGVILFEETLYQKTADGKLFVDILKKNGVLPGIKVDKGIVQLAGTNAETSTLGLDGLAERCQKYYEAGARFAKWRAVLKISSTEPSQLAINENANGLARYAIICQENGLVPIVEPEILVDGSHDIDCCADVTERVLASCYKALNDHHVLLEGTLLKPNMVTPGSDNSKVKPEVIADYTVRALQRTVPPAVPAIVFLSGGQSEEEATINLNAMNKLKGKKPWSLTFSFGRALQQSTLKAWGGKEENIKKAQAAFLVRCKANSEATLGSYKGDAKLGEGAAESLHVKDYKY

SEQ ID NO: 4784 - protein, 358 aa, Actinidia deliciosa
MSCYKGKYHDELIANAAYIGTPGKGILAADESTGTMGKRLSSINVENVESNRRAFRELLFTTPGALEYLSGVILFEETLYQKTSDGKPFVELLKENGVLPGIKVDKGVVVLPGTNGETTTQGLDDLGKRCQQYYAAGCRFAKWRAVLNIGITEPSQLAINENANGLARYAIICQENGLVPIVEPEILVDGNHSIDKCADVTERVLAAVYKALNDHHVLLEGTLLKPNMVTPGSEAPKVAPEVVAEYTVRALQRTMPAAVPAVVFLSGGQSEEEATLNLNAMNKLKTKKPWTLTFSFGRALQASTLKAWQGKVENVEKAKAVFLQRCKANSEATLGTYKGSSSLSEGASESLHVKDYKY

SEQ ID NO: 4785 - protein, 358 aa, Unknown
  Sequence found in Organisms: Solanum tuberosum, Solanum phureja
MSCYKGKYADELIKNAAYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIQKCADVTERVLAACYKALNDHHVLLEGTLLKPNMVTPGSESPKVAPEVIAEYTIRALQRTMPPAVPAVVFLSGGQSEEQATVNLNAMNKLQTKKPWSLSFSFGRALQQSTLKAWGGKEENVQKAQAAFLTRCKANSDATLGKYAGASNLSEGASESLHVKDYKY

SEQ ID NO: 4786 - protein, 346 aa, Thalictrum flavum
IANAAYIGTLGKGILAADESTGTIGKRLASINVENVETNRRALRELLFCTPGALQYLSGVILFEETLYQKTADGKPFVEVLKEGGVLPGIKVDKGTVELAGTNGETTTQGLDGLAQRCQQYYAAGARFAKWRAVLKIGPTEPSQLAINENANGLARYAIICQENGLVPIVEPEILVDGSHDIDRCADVTERVLAACYKALNDHHVLLEGTLLKPNMVTPGSEAKQVAPEVVAEYTVRALQRTMPSAVPAVVFLSGGQSEEQATLNLNAMNKLKGKKPWSLSFSFGRALQQSTLKTWAGKEENLERAQAAFLSRCKANSEATLGIYKGDAAQGEGVSESLHVKGYKY

SEQ ID NO: 4787 - protein, 358 aa, Trigonella foenum-graecum
MSSFKSKYQDELIANAAYIGSPGKGILAADESTGTIGKRLASISVENVETNRRALRELLFTTPGAFGCLSGVILFEETLYQKTAAGKPFVELLKEGGVLPGIKVDKGTVELAGTNGETTTQGLDGLGQCCQKYYEAGARFAKWRAVLKIGPNEPSELAIHENAYGLARYAVICQENGLVPIVEPEILVDGSHDINKCAEVTERVLAACYKALNDHHVLLEGTLLKPNMVTPGSDSPKVAPEVIAEYTVKALQRTVPAAVPAVVFLSGGQSEEQATLNLNAMNKFKGKKPWALSFSFGRALQQSTLKAWAGKDENIKKAQDAFISRCKANSCATWGIYEGDATLGEGASESLHVKDYKY

SEQ ID NO: 4788 - protein, 357 aa, Vinca minor
MSCYRGEYADELIANAAYIGTPGKGILAADESTGTIGKRLSSINVENVETNRRALRELLFTTPGCLQYLSGVILFEETLYQKTAAGKPFVDVMKEGGVLPGIKVDKGTVELAGTNGEITTQGLDGLAERCKQYYKAGARFAKWRAVLKIGPSEPSQLAINDNANGLARYAIICQQNGLVPIVEPEILVDGSHDINKCADVTERVLAACYKALNDHHVLLEGTLLKPNMVTPGSDSPKVSPEVIAEHTVRALQRTMPPAVPAVVFLSGGQSEEEASVNLNAMNKLQTKKPWSLSFSFGRALQQSTLKAWAGKEENVKKAQEVFLARCKANSEATLGKYAGGASGAAASESLHVKDYKY

SEQ ID NO: 4789 - protein, 358 aa, Arabidopsis thaliana
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 4790 - protein, 358 aa, Brassica napus
MASFTSKYADELIANAAYIGTPGKGILAADESTGTIGKRLSSINVENVESNRRALRELLFTTPGALPCLSGVILFEETLYQKSSKGTPFVDILKEGGVLPGIKVDKGTVSLPGTNGETTTQGLDGLGERCKKYYEAGARFAKWRAVLKIGPNEPSELAIRENAYGLARYAAICQENGLVPIVEPEILVDGSHDIQKCAEVTERVLAACYKALSDHHVMLEGTLLKPNMVTPGSESGKVAPEVVAEYTVRALQRTVPAAVPAVVFLSGGQSEEEATRNLNAMNQLKTKKPWSLSFSFGRALQQSTLKTWGGKEENVKKAQEAFLVRCKANSEATLGVYKGDAQLGEGAAESLHVKDYKY

SEQ ID NO: 4791 - protein, 364 aa, Manihot esculenta
IEFFLFFFALQNAGADELIANAAYIGTPGKGILAADESTGTIGKRLASINVENVESNRRAFRELLFCTPDVLQFLSGVILFEETLYQKRTDGKPFVDILKEGGVLPGIKVDKGIVELPGTNGETSTLGLDGLAERCQKYYEAGARFAKWRAVLKIGPTEPSQLSINENANGLARYAIICQENGLVPIVEPEILVDGSHDINRCADVTERVLAACYKALNDHHVLLEGTLLKPNMVTPGSDSPKVKPEVIAEYTVRALQRTVPPAVPAIVFLSGGQSEEEATINLNAMNKLKGKKPWSLTFSFGRALQQSTLKAWAGKEENVKKAQAAFHVRCKANSEATLGSYKGDATLGEGAADSLHVKDYKY

SEQ ID NO: 4792 - protein, 357 aa, Lactuca sativa
MSCYRGKYADELIANATYIGTPGKGILAADESTGTIGKRLSSINVENNESNRRALRELLFCTPGALQYLSGVILFEETLYQKTAAGKPFVDVMKEANVLPGIKVDKGTVELAGTDGETTTQGLDGLAQRCAQYYAAGARFAKWRAVLKIGPNEPSQLAINENANGLARYAIICQENGLVPIVEPEILVDGSHDINKCADVTERVLAACYKALNDHHVLLEGTLLKPNMVTPGSDAKKVAPEVVAEYTVRALQRTMPPAVPAVVFLSGGQSEEQATVHLNAMNQFKGKKPWSLTFSFGRALQQSTLKAWGGKEENVKKAQEAFLARCKGNSEATLGKYQGSAAFEGASESLHVKDYKY

SEQ ID NO: 4793 - protein, 358 aa, Lotus japonicus
MSAFKSKFEDELIANAAYIGSPGKGILAADESTGTIGKRFDSIKVENVESNRRALRELLFTAPGCVECLSGVIMFEETLYQKTASGKLFVDVLKEANVLTGIKVDKGTVELAGTNGETTTQGLDDLGKRCQKYYEAGARFAKWRAVLKIGPNEPSPLSIHENAYGLARYAAICQENGLVPIVEPEILVDGSHDINICADVTERVLAACYKALNDHHVLLEGTLLKPNMVTPGSDSPKVAPEVIAEHTVRALLRTVPPAVPAIVFLSGGQSEEEATVNLNAMNKLKGKKPWSLTFSFGRALQQSTLKAWAGKEENVETAQATFLTRCKANSEATLGSYKGDANLAEGASESLHVKDYKY

SEQ ID NO: 4794 - protein, 307 aa, Artemisia annua
MSCYKGKYHDELIANAAYIGTPGKGILAADESTGTIGKRFAAINVENVETNRRTYRELLFCTPGALQYLSGAILFEETLFQKTADGKPFVEVLQEGGVLPGIKVDKGTVELAGTNGEATTQGLDGLAQRCQQYYAAGARFAKWRAVLKIGAAEPSQLAINENANGLARYAIICQENGLVPIVEPEILVDGDHDIDRSADVTERVLAACYKALNDHHVLLEGTLLKPNMVTPGSDSAKVPPEVVAEYTVRALQRTVPPAVPGIVFLSGGQSEEEATVHLNAMNKIEGKKPWTLTFSYGRALQQSTLKA

SEQ ID NO: 4795 - protein, 165 aa, Arabidopsis lyrata
MSCFKSKFADELIANAAYIGTPGKGILAADESTGTIGKRFASINVENVESNRRALRELLFTTPGALQYISGIILFEETLYQKTASGKPFVDVMKEAGVLPGIKVDKGTVELAGTNGETQPLALMDLVTVARNTTKLVHVLQSGVLFSKLETMSLLSWLSMRMLTV

SEQ ID NO: 4796 - protein, 357 aa, Distylium racemosum
MSAYCGKYTEELIKTAKYIATPGKGILAADESTGTIGKRLASISVENVEANRQALRQLLFTSPGALQYISGVILFEETLYQKTVGGKPFVDVLQEGGVIPGIKVDKGTVELAGTNGETTTQGLDGLAQRCQQYYKAGARFAKWRAVLKIGPAEPSELSIQQNAHGLARYAIICQENGLVPIVEPEILTDGPHDIKKCAEVTEKVLAACYKALNDHHVLLEGTLLKPNMVTPGSDGPQVPPEVIAEYTVKALQRTVPVAVPGIVFLSGGQSEEQATLNLNAMNKLDTIKPWTLSFSFGRALQQSTLKTWAGKKENEEAAQKAFLVRCKANSESTLGKYGGGSGAGAASESLHVKDYKY

SEQ ID NO: 4797 - protein, 358 aa, Olea europaea
MSCYKGKYADELIANAAYIGSPGKGILAADESTGTIGKRLASINVENVETNRRALRELLFTAPGVLQYLSGVILFEETLYQKTAAGKPFVDVLKEGGVLPGIKVDKGTVELAGTNGETTTQGLDGLAQRCQQYYKAGARFAKWRAVLNIGANEPSQLAINENANGLARYAIICQENGLVPIVEPEILVDGSHDINKCADVTERVLAVVYKALNDHHVLLEGTLLKPNMVTPGSSSPKVAPEVIAEHTVRALQRTMPPAVPAVVFLSGGQSEEEATLNLNAMNKLKTKKPWTLSFSFGRALQQSTLKAWAGKDENIKKAQDALLTRCKANSEATLGTYQGGGALSEGASESLHVDNYKY

SEQ ID NO: 4798 - protein, 358 aa, Coffea canephora
MSCYKGKYTDELIATANYIGTPGKGILAADESTGTIGKRLSSINVENVESNRRALRELLFTTPGALECLSGVILFEETLYQKSAAGKPFVDVLKEGGVIPGIKVDKGTVELPGTNGETTTQGLDGLAQRCQQYYTAGARFAKWRAVLKIGPNEPSQLAINENANGLARYAIICQQNGLVPIVEPEILVDGSHDIEKCADVTERVLAAVYKALNDHHVLLEGTLLKPNMVTPGSEAPKVAPEVIAEYTVRALQRTMPAAVPAVVFLSGGQSEEEATRNLNAMNRLKTKKPWSLTFSFGRALQQSTLKAWAGKEENIPKAQAAFLSRCKANSDATLGKYEGGASLGEGASESLHVKDYKY

SEQ ID NO: 4799 - protein, 358 aa, Medicago truncatula
MSNFKSKYHDELIANAAYIGTPGKGILAADESTGTIGKRLSSISVENVESNRRALRELLFTAPGVLQYLSGVILFEETLYQSTAAGKPFVDVLNEAGVLPGIKVDKGTVELAGTDGETTTQGLDGLGARCAKYYEAGARFAKWRAVLKIGPNEPSEHSIHENAYGLARYAVICQENGLVPIVEPEILVDGPHDIQKCAAVTEKVLAACYKALNDHHVLLEGTLLKPNMVTPGSDAPKVAPEVVAEHTVRALQRTVPAAVPAVVFLSGGQSEEEASVNLNAINQVNGKKPWTLSFSFGRALQQSTLKAWSGKEENVKAAQEALLTRAKANSEATLGTYKGNSKLGAGASESLHVKDYKY

SEQ ID NO: 4800 - protein, 358 aa, Medicago truncatula
MSSFKSKYEDELIANAAYIGSPGKGILAADESTGTIGKRFASINVENVEANRRTLRELLFTAPGCLDCLSGVILFEETLYQKTAAGVPFVDVLKKAGVLPGIKVDKGTVELAGTNGETTTQGLDDLGQRCKKYYEAGARFAKWRAVLKIGPNEPSPLSIHENAYGLARYAVICQENGLVPIVEPEILVDGPHDIAKCADVTERVLAACYKALSDHHVLLEGTLLKPNMVTPGSDSPKVAPEVIAQHTVRALLRTVPAAVPAIVFLSGGQSEEEASVNLNAMNKLKGKKPWTLTFSYGRALQQSTLKAWGGKDENIPKAQAALLVRCKANSEATLGTYQGNANLGDGASESLHVKDYKY

SEQ ID NO: 4801 - protein, 358 aa, Glycine max
MSHFKGKYHDELIVNAAYIGTPGKGILAADESTGTIGKRLASISVENVESNRRALRELLFTAPGALKYLSGVILFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 4802 - protein, 367 aa, Malus domestica
MDYGIWINLCIGDFLLAINELIANATYIGTPGKGILAADESTGTIGKRFSSIGVENTETNRRALRELLFTTPGAVQYLSGVILFEETLYQKTAAGKPFVDVLKEGGVLPGIKVDKGTVELAGTNGETTTQGLDGLGERCKKYYEAGARFAKWRAVLKIGPNEPSQLSINENANGLARYAIICQENGLVPIVEPEILVDGSHDIQKCADVTERVLAACYKALNDHHVLLEGTLLKPNMVTPGSDAKKVPPEMIAEYTVRALQRTMPAAVPAVVFLSGGQSEEEATINLNAMNKLKANKPWSLSFSFGRALQQSTLKAWSGKEENVKKAQEAFLTRAKANSEATLGNYKGDAKLGEGAAESLHVKDYKY

SEQ ID NO: 4803 - protein, 358 aa, Gossypium hirsutum
MSCFISKYADELAKNAAYIGTPGKGILAADESTGTIGKRLSSINVENIEENRRALRELLFTAPGALQYLSGVILFEETLYQKTASGKPFVDVLNEGGVLPGIKVDKGTVELNGTNGETFTQGLDGLAQRCQKYYEAGARFAKWRAVLKISANEPTELAIQENANGLAMYAAICQQCGLVPIVEPEILVDGSHGIQKCAAVTERVLAACYKALNDHHVMLEGTLLKPNMVTPGSDSPKVAPDVIAEYTVRALQRTVPAAVPAIVFLSGGQSEEEATLNLNAMNKLQTKKPWSLSFSFGRALQQSTLKTWAGKEENVKKAQDALLVRCKANSEATLGTYKGDAELCEGAAESLHVKDYKY

SEQ ID NO: 4804 - protein, 89 aa, Gossypium hirsutum
MSCFISKYADELAKNAAYIGTPGKGILAADESTGTIGKRLSSINVVNIEETGVLPVSSSSLLQELFSTSVVLFSSRKPFIKNRFGQALR

SEQ ID NO: 4805 - protein, 358 aa, Glycine max
MSSFKSKFQDELIANASYIGTPGKGILAADESTGTIGKRLASINVENVETNRRILRELLFTAPGCLERLSGVILFEETLYQKSAAGVPFVDILKKGGVLPGIKVDKGTVELAGTNGETTTQGLDDLAQRCKKYYEAGARFAKWRAVLKIGPNEPSPLCIHENANGLARYAAICQENGLVPIVEPEILSDGPHDIAKCADVTERVLAACYKALNDHHVLLEGTLLKPNMVTPGSESARVKAEVIAEHTVRALQRTVPPAVPAIVFLSGGQSEEEATVNLNAMNQLKGKKPWSLTFSYGRALQQSTLKAWGGKDENIPKAQSALLVRCKANSEATLGTYKGDATLGEGASESLHVKDYKY

SEQ ID NO: 4806 - protein, 349 aa, Glycine max
DELIANATYIGTPGKGILAADESTGTIGKRLASINVENVETNRRILRELLFTAPGCLECLSGVILFEETLYQKSAAGVPFVDILKKGGVLPGIKVDKGTVELAGTNGETTTQGLDDLAQRCKKYYEAGARFAKWRAVLKIGPNEPSPLSIHENANGLARYAAICQENGLVPIVEPEILSDGPHDIAKCADVTERVLAACYKALNDHHVLLEGTLLKPNMVTPGSEAARVTAEVIAEHTVRALQRTVPPAVPAIVFLSGGQSEEEATVNLNAMNQLKGKKPWSLTFSYGRALQQSTLKAWGGKDENIPKAQSALLVRCKANSEATLGTYKGDATLGEGASESLHVKDYKY

SEQ ID NO: 4807 - protein, 357 aa, Vinca minor
MSCYRGEYADELIANAAYIGTPGKGILAADESTGTIGKRLSSINVENVETNRRALRELLFTTPGCLQYLSGVILFEETLYQKTAAGKPFVEVLKEGGVLPGIKVDKGTVELPGTKGETTTQGLDGLAQRCQQYYKAGARFAKWRAVLNIGPNEPSQLAITDNANGLARYAIICQQNGLVPIVEPEILVDGSHDINKCADVTERVLAACYKALNDHHVLLEGTLLKPNMVTPGSDSPKVSPEVIAEHTVRALQRTMPCAVPAVVFLSGGQSEEEASVNLNAMNKLQTKKPWSLSFSFGRALQQSTLKAWAGKEENVKKAQEVFLARCKANSEATLGKYAGGASGGAASESLHVKDYKY

SEQ ID NO: 4808 - protein, 357 aa, Vigna unguiculata
MSAFVGKYADELIKNAKYIATPGKGILAADESTGTIGKRLASINVENIEANRQALRELLFTSPNALQYLSGVILFEETLYQKTTDGKPFVEVLEENNVIPGIKVDKGVVELAGTNGETTTQGFDSLGARCQQYYKAGARFAKWRAVLKIGPTEPSELSIQQNAQGLARYAIICQENGLVPIVEPEILTDGPHDIAKCAAVTETVLAAVYKALNDQHVLLEGTLLKPNMVTPGSDSPKVTPEVIAEHTVQALRRTVPAAVPGIVFLSGGQSEEEATLNLNAMNKLEVLKPWTLSFSFGRALQQSTLKTWGGKEENITKAQEAFLARCKANSEATLGKYGGGSKAGLASESLYEKNYKY

SEQ ID NO: 4809 - protein, 358 aa, Gossypium hirsutum
MSCFISKYADELAKNAAYIGTPGKGILAADESTGTIGKRLSSINVVNIEENRRALRELLFTAPGALQYLSGVILFEETLYQKTASGKPFVDVLKEGGVLPGIKVDKGTVELNGTNRETFTQGLDGLAQRCQKYYEAGARFAKWRAVLKISANEPTELAIQENANGLAMYAAICQQCGLVPIVEPEILVDGSHDIQKCAAVTERVLATCYKALNDHHVMLEGTLLKPNMVTPGSDSPKVAPDVIAEYTVRALQRTVPAAVPAIVFLSGGQSEEEATLNLNAMNKLQTKKPWSLSFSFGRALQQSTLKTWAGKEENVKKAQDALLVRCKANSEATLGTYKGDAELCEGAAESLHVKDYKY

SEQ ID NO: 4810 - protein, 359 aa, Arabidopsis thaliana
MSCFKSKFADELIANAAYIGTPGKGILAADESTGTIGKRFVSINVENVESNRRALRELLFTTPGALQYISGIILFEETLYQKTASGKLFVDVMKEAGVLPGIKVDKGTVELAGTNGETTTTGLDGLGDRCKKYYEAGARFAKWRAVLKIGNNEPSELAIHENAYGLARYAVICQENGLVPIVEPEILVDGSHDIEKCAYVTERVLAACYKALSDHHVILEGTLLKPNMVTPGSDSGSKVKPEVIAKHTVRALQRTVPAAVPAVVFLSGGQSEEEATVNLNAINQLKGKKPWSLTFSYGRALQQSTLKAWGGKEENVDKAQKAFLARAKANSEATLGGYKGDAQLGEGASESLHVKDYKY

SEQ ID NO: 4811 - protein, 359 aa, Brassica oleracea
  misc_feature (5)..(6): Xaa can be any naturally occurring amino acid
  misc_feature (81)..(81): Xaa can be any naturally occurring amino acid
DHGFXXSKYADELIANAAYIGTPGKGILAADESTGTIGKRLSSINVENVESNRRALRELLFTTPGALPCLSGVILFEETLXQKSSKGTPFVDILKEGGVLPGIKVDKGTVSLPGTNGETTTQGLDGLGERCKKYYEAGARFAKWRAVLKIGPNEPSELAIRENAYGLARYAAICQENGLVPIVEPEILVDGSHDIQKCAEATERVLAACYKALSDHHVMLEGTLLKPNMVTPGSESGKVAPEVVAEYTVRALQRTVPAAVPAVVFLSGGQSEEEATRNLNAMNQLKTKKPWSLSFSFGRALQQSTLKTWGGKEENVKKAQEAFLVRCKANSEATLGVYKGDAQLGEGAAESLHVKDYKY

SEQ ID NO: 4812 - protein, 359 aa, Brassica napus
MSCFKSKYADELIANAAYIGSPGKGILAADESTGTIGKRFASINVENVELNRRALRELLFTTPGALQYISGIILFEETLYQKTASGKPFVDVMKEAKVLPGIKVDKGTVELAGTNGETTTIGLDGLGDRCKKYYEAGARFAKWRAVLKIGANEPSELAIHENAYGLARYAVICQENGLVPIVEPEILVDGSHDIEKCAYVTERVLAACYKALNDHHAILEGTLLKPNMVTPGSDSKSRAEPKVIAEHTVRALQRTVPAAVPAVVFLSGGQSEEQATVNLNAINQLKGKKPWSLTFSYGRALQQSTLKAWGGKEENVEKAQKAFLARAKANSEATTGAYKGDAQLGEGASESLHVKDYKY

SEQ ID NO: 4813 - protein, 359 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLKIGPNEPSLSILSIENAYGLARYAVICQENGLVPIVEPEILVDGSHDIHKCAAITERVLAATYKALSDHHVLLEGTLLKPNMVTPGSDSPKVAPEVVAEHTVRALQRTVPAAVPAVVFLSGGQSEEEATVNLNAINQVKGKKPWTLSFSFGRALQQSTLKAWSGKEENVKNAQDALLTRAKANSEATLGTYKGNSQLGEGASESLHVKDYKY

SEQ ID NO: 4814 - protein, 359 aa, Raphanus sativus
MSCFKSKYADELIANAAYIGTPGKGILAADESTGTIGKRFASINVENVESNRRALRELLFTTPGALQYISGIILFEETLYQKTASGKPFVDVMKGAGVLPGIKVDKGTVELAGTNGETTTIGLDGLGDRCKKYYEAGARFAKWRAVLKIGANEPSELAIHENAYGLARYAVICQENGLVPIVEPEILVDGSHDIEKCAYVTELVLAACYKALNDHHVILEGTLLKPNMVTPGSDSKSRAEPKVIAEHTVRALQRTVPAAVPAVVFLSGGQSEEQATVNLNAINQFKGKKPWSLTFSYGRALQQSTLKAWGGKEENVEKAQKAFLARAKANSEATTGSYKGDAQLGEGASESLHVKDYKY

SEQ ID NO: 4815 - protein, 388 aa, Cucumis melo
KRRAPKTLSLHCSLSPSNFFNLLLFSILVSIPKCLPSRANELIANAAYIGTPGKGILAADESTGTIGKRLASINVENVESNRRALRELLFLTPGALQYLSGVILFEETLYQKTAAGKPFVDVLKEGGVLPGIKVDKGTVELAGTNGETTTQGLDGLAQRCQKYYEAGARFAKWRAVLKIGPTEPSQLSINENAYGLARYAAICQENGLVPIVEPEILVDGSHSIDKCAEVTERVLAACYKALNDHHVLLEGTLLKPNMVTPGSEAAKVAPEVIAEYTVRALQRTVPAAVPAIVFLSGGQSEEEATLNLNAMNKLKGKKPWSLSFSFGRALQQSTLKAWAGKEENVEKARAAFLTRCKANSEATLGTYKGDANLSEGAAESLHVKDYKY

SEQ ID NO: 4816 - protein, 357 aa, Senecio madagascariensis
MTAYRGKYADELIANATHIGSPGKGILAADESTGTIGKRLQSINVENNESNRRALRELLFCTPGAMQYLSGVILYEETLYQKTAAGKPFVDVMKENNVLPGIKVDMGCVSLAGTDGETTTQGLDGLGARCAKYYEAGARFAKWRAVLKIGANEPSPLSIHENAYGLARYAMLCQENGLVPIVEPEILVDGSHDINKCAEVTERVLAACYKALNDHHVLLEGTLLKPNMVTPGSDSKKVAPEVIAEYTVRALQRTMPAAVPAVVFLSGGQSEEEATVNLNAMNQYKGKKPWSLTFSFGRALQQSTLKAWAGKEENVKKAQDAFLARCKANSEATLGKYQGGAAGEGATESLHVKDYKY

SEQ ID NO: 4817 - protein, 358 aa, Glycine max
MSHFKGKYHDELIANAAYIGTPGKGILAADESTGTIGKRLASISVENIESNRRALRELLFTAPGVLQYLSGVILFEETLYQSTAAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 4818 - protein, 360 aa, Lippia dulcis
MYSLLYVSFFFLDELIANAAYIGTPGKGILAADESTGTIGKRLSSINVENVEENRRALRELLFTAPGALQYLSGIILFEETLYQKTAAGKLFVDVMKEAGVLPGIKVDKGTVELAGTNGETTTQGLDGLAQRCQQYYTAGARFAKWRAVLKIGPNEPSQLAINENANGLARYAIICQENGLVPIVEPEILVDGPHDINKCADVTERVLAACYKALNDHHVLLEGTLLKPNMVTPGSDSAKVAPEVIAEYTVRALQRTMPPAVPAVVFLSGGQSEEEATVNLNAMNKLKTKKPWSLSFSFGRALQQSTLKAWAGKEENIPKAQAALLARCKANSEATLGTYEGGALNEGASESLHVKDYKY

SEQ ID NO: 4819 - protein, 358 aa, Trigonella foenum-graecum
MSNFKSKYHDELIANAAYIGTPGKGILAADESTGTIGKRLASISVENVESNRRALRELLFTAPGVLQYLSGVILFEETLYQSTAAGKPFVDVLNEAGVLPGIKVDKGTVELAGTDGETTTQGLDGLGARCAKYYEAGARFAKWRAVLKIGPNEPSEHSIHENAYGLARYAVICQENGLVPIVEPEILVDGSHDIQKCAAITERVLAACYKALSDHHVILEGTLLKPNMVTPGSDSPKVAPEVVAEHTVRALQRTVPAAVPAVVFLSGGQSEEEASVNLNAINQVKGKKPWTLSFSFGRALQQSTLKAWSGKEENVKAAQEALLTRAKANSEATLGTYKGNSQLGAGASESLHVKDYKY

SEQ ID NO: 4820 - protein, 357 aa, Pisum sativum
MSAFVGKYADELIKNAKYIATPGKGILAADESTGTIGKRLASINVENIEANRQALRELLFTSPNALQYLSGVILFEETLYQKSSEGKPFVEILQENNVIPGIKVDKGVVELAGTDGETTTQGFDSLGARCQQYYKAGARFAKWRAVLKIGPNEPSELSIQQNAQGLARYAIICQENGLVPIVEPEILTDGSHDIAKCAAVTETVLAACYKALNDQHVLLEGTLLKPNMVTPGSDSPKVSPEVIGEYTVNALRRTVPAAVPGIVFLSGGQSEEQATLNLNAMNKFDVVKPWTLSFSFGRALQQSTLKTWSGKKENVGKAQDVFLARCKANSEATLGKYGGGSGTGLASESLHVKDYKY

SEQ ID NO: 4821 - protein, 278 aa, Centaurea maculosa
  misc_feature (5)..(5): Xaa can be any naturally occurring amino acid
  misc_feature (262)..(262): Xaa can be any naturally occurring amino acid
MSCYXGKYADELIANAAYIGTPGKGILAADESTGTIGKRLDSIKVENVEENRRALRELLFCTPGALQYLSGVILFEETLYQKTAAGKPFVDVMKEAGVLPGIKVDKGTVELAGTNGETTTQGLDDLGKRCAQYYKAGARFAKWRAVLKIGANEPSQLAINENANGLARYAIICQENGLVPIVEPEILVDGSHDINKCADVTERVLAACYKALNDHHVLLEGTLLKPNMVTPGSDAPKVAPEVVAEYTVRALQRTMPPAVQRXVCRSQSEEQPPSTSTP

SEQ ID NO: 4822 - protein, 358 aa, Cedrus atlantica
MSCFEGKYRDELIANAAYIATPGKGILAADESTGTIGKRLASINVENIETNRRLLREFLFTAPNALQYLSGAILFEETLYQKTAAGKPFVDVLKEGGVLPGIKVDKGTVDLAGTKGETTTQGLDGLAQRCQQYYNAGARFAKWRSVLKIGITEPSPLAIQENANGLARYAIICQENGLVPIVEPEILVDGPHDIKTCAAVTEKVLAACYKALNDHHVLLEGTLLKPNMVTPGSDSPKVTPEVIAEHTVRALQRTVPPAVPGIMFLSGGQSEEEATLNLNAMNKLQTKKPWTLSFSFGRALQASTLKTWAGKNENIPAAQAALLSRCKANSEATLGKYAGDSAKGNGVSESLHVKDYKY

SEQ ID NO: 4823 - protein, 358 aa, Phaseolus coccineus
MSHFKGKYHDELIANAAYIGTPGKGILAADESTGTIGKRLSSINVENVESNRRALRELLFTAPGALQYLSGVILFEETLYQSTASGKPFVELLKENGVLTGIKVDKGTVELAGTDQETTTQGLDGLGQRCAKYYEAGARFAKWRAVLKIGPNEPSELSIHENAYGLARYAVICQENGLVPIVEPEILVDGSHDIHKCAAVTERVLAACYKALNDHHVLLEGTLLKPNMVTPGSKSAKVSPQVVAEHTVRALQRTVPAAVPAVVFLSGGQSEEEASLNLNAINQVNGKKPWSLSFSFGRALQQSTLKAWGGKEENVKKAQEALLVRAKANSEATLGTYKGSSQLDDGAEESLYVENYKY

SEQ ID NO: 4824 - protein, 357 aa, Manihot esculenta
MSAFVGKYADELIRTAKYIATPGKGILAADESTGTIGKRLASISVENVESNRQALRELLFTSPNALPYLSGVILFEETLYQKTSDGKPFVEVLQENNVVPGIKVDKGTVELAGTNGETTTQGFDSLGARCQQYYKAGARFAKWRAVLKIGPTEPSELAIQQNAQGLARYAIICQENGLVPIVEPEVLTDGPHDIKKCAYVTEIVLAAVYKALNDQHVLLEGTLLKPNMVTPGSDSPKVAAEVIAEYTVTALRRTVPPAVPGIVFLSGGQSEEEATLNLNAMNKLPVLKPWTLSFSFGRALQQSTLKIWAGKKENIEKAQKAFLERCTANSEATLGKYTGGSSGGLASESLYVKGYKY

SEQ ID NO: 4825 - protein, 358 aa, Gossypium hirsutum
MSCFISKYADELAKNAAYIGTPGKGILAADESTGTIGKRLASINVENVEENRRALRELLFTAPGALQFISGVIFFEETLYQKTASGKLFVDVLKESGVLPGIKVDTGTVVLNGTNDETFTQGLDGLAQRCQKYYEAGARFAKWRAVLKIGTIEPTELAIQENANGLAMYSAICQQCGLVPIVEPEILVDGPHDINKCAAVTERVLAACYKALNDHHVMLEGTLLKPNMVTPGSDSPKVAPEVIAEHTVRALQRTIPPAVPAVVFLSGGQSEEEATINLNAMNKLKTKKPWSLSFSFGRALQQSTLKAWGGKAENLGKAQEAFLVRCKANSEATLGTYKGDAKLGEGAAESLHVKDYKY

SEQ ID NO: 4826 - protein, 357 aa, Marchantia polymorpha
MSAYEGKYAEELKKTAAYIATPGKGILAADESTGTIGKRLSSIKVENVEANRQALRQLLFTAPDTHQYLSGVILFEETLYQKTDDGVPFTKLLLDGGVIPGIKVDKGVVELAGTDGETTTQGLDGLGDRCKKYYEAGARFAKWRAVLKIGANEPSELSIQQNAQGLARYAMICQENGLVPIVEPEILVDGTHSIERCAYVTEMVLAACYKALNEQHVLLEGTLLKPNMVTPGSEAKKVTPEVIAKYTVQALQRTVPPAVPGIVFLSGGQSEEEATLNLNAMNQLDAKKPWTLSFSFGRALQQSVLKTWSGKAENIDAAQKAFHKRCKANSEAVLGTYKGDAAGGLGDESLHVKDYKY

SEQ ID NO: 4827 - protein, 357 aa, Quercus alba
MSAFVGKYAEELIKNARYIATPGKGILAADESTGTIGKRLASINVENIESNRQALRELLFTSPNALPYLSGVILFEETLYQKTSDGKPFVEVLKENNVIPGIKVDKGTVELAGTNGETTTQGFDSLGARCQQYYKAGARFAKWRAVLKIGPNEPSELSIQQNAQGLARYAIICQENGLVPIVEPEILTDGAHDIKKCAAATEIVLAAVYKALNDQHVLLEGTLLKPNMVTPGSDSPKVTPEVIAEYTVTALRRTVPAAVPGIVFLSGGQSEEEATLNLNAMNRLEVLKPWTLSFSFGRALQQSTLKTWAGKKENVGKAQQVFLVRCKANSESTLGKYSGGGAGGLASESLFVKGYKY

SEQ ID NO: 4828 - protein, 357 aa, Helianthus annuus
MSCYKGKYADELIANAAYIGTPGKGILAADESTATIGKRLSSINVENNESNRRALRELLFCTPGALQYISGIILFEETLYQKTAAGKPFVELMKEAKVLPGIKVDKGVVELAGTNGETTTTGLDGLGQRCAQYYEAGARFAKWRAVLKIGPNEPSPLSIMENAYGLARYAIICQENGLVPIVEPEILVDGPHDINKCADVTERVLAACYKALNDHKVLLEGTLLKPNMVTPGSDAKKVAPEVVGEYTVRALQRTMPAAVPAVVFLSGGQSEEEASVNLNAINQYKGKKPWSLTFSYGRALQQSTLKAWAGKEENVKKAQEVFLGRCKANSEASEGKYKGGAAGEGANESLHVKDYKY

SEQ ID NO: 4829 - protein, 199 aa, Ipomoea batatas
MSCYRGKYADELIANATYIGTPGKGILAADESTGTIGKRLASINVENVEENRRALRELLFTTPGALQYLSGVILFEETLYQKTACGKPFVELLKEGGVLPGIKVDKGTVELPGTKGETTTQGLDGLAERCKKYYEAGARFAKWRAVLKIGPNEPSQLAINENANGLARYAIICQQNGLVPIVEPEILVDGPHDITNVQM

SEQ ID NO: 4830 - protein, 357 aa, Lotus japonicus
MSAFVGKYADELIKNAKYIATPGKGILAADESTGTIGKRLASINVENIEANRQALRELLFTSPGALQYLSGVILFEETLYQNSSEGKPFVEFLQENNVIPGIKVDKGVVELAGTNGETTTQGFDSLGARCQQYYKAGARFAKWRAVLKIGPTEPSELSIQQNAQGLARYAIICQENGLVPIVEPEILTDGDHDIAKCAAVTETVLAAVYKALNEQHVLLEGTLLKPNMVTPGSDSPKVTPEVIAEHTVTALRRTVPAAVPGIVFLSGGQSEEQATLNLNAMNKLEVLKPWALSFSFGRALQQSTLKTWAGKKESVTKAQEVFLARCKANSEATLGKYGGGSGSGLASENLYVKDYKY

SEQ ID NO: 4831 - protein, 357 aa, Cajanus cajan
MSAFVGKYADELIKNAKYIATPGKGILAADESTGTIGKRLASINVENIEANRQALRQLLFTSPNALQYLSGVILFEETLYQKTSDGKPFVEVLEENNVIPGIKVDKGVVELAGTNGETTTQGFDSLGARCQQYYKAGARFAKWRAVLKIGPNEPSELSIQQNAQGLARYAIICQENGLVPIVEPEILTDGAHDIVKCAAVTETVLAAVYKALNEHHVLLEGTLLKPNMVTPGSDSPKVAPEVIAEYTVQALRRTVPAAVPGIVFLSGGQSEEEATLNLNAMNKLGVLKPWTLSFSFGRALQQSTLKTWGGKKENIGKAQESFLARCKANSEATLGKYVGGSGTGLASESLYVKDYKY

SEQ ID NO: 4832 - protein, 78 aa, Gossypium hirsutum
MNKLQTKKPWSLSFSFGRALQQSTLKTWAGKEENVKKAQDALLVRCKANSEATLGTYKGDAELCEGAAESLHVKDYKY

SEQ ID NO: 4833 - protein, 358 aa, Pisum sativum
MSHFKSKYHDELIANAAYIGTPGKGILAADESTGTIGKRLASINVENVESNRQALRELLFTAPGVLQYLSGVILFEETLYQKTAAGKPFVDVLNEAGVLPGIKVDKGTVELAGTDGETTTQGLDGLGARCAKYYEAGARFAKWRAVLKIGANEPSEHSIHENAYGLARYAVICQENGLVPIVEPEILVDGSHDILKCAAITERVLAATYKALSDHHVILEGTLLKPNMVTPGSDAPKVAPEVIAEHTVRALQRTVPAAVPAVVFLSGGQSEEEASVNLNAINQIKGKKPWTLSFSFGRALQQSTLKAWGGKTENVKAAQDALLTRAKANSEATLGTYKGASNLGAGASESLHVKDYKY

SEQ ID NO: 4834 - protein, 357 aa, Sciadopitys verticillata
MSAYCGKYIEELMQTAKYIATPGKGILAADESTGTIGKRLASINVENVEANRQVLRELLFTSPGCLPYLSGVILFEETLYQKTASGKPFVEVLQEGGVVPGIKVDKGTVELAGTNGETTTQGLDGLAARCQQYYKAGARFAKWRAVLKIGPNEPSELAIQQNAHGLARYAIICQENGLVPIVEPEILTDGPHDIKQCAEVTEKVLAACYKALNDHHVLLEGTLLKPNMVTTGSDGPKVPPEVIAEYTVRALQRTVPVAVPGIVFLSGGQSEEEATLNLNAINKLNTIKPWTLSFSFGRALQQSTLKTWGGKKDNLGAAQKAFLVRCKANSEATLGKYGGGAGVGLATESLHVKDYKY

SEQ ID NO: 4835 - protein, 357 aa, Ricinus communis
MSAFVGKYAEELIKTAKYIATPGKGILAADESTGTIGKRLASINVENVESNRQALRELLFTSPNALSHLSGVILFEETLYQKTSDGKPFVEVLQENNVVPGIKVDKGTVELAGTNGETTTQGFDSLGARCQQYYKAGARFAKWRAVLKIGPTEPSELAIQQNAQGLARYAIICQENGLVPIVEPEILTDGPHDIKKCAAMTEIVLAAVYKALNDQHVLLEGTLLKPNMVTPGSDSPKVTPEMIAEYTVTALRRTVPPAVPGIVFLSGGQSEEEATLNLNAMNKLPVLKPWTLSFSFGRALQQSTLKIWAGKKENIEKAQEVFLVRCKSNSEATLGKYTGGGASGLASESLYVKGYKY

SEQ ID NO: 4836 - protein, 358 aa, Picea glauca
MSCFEGKYRDELIANAAYIATPGKGILAADESTGTIGKRLASINVENIETNRRQLREFLFTAPNAVQYLCGAILFEETLYQKSAAGKPFVDILNEGGVLPGIKVDKGTVDLAGTKGETTTQGLDGLAQRCQQYYNAGARFAKWRAVLKIGTTEPSPLAIQENANGLARYAIICQENGLVPIVEPEILVDGPHDIKTCAAITERVLAACYKALNDHHVLLEGTLLKPNMVTPGSDAPKVTPEVIAEYTIRALQRTVPPAVPGIMFLSGGQSEEEATLNLNAMNKLQTKKPWTLSFSFGRALQASTLKTWAGKTENIPAAQAAFLSRCKANSEATLGKYAGDSSKGNGVSESLHVKDYKY

SEQ ID NO: 4837 - protein, 357 aa, Tragopogon dubius
MSAFVGKYADELIKNAKYIATPGKGILAADESTGTIGKRLSSINVENVESNRQALRELLFTAPNAVTYLSGVILFEETLYQKTAAGKPFVDVLLEANVLPGIKVDKGVVDLSGTNGETTTQGLDGLGARCAKYYEAGARFAKWRAVLKIGATEPSELSIQQNAQGLARYAIICQENGLVPIVEPEILTDGSHDIKKCAYATEMVLAAVYKALNEQHVLLEGTLLKPNMVTPGSDSPKVTPEVIAEYTVTALRRTVPAAVPGIVFLSGGQSEEEATVNLNAMNKLEVLKPWTLTFSFGRALQSSTLKTWAGKEENVAAAQAVFLARCKANSEATLGKYAGDDAGGLASESLYVKGYKY

SEQ ID NO: 4838 - protein, 357 aa, Medicago truncatula
MSAFVGKYADELIKNAKYIATPGKGILAADESTGTIGKRLASINVENIEANRQALRELLFTSPNALQYLSGVILFEETLYQNSSEGKPFVEILQENNVIPGIKVDKGVIELAGTNGETTTQGFDSLGARCQQYYKAGARFAKWRAVLKIGPNEPSELSIQQNAQGLARYAIICQENGLVPIVEPEILTDGSHDIAKCAAVTETVLAAVYKALNDQHVLLEGTLLKPNMVTPGSDSPKVTPEVIGEYTVTALRRTVPAAVPGVVFLSGGQSEEQATLNLDAMNKLDVVKPWTLSFSFGRALQQSTLKTWAGKKENVGKAQEVFLARCKANSEATLGKYGGGSGTGLASESLYVKDYKY

SEQ ID NO: 4839 - protein, 357 aa, Glycine max
MSAFVGKYADELIKNAKYIATPGKGILAADESTGTIGKRLASINVENIEANRQALRELLFTAPNALQYLSGVILFEETLYQKTSDGKPFVEVLQENNVIPGIKVDKGVVELAGTNGETTTQGFDSLGARCQQYYKAGARFAKWRAVLKIGPTEPSQLSIQQNAQGLARYAIICQENGLVPIVEPEILTDGAHDIAKCAAVTETVLAAVYKALNEQHVLLEGTLLKPNMVTPGSDSPKVPPEVIAEYTVQALRRTVPAAVPGVVFLSGGQSEEEATLNLNAMNKSELLKPWTLSFSFGRALQQSTLKTWGGKKENVAKAQEAFLARCKANSDATLGKYVGGSGSGLTSESLYVKNYNY

SEQ ID NO: 4840 - protein, 357 aa, Glycine max
MSAFVGKYADELIKNAKYIATPGKGILAADESTGTIGKRLSSINVENIEANRQALRELLFTAPDALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAAVYKALNEQHVLLEGTLLKPNMVTPGSDSPKVPPEVIAEYTVQALRRTVPAAVPGVVFLSGGQSEEEATLNLNAMNKLEVLKPWTLSFSFGRALQQSTLKTWGGKKENVAKAQEAFLARCKANSDATLGKYVGGSGSGLTSESLYVKNYKY

SEQ ID NO: 4841 - protein, 354 aa, Salvia sclarea
MTAYRGKYADELIANAAYIGTPGKGILAADESTGTIGKRLSSINVENIEANRRALRELLFCAPGALQYLSGVILFEETLYQKTAAGKPFVDVLNEGGVLPGIKVDKGTVELAGTNGETTTQGLDGLAQRCQQYYAAGARFAKWRAVLKIGANEPSQLAINDNANGLARYAIICQENGLVPIVEPEILVDGSHDINKCAEVTERVLAACYKALNDHHVLLEGTLLKPNMVTPGSDAPKVTPEVVAEYTVRALQRTMPPAVPAVVFLSGGQSEEEATRNLNAMNKLKAKKPWTLSFSFGRALQQSTLKAWAGKEEMSEGSCCIAYSASHSEATLGPTGDSALGEGADGEPPRRLQY

SEQ ID NO: 4842 - protein, 358 aa, Pinus pinaster
MSCFEGKYRDELIANAAYIATPGKGILAADESTGTIGKRLASINVENIESNRRLLREFLFTAPNALQYLSGAILFEETLYQKTAAGKPFVDVLNEGGVLPGIKVDKGTVDLAGTKGETTTQGLDGLAQRCQQYYNAGARFAKWRSVLKIGTTEPSPLAIQENANGLARYAIICQENGLVPIVEPEILVDGSHDIETCAAVTERVLAACYKALNDHHVLLEGTLLKPNMVTPGSDSPKVTPEVIAEYTVRALQRTVPPAVPGIMFLSGGQSEEEATLNLNAMNKLQTKKPWTLSFSFGRALQASTLKTWAGKDENIPAAQAALLSRCKANSDATLGKYAGDSAKGNGVSESLHVKDYKY

SEQ ID NO: 4843 - protein, 357 aa, Platanus occidentalis
MSAFIGKYADELIKNAKYIATPGKGILAADESTGTIGKRLASINVENIESNRQALRELLFTCPNALPFLSGVILFEETLYQNTSDGKPFVEVLQENNVIPGIKVDKGTVDLAGTNGETTTQGFDSLGARCQQYYKAGARFAKWRAVLKIGPTEPSELAIQQNAQGLARYAIICQENGLVPIVEPEVLTDGSHDIKKCAAVTETVLAAVYKALNDQHVLLEGTLLKPNMVTPGSDSPKVTPEVIAEYTVAALRRTVPPAVPGIVFLSGGQSEAEATLNLNAMNKLDVVKPWTLSFSFGRALQQSTLKTWAGKKENVAIAQGAFLARCKANSEATLGKYTGGSDGGLASESLHVKGYKY

SEQ ID NO: 4844 - protein, 358 aa, Pseudotsuga menziesii
MSCFEGKYHDELIANASYIATPGKGILAADESTGTIGKRLSSINVENIESNRRQLREFLFTAPNALQYLCGAILFEETLYQKTAAGKPFVDVLNEGGVLPGIKVDKGTVDLAGTNGETTTQGLDGLAQRCQQYYKAGARFAKWRAVLKIGPTEPSPLAIQENANGLARYAIICQENGLVPIVEPEILVDGPHDIKTCAAITEKVLAACYKALNDHHVLLEGTLLKPNMVTPGSDAPKVTPEVIAEHTVKALQRTVPPAVPGIMFLSGGQSEEEATLNLNAMNKLQTKKPWTLSFSFGRALQASTLKTWGGKDGNIPVAQAAFLSRCKANSEATLGKYAGDSSKGNGVSESLHVKDYKY

SEQ ID NO: 4845 - protein, 357 aa, Phaseolus coccineus
MSAFVGKYADELIKNAKYIATPGKGILAADESTGTIGKRLASINVENIEANRQALRELLFTAPNALQYLSGVILFEETLYQKTSDGKPFVEVLNENNVIPGIKVDKGVVELAATNGETTTQGFDSLGARCQQYYKAGARFAKWRAVLKIGPNEPSELSIQQNAQGLARYAIICQENGLVPIVEPEILTDGAHDIAKCAAVTEIVLAAVYKALNDHHVLLEGTLLKPNMVTPGSDSPKVAPEVIAEYTVQALRRTVPAAVPGIVFLSGGQSEEEATLNLNAMNKLEVLKPWTLSFSFGRALQQSTLKTWGGKEENVAKAQEAFLARCKANSEATLGKHVGESQTGLASESLYEKNYKY

SEQ ID NO: 4846 - protein, 357 aa, Quercus alba
MSAFVGKYAEELIKNARYIATPGKGILAADESTGTIGKRLASINVENIESNRQALRELLFTSPNALPYLSGVILFEETLYQKASDGKPFVEVLQENNVIPGIKVDKGTVELAGTNGETTTQGLDSLGARCQQYYKAGARFAKWRAVLKIGPTEPSELSIQQNAQGLARYAIICQENGLVPIVEPEILTDGAHDIKKCAAATEIVLAAVYKALNDQHVLLEGTLLKPNMVTPGSNSPKVTPEVIAEYTVTALRRTVPAAVPGIVFLSGGQSEEEATLNLNAMNRLEVLKPWTLSFSFGRALQQSTLKTWAGKKENVGKAQQVFLVRCKANSEATLGKYSGGGAGGLASESLFVKGYKY

SEQ ID NO: 4847 - protein, 358 aa, Distylium racemosum
MSCFKGKYHDELIANAAYIATPGKGILAADESTGTIGKRLASINVENVESNRRALRELLFTTPGALPLISGVILFEETLFQKSSNGTPFVDILKAAGVLPGIKVDKGTVDLPGTNSETTTQGLDGLGQRCQQYYAAGARFAKWRAVLKIGPNEPSELAIHENAHGLARYAVICQENGLVPIVEPEILVDGPHSIDVCADVTERVIAACYKALNDHHVLLEGTLLKPNMVTPGSDAPKVSPDVIAEYTVRALRRTVPPAVPGIMFLSGGQSEEEATLNLNAMNKLKVLKPWTLSFSFGRALQASTLKTWAGKADNVAKAQAAFLSRCKANSAATLGAYKGDAAAVAGASESLHVKDYKY

SEQ ID NO: 4848 - protein, 363 aa, Eucalyptus grandis
ATSVFFDLIPCRFADELIANAAYIGTPGKGILAADESTGTIGKRFAAINVENVETNRRTYRELLFCTPGALQCLSGAILFEETLFQKTADGKPFVEVLQEGGVLPGIKVDKGTVELAGTNGETTTQGLDGLAQRCQQYYAAGARFAKWRAVLKIGAAEPSQLAINENANGLARYAIICQENGLVPIVEPEILVDGDHDIDRSADVTERVLAACYKALNDHHVLLEGTLLKPNMVTPGSDSAKVPPEVVAEYTVRALQRTVPPAVPGIVFLSGGQSEEEATVHLNAMNKIEGKKPWTLTFSYGRALQQSTLKAWAGKEENVEKAREAFLARCKANSEATLGAYSGDAGSVEGASESLHVKDYKY

SEQ ID NO: 4849 - protein, 358 aa, Gnetum gnemon
MACSKGKYHDELIKNASYIATPGKGILAADESTGTIGKRLSSISVENNETNRRALRELLFTTPNALQYLSGVILFEETLYQKSKDGKPFVDILKEGGVLPGIKVDKGTVELSGTNGETSTQGLDGLAKRCQDYYAAGARFAKWRAVLKIGAKEPSELSIQENAQGLARYASICQENGLVPIVEPEILVDGSHDIETCAYVTERVLAACYKALNDHHVFLEGTLLKPNMVTPGADAPKVSADVIAQYTVRTLQRTVPAAVPGIMFLSGGQSEEEATSNLNAMNKLQTKKPWTLSFSFGRALQASTLKKWAGKDDNVAAAQAAFLSRCKANSQATIGTYVGASSIASAASESLYVKDYKY

SEQ ID NO: 4850 - protein, 357 aa, Eucalyptus grandis
MSAFVGKYADELIKTAKYIATPGKGILAADESTGTIGKRLAGINVENIESNRQALRELLFTCPNALPYLSGVILFEETLYQKTSEGKPFVEVLQENNVIPGIKVDKGTVELAGTNGETTTQGFDSLGARCQQYYKAGARFAKWRAVLKIGPTEPSELSIQQNAQGLARYAIICQENGLVPIVEPEILTDGSHDIKKCAAATETVLAAVYKALNDQHVLLEGTLLKPNMVTPGSDSPKVPPEVIAEYTVTALRRTVPPAVPGIVFLSGGQSEEEATLNLNAMNKLDVLKPWTLSFSFGRALQSSTLKTWGGKKENIGKAQEGFLARCLANSEATLGKYTGGTAGGLASESLFVKGYKY

SEQ ID NO: 4851 - protein, 357 aa, Vitis vinifera
MSAFVGKYADELIKNAKYIATPGKGILAADESTGTIGKRLSSIKVDNNEPNRQALRELLFTSPNALSYLSGVILFEETLYQNTRDGKPFVEVLQENNVIPGIKVDKGTVELAGTNGETTTQGFDSLGARCQQYYKAGARFAKWRSVLKIGPTEPSELSIQQNAQGLARYAIICQENGLVPIVEPEILTDGDHDIKKCAAVTETVLAAVYKALNDHHVLLEGTLLKPNMVTPGSAGPKVSSEVIAEYTVAALRRTVPPAVPGIVFLSGGQSEEEATLNLNAMNKLEVLKPWTLSFSFGRALQQSTLKTWSGKTENVGKAQGAFLGRCKANSEATLGKYEGGTGGGLASESLYVKGYKY

SEQ ID NO: 4852 - protein, 357 aa, Helianthus annuus
MSAFVGKYADELIKNAKYIATPGKGILAADESTGTIGKRLSSINVENIESNRQALRELLFTAPNALPYLSGVILFEETLYQKTADGKPFVDVLLEANVLPGIKVDKGVVDLAGTNGETTTQGFDGLGARCAAFYKAGARFAKWRAVLKIGATEPSELSIQQNAQGLARYAIICQENGLVPIVEPEILTDGSHDIKKCAYASEMVLAAVYKALNEQHVLLEGTLLKPNMVTPGSDSPKVTPEEIAEYTVTTLRRTVPAAVPGVVFLSGGQSEEEATVNLNAMNKLDVLKPWTLSFSFGRALQASTLKIWGGKKENVAAAQANFLARCKANSEATLGKYGGDGAGGLASESLYVKGYKY

SEQ ID NO: 4853 - protein, 357 aa, Helianthus annuus
MSCYKGKYADELIANAAYIGTPGKGILAADESTATIGKRLSSINVENNESNRRALRELLFCTPGALQYISGIILFEETLYQKTAAGKPFVELMKEAKVLPGIKVDKGVVELAGTNGETTTTGLDGLGQRCAKYYEAGARFAKWRAVLKIGANEPSPLAIMENAHGLARYAIICQENGLVPIVEPEILVDGPHDINKCADVTERVLAECYKALNDHKVLLEGTLLKPNMVTPGSDAKKVAPEVVGEYTVRALQRTMPPAVPAVVFLSGGQSEEEASVNLNAINQYKGKKPWSLTFSYGRALQQSTLKAWAGKEENVKKAQEVFLGRCKANSEASEGKYKGGAAGEGANESLHVKDYKY

SEQ ID NO: 4854 - protein, 358 aa, Abies balsamea
MSCFQGKYHDELIANAAYIATPGKGILAADESTGTIGKRLASINVENIETNRRLLREFLFTAPNALQYLSGAILFEETLYQKTAAGKPFVDVLKEGGVLPGIKVDKGTVDLAGTNGETTTQGLDGLAQRCQQYYNAGARFAKWRSVLKIGITEPSPLAIQENANGLARYAIICQENGLVPIVEPEILVDGPHDIKTCAAVTEKVLAACYKALNDHHVLLEGTLLKPNMVTPGSDSPKVAPEVIAEHTVRALQRTVPPAVPGIMFLSGGQSEEQATLNLNAINKLQTKKPWTLSFSFGRALQASTLKTWAGKDGNIPAAQAALLSRCKANSEATLAKYAGDSSKGNGVSESLHVKDYKY

SEQ ID NO: 4855 - protein, 344 aa, Gossypium hirsutum
NAAYIGTPGKGILAADESTGTIGKRLSSINVENIEENRRALRELLFTAPGALQYLSGVILFEETLYQKTASGKPFVDVLKEGGVLPGIKVDKGTVELNGTNGETFTQGLDGLAQRCQKYYEAGARFAKWRAVLKISANEPTELAVQENANGLAMYAAICQQCGLVPIVEPEILVDGSHDIQKCAAVTERVLAACYKALNDHHVMLEGTLLKPNMVTPGSDSPKVAPDVIAEYTVRALQRTVPAAVPAIVFLSGGQSEEEATLNLNAMNKLQTKKPWSLSFSFGRALQQSTLKTWAGKEENVKKAQDTLLVRCKANSEATLGTYKGDAELCEGAAESLHVKDYKY

SEQ ID NO: 4856 - protein, 357 aa, Podocarpus macrophillus
MSAFCGKYTEELIRTAKYIATPGKGILAADESTGTIGKRLASINVDNVEANRQTLRELLFTCPGALQCLSGVILFEETLYQKTKSGKPFVEVLQEGGVVPGIKVDKGTVDLAGTNGETTTQGLDGLAQRCQQYYKAGARFAKWRAVLKIGLTEPSELSIQQNAHGLARYAIICQENGLVPIVEPEVLTDGSHDIKKCAEVTEKVLAAVYKALNDHDVLLEGSLLKPNMVTPGSDGPKVGPEVIAENTVKALQRTVPVAVPGIVFLSGGQSEEEATLNLNAMNKLETIKPWTLSFSFGRALQQSTLKTWVGKEENVEAAQKAFLVRCKANSEATLGKYAGGAGAGAASESLYVKGYKY

SEQ ID NO: 4857 - protein, 357 aa, Trifolium pratense
MSAFVGKYADELIKNAKYIATPGKGILAADESTGTIGKRLSSINVENIEANRQALRELLFTSPNALQYLSGVILFEETLYQNSSDGKPFVEILQENNVIPGIKVDKGVVELAGTNGETTTQGFDSLGARCQQYYKAGARFAKWRAVLKIGPNEPSELSIQQNAQGLARYAIICQENGLVPIVEPEILTDGSHDIAKCAAVTETVLAAVYKALNDQHVLLEGTLLKPNMVTPGSDSPKVSPEVIGEYTVNALRRTVPPAVPGIVFLSGGQSEEQATLNLDAMNKLDVVKPWTLSFSFGRALQQSTLKTWAGKKENVGKAQEVFLTRCKSNSEATLGKYGGGSGTGLASESLYVKDYKY

SEQ ID NO: 4858 - protein, 357 aa, Vigna unguiculata
MSCFKSKYQDELIANAAYIGTPGKGILAADESTGTIGKRLSSISVENNETNRRVLRELLFTAPGCAECLSGVILFEETLYQKTATGVPFVDVMKKGGILPGIKVDKGTVELAGTNGETTTQGLDDLAQRCQKYYEAGARFAKWRAVLKIGPTEPSPLAIHENAYGLARYAAICQENGLVPIVEPEILSDGPHEIEKCADVTERVLAACYKALSDHHVLLEGTLLKPNMVTPGSDGKRVGSEVIAEHTVRALLRTVPPAVPAIVFLSGGQSEEEATVNLNAMNMLKGKKPWSLTFSYGRALQQSTLKAWSGKDENIKKAQEALLVRCKANSQATLGSYKGDAKGDGASESLHVKDYKY

SEQ ID NO: 4859 - protein, 357 aa, Lactuca sativa
MSAFVGKYADELIKNAKYIATPGKGILAADESTGTIGKRLSSINVENVESNRQALRELLFTAPNAVTYLSGVILFEETLYQKTADGKPFVDVLLEANVLPGIKVDKGVVDLSGTNGETTTQGLDGLGARCAKYYEAGARFAKWRAVLKIGATEPSELSIQQNAQGLARYAIICQENGLVPIVEPEILTDGSHDIKKCAYATEMVLAAVYKALNEQHVLLEGTLLKPNMVTPGSDSPKVTPEVIAEYTVTALRRTVPAAVPGIVFLSGGQSEEQATVNLNAMNKLEVLKPWTLTFSFGRALQSSTLKTWGGKKENVAAAQAVFLARCKANSDATLGKYEGEGAGGLASESLYVKGYKY

SEQ ID NO: 4860 - protein, 357 aa, Quercus alba
MSAFVGKYAEELIKNARYIATPGKGILAADESTGTIGKRLASINVENIESNRQALRELLFTSPNALPYLSGVILFEETLYQKASDGKPFVEVLQENNVIPGIKVDKGTVELAGTNGETTTQGLDSLGARCQQYYKAGARFAKWRAVLKIGPNEPSELSIQQNAQGLARYAIICQENGLVPIVEPEILTDGAHDIKKCAAATEIVLAAVYKALNDQHVLLEGTLLKPNMVTPGSNSPKVTPEVIAEYTVTALRRTVPAAVPGIVFLSGGQSEEEATLNLNAMNRLEVLKPWTLSFSFGRALQQSTLKTWAGKKENVGKAQQVFLVRCKANSESTLGKYSGGGAGGLASESLFVKGYKY

SEQ ID NO: 4861 - protein, 357 aa, Arachis hypogaea
MSAFVGKYADELIKNAKYIATPGKGILAADESTGTIGKRLASINVENIEANRQALRELLFTSPNALPYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGNHDIAKCAAVTETVLAAVYKALNDHHVLLEGTLLKPNMVTPGSDSPKVPPAVIAEHTVTALRRTVPSAVPGIVFLSGGQSEEEATLNLDAMNKLEVLKPWTLSFSFGRALQQSTLKSWAGKKDNITKAQVAFLARCKANSEATLGKYGGGSGTGLASESLFVKGYKY

SEQ ID NO: 4862 - protein, 357 aa, Prunus persica
MSAFVGKYAEELIKNAKYIATPGKGILAADESTGTIGKRLSSINVENIESNRQALRELLFTSPNALTYLSGVILFEETLYQKTTDGKPFVEVLQENNVIPGIKVDKGTVELAGTNGETTTQGFDSLGARCAQYYKAGARFAKWRAVLKIGPTEPSELSIQQNAQGLARYAIICQENGLVPIVEPEILTDGDHDIKKNAAVTETVLAAVYKALNEHHVLLEGTLLKPNMVTPGSDSPKVTPEVIAEYTVTALRRTVPAAVPGIVFLSGGQSEEEATLNLDAMNKLDVLKPWTLSFSFGRALQASTLKTWGGKKENVGKAQENFLTRCKANSDATLGKYGGGSADGLASESLFVKGYKY

SEQ ID NO: 4863 - protein, 130 aa, Taxus baccata
MVTPGLDGPKVTPEVIAEYTVKALQRTVPVAVPGIVFLSGGQSEEEATKNLNAMNKLNTIKPWTLSFSFGRALQQSTLKTWAGKKENLEAAQKALLVRCKANSEATLGKYSGDAGVGLATESLHVKNYKY

SEQ ID NO: 4864 - protein, 605 aa, Triticum aestivum
ESLRANLHEPTLPTLAMEIGSVPSQDEDAAAATPREATLGRHLARRLAEVGARDVFAVPGDFNLTLLDELEAEQPSGGGVRLVGCCNELNAAYAADGYARARAGGVGACVVTFTVGALSAINAVAGAFSENLPVVCISGGPNSNDYGSNRILHHTIGLPDFSQELRCFQNVTCYQAVVNNLEDAHEQIDTAISTALKESKPVYISICCDLPSIPHPTFGHHPVPFFLSPRLSNQMSLEAAVEAAAAFLNKSVKPVLIGGAKMRVAKARKAFVELADACGYPFAVMPSAKGLVPEHHPRFIGTYWGIVSTPFCGEIVESADAYLFAGPMFNDHTSVGYSLLLNKEKAIIVQPDRVVIGNGPAFGCVLMKDFLRALATRLKKNTAACEIHSRIFVPEGEPRPSEPGEPLRVNVFFKHIQKMLSGNSAVIAETGDSWFNCQKLKLPEGCGYECQLQYGSIGWSVGATLGYAQASKDKRVISLIGDGSFQVTAQEVSTMLRWGQNNIIFLINNGGYTIEVKIHDGPYNVIKNWNYTSLVEAFHNGEGKCYTAKVRTEEELEEAIEASLGPHKDSLCFIEVIVHKDDTSKELLVWGARLFAANNRPPNPQ

SEQ ID NO: 4865 - protein, 184 aa, Triticum aestivum
MGSSPAPSPSPSTSPPMPMIGRAGNLTVFITPPSPASTPRSSRPSDSPRPDFSTPTSRTGTAPPPPQKSASPPAPPVKFSPPAPPVKVSLPPVQVPPPQYGKASAGGKHDGSAFGFLWDAVARVQEAHASLDEYVANWFGLDQSKYQWALNDYYDTTGKEVEYGKAGKPKELTTTTTTTKVQKV

SEQ ID NO: 4866 - protein, 222 aa, Triticum aestivum
GTRKPPLPLSAMASRPFPRESPRSRPPSSSSLSASVQMGSSPAPSPSPSTSPPMPMIGRAGNLTVFITPPSPASTPRSSRPSDSPRPDFSTPTSRTGTAPPPAQKSASPPAPPVKFSPPAPPVKVSLPPVQVPPPQYGKASAGGKHDGSVFGFLWDAVARVQEAHASLDEYVANWFGLDQSKYQWALNDYYDTTGKEVEYGKAGKPKELTTTTTTTNKVQKV

SEQ ID NO: 4867 - protein, 177 aa, Pseudoroegneria spicata
MGSSPAPSTSPPMPMIGRAGNLTVFITPPSPASTPRSSRPSDSPRPDFSTPTPRTGTALPPPQKSASPPAPPVKFSPPAPPVKVSLPPVQVPPPQYGKASTGGKHDGSAFGFLWDAVARVQEAHASLDEYVANWFGLDQSKYQWALNDYYDTTGKEVEYGKAGKPKELTTTTKVQKV

SEQ ID NO: 4868 - protein, 226 aa, Triticum aestivum
  misc_feature (11)..(11): Xaa can be any naturally occurring amino acid
DPRFRTANKSXTAIVCNGSRPFPRESPLSRPPSSSSLSASVQMGSSPAPSPSPSTSPPMPMIGRAGNLTVFITPPSPASTPRSSRPSDSPRPDFSTPNSRTGTAPPPPQKSASPPAPPVKFSSPPPPVKVSLPPVQVPPPQYGKASAGGKHDGSAFGFLWDAVARVQEAHTSLDEYVANWFGLDQSKYQWALNDYYDTTGKEVEYGKAGKPKELTTTTTTTKVQKV

SEQ ID NO: 4869 - protein, 181 aa, Brachypodium distachyon
MGSSSPSPSPPPPPPPMIGRAGNLTVFITPPSPASTPRSSRPSESPRSDLSTPASRTAPAPPVSPSPQKRASPPPSPVKFSPPALPVKVFPSPVQVPPAQYEKASAGDKHDGSAFAFFWDAVARVQEAHASLDEYVANWFGLDQSKYQWALNDYYENTGKEVECGKAGKPKELLTTKVQKV

SEQ ID NO: 4870 - protein, 251 aa, Triticum aestivum
MAAGPFALRLGPRLAAPTVASATRGGGRGSGRPTASRALVSKKPNKDHRLWIRKDSAGSGKKALCLVNTVSKLPNEKEAVYGALDRWTAFESEFPIIAAAKALEMLKKRRKWLQIIQVTKWLMSKGQVLTWTTYDTLLLALSMDGRVDEAESIWNTILETYTRSVPKKLFSRMIQIYNTRHLPDKVLEIYADMEELGVRPDEDTTRRVGRAFASSGQEDKQKPVLEKYLKKWKYIHFNGERVRVRRAGPLA

SEQ ID NO: 4871 - protein, 280 aa, Triticum aestivum
  misc_feature (9)..(9): Xaa can be any naturally occurring amino acid
RRPTRTVLXRVLVFHSNPLPNHSLRAGCAMAAGPFALRLGPRLAAPTVASATRGGGRGSGRPTASRALVSKKPNKDHRLWIRKDSAGSGKKALCLVNTVSKLPNEKEAVYGALDRWTAFESEFPIIAAAKALEMLKKRRKWLQIIQVTKWLMSKGQVLTWTTYDTLLLALSMDGRVDEAESIWNTILETYTRSVPKKLFSRMIQIYNTRHLPDKVLEIYADMEELGVRPDEDTTRRIGRAFATSGQEHKQKPVLEKHLKKWKYIHFNGERVRVRRAGPLA

SEQ ID NO: 4872 - protein, 253 aa, Oryza sativa
MAGAFSLRLGPRIAGTPPPPASATKGEGRGGGRPTGSRALVSKKPNKEHHLWIRKDSAGSGKKALHLVNTVSKLPNEKEAVYGALDKWTAFEPEFPTIAAAKALEMLKRRRQWLRIIQVAKWLMSKGQVLTWTTYDTLLLALFMDGRIDEAESIWNNIIQTHTRSVPKRLFSRMILIYDTRHCPDKVLEVIYADMEELGVHPDEDTTRRIGRAFVTLGQEDKEKIVLEKYLKKYKYMHFNGERVRVRRGGPLT

SEQ ID NO: 4873 - protein, 760 aa, Pennisetum glaucum
AEEDEGHHTPAHRDHDRRTMPIPPGLPPLHTGREGRPVISPGSTKRVGAIVRPTTPKSPVPIVSAFERIEDSDEEEDLVPDAKNDAAYLASNGAVASELLPDKTSQNGELKAVPSTQMIRSHSATGSLHAPQLNPIAADILRKEPEHETFSKINITAVETPSSDEIEAYKVLQKCLELRERYIFREEVAPWEKEIITDPSTPKPNPNPFNYEHQAKTDHHFEMVDGVVHVYPNKDSKERLYPVADATTFFTDMHYILRVLAAGDIRTVCHHRLNLLEQKFNLHLMVNADRELLAQKAAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLYEVTIDPASHPQLHVFLEQVVGLDLVDDESKPERRPTKHMPTPEQWTNVFNPAYAYYVYYCYANLYTLNKLRESKGMTTIKLRPHCGEAGDIDHLAAAFLTSHNIAHGVNLRKSPVLQYLYYLAQIGLAMSPLSNNSLFIDYHRNPFPTFFLRGLNVSLSTDDPLQIHLTKEPLVEEYSIAASLWKLSSCDLCEIARNSVYQSGFSHRLKSHWIGRNYYRRGPEGNDIHQTNVPHIRVEFRHTIWKEEMELIHLRNVKLAEEIDR

SEQ ID NO: 4874 - protein, 825 aa, Triticum aestivum
MEPSPSYALHLAVAALVGATFAAASAYYMHRKTLDQLLRFARSLDRDHRRRARLLPDGAEDSDRDREEGEEEDDGPPPHRDHDRRTLPIPPGLPPLHTGREGKPTISPAANKRVGSLVRPTTPKSSVPAVSTFESIEDSDEDVDLEPDSKNDDAVYVGTNGAIGSDPVPVKADQNGDIPATSMIRSHSATGSLHGIQLNPVAADILRKEPEHETFSRINITAVETPSHDEIEAYKVLQKCLELREKYIFREEVAPWEKEIITDPSTPKPNPNPFNYEHQTKTEHHFEMVDGVVHLYPSKDSKERLYPVADATTFFTDMHYILRVLAAGDIRTVCHHRLNLLEQKFNLHLMVNADRELLAQKAAPHRDFYNVRKVDTHVHHSACMNQKHLLRFIKSKLKKEPDEVVIFRDGTYLTLKEVFESLDLTGYDLNVDLLDVHADKSTFHRFDKFNLKYNPCGQSRLREIFLKQDNLIQGRFLAELTKEVFADLEASKYQMAEYRISIYGRKKSEWDQMASWIVNNELYSENVVWLIQIPRIYNVYREMGTINSFQNLLDNIFLPLFEVTVDPSSHPQLHVFLEQVVGLDLVDDESKPERRPTKHMPTPEQWTNVFNPAYAYYVYYCYANLYTLNKLRDSKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYKRGPDGNDIHQTNVPHIRIEFRHNIWKDEMELIHFGNVKLPEETDR

SEQ ID NO: 4875 - protein, 690 aa, Setaria italica
DSDEEEDLVPDAKNDAAYLASNGAVASELLPDKTSQNGELKAVPSTQMIRSHSATGSLHVPQLNPIAADILRKEPEHETFSKINITAVETPSSDEIEAYKVLQKCLELRERYIFREEVAPWEKEIITDPSTPKPNPNPFNYEHQAKTEHHFEMVDGVVHVYPNKDSKERLYPVADATTFFTDMHYILRVLAAGDIRTVCHHRLNLLEQKFNLHLMVNADRELLAQKAAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNIYREMGTINSFQNLLDNIFLPLYEVTIDPASHPQLHVFLEQVVGLDLVDDESKPERRPTKHMPTPEQWTNVFNPAYAYYVYYCYANLYTLNKLRESKGMTTIKLRPHCGEAGDIDHLAAAFLTSHNIAHGVNLRKSPVLQYLYYLAQIGLAMSPLSNNSLFIDYHRNPFPTFFLRGLNVSLSTDDPLQIHLTKEPLVEEYSIAASLWKLSSCDLCEIARNSVYQSGFSHRLKSHWIGRNYYRRGPEGNDIHQTNVPHIRVEFRHTIWKEEMELIHLRNVKLPEEIDR

SEQ ID NO: 4876 - protein, 830 aa, Triticum aestivum
  misc_feature (29)..(29): Xaa can be any naturally occurring amino acid
  misc_feature (69)..(69): Xaa can be any naturally occurring amino acid
  misc_feature (71)..(71): Xaa can be any naturally occurring amino acid
  misc_feature (73)..(74): Xaa can be any naturally occurring amino acid
  misc_feature (77)..(77): Xaa can be any naturally occurring amino acid
  misc_feature (85)..(85): Xaa can be any naturally occurring amino acid
  misc_feature (311)..(311): Xaa can be any naturally occurring amino acid
  misc_feature (401)..(402): Xaa can be any naturally occurring amino acid
HPPPRRHGALPVLRAPPGRRGARRRHLRXRVRYMHRKTLDQLLRFARSLDRDHRRRARLLPDGAEDSDXDXEXXEEXDDGPPPHXDHDRRTLPIPPGLPPLHTGREGKPTISPAANKRVGSLVRPTTPKSSVPAVSTFESIEDSDEDVDLEPDSKNDDAVYVGTNGAIGSDPVPVKADQNGDIPATSMIRSHSATGSLHGIQLNPVAADILRKEPEHETFSRINITAVETPSHDEIEAYKVLQKCLELREKYIFREEVAPWEKEIITDPSTPKPNPNPFNYEHQTKTEHHFEMVDGVVHLYPSKDSKERLXPVADATTFFTDMHYILRVLAAGDIRTVCHHRLNLLEQKFNLHLMVNADRELLAQKAAPHRDFYNVRKVDTHVHHSACMNQKHLLRFIKSXXKKEPDEVVIFRDGTYLTLKEVFESLDLTGYDLNVDLLDVHADKSTFHRFDKFNLKYNPCGQSRLREIFLKQDNLIQGRFLAELTKEVFADLEASKYQMAEYRISIYGRKKSEWDQMASWIVNNELYSENVVWLIQIPRIYNVYREMGTINSFQNLLDNIFLPLFEVTVDPSSHPQLHVFLEQVVGLDLVDDESKPERRPTKHMPTPEQWTNVFNPAYAYYVYYCYANLYTLNKLRDSKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYKRGPDGNDIHQTNVPHIRIEFRHNIWKDEMELIHFGNVKLPEETDR

SEQ ID NO: 4877 - protein, 831 aa, Brachypodium distachyon
MESSAYALHLAVAALVGASFAAASAYYMHRKTLDQLLRFARSLDQRDHNRRRRGHHLRAHLLPDEDDSDLDQAEADEDDSPPARDHDRRFLPIPPGLPPLHTGREGKPTISPASNKRIGSLVRPTTPKSSVPTVSAFESIEDSDEDAELVQDSKNDAVYLGTNGANGSDPIPDKATQNGDIKPVPSSNMIRSHSATGSLHGVQLNPVAADILRKEPEHETFSRINITAVETPSHDEAEAYKVLQKCLELREKYIFREEVAPWEKEIITDPSTPKPNPNPFNYEHQTKTEHHFEMVDGVVHLYPNKDSKERLYPVADATTFFTDMHYILRVLAAGDIRTVCHHRLNLLEQKFNLHLMVNADRELLAQKAAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKEVFADLEASKYQMAEYRISIYGRKKSEWDQMASWIVNNELYSDNVVWLIQIPRIYNVYREMGTINSFQNLLDNIFLPLFEVTVDPASHPQLHVFLEQVVGLDLVDDESKPERRPTKHMPTPEQWTNVFNPAYAYYVYYCYANLYTLNKLRDSKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYRRGPDGNDIHQTNVPHIRIEFRHTIWKEEMELIHLGNVKIPEETDR

SEQ ID NO: 4878 - protein, 814 aa, Zea mays
MDSPYALHLAIAALVGASFAAASAYYMHRKTLDQLLRFARDQQRRRNRLLPEGDELEDGEEDPPPHWDHDRRTLPIPPGLPPLHTGREGCRPVVSPGSTKRVGPIVRPTTPKSSVPTISAFDRIEDSDDEEDLVPDAKNDTAYLTPNGAIGSDLTDKASQNGELTSAPSTQMIRSHSATGSLHVPQLNPIAADILRKEPEHETFSKINITAVETPSPDEIEAYKVLQKCLELRQRYIFREEVAPWEKEIITDPSTPKPNPNPFSYEHQAKTDHHFEMVDGVIHVYPNKDSKERLYPVADATTFFTDMHYVLRVLAAGDIRTVCHHRLNLLEQKFNLHLMVNTDRELLAQKAAPHRDFYNVRKVDTHVHHSACMNQKHLLRFIKSKLRKEPDEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLYEVTVDPASHPQLHVFLKQVVGLDLVDDESKPERRPTKHMPTPEQWTNIFNPAYAYYVYYCYANLYTLNKLRESKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYRRGPEGNDIHQTNVPHIRVEFRHTIWKEEMELIHFGNVNLPEEVDR

SEQ ID NO: 4879 - protein, 817 aa, Sorghum bicolor
MESPYALHLALAALVGASFAAASAYYMHRKTLDQLLRFARDQQRRRNRLLPDADELEGGEDDEDYPPAHRDHDRRTLPIPPGLPPLHTGREGGRPVISPGSTKRVGPIVRPTTPKSSVPTVSAFDRIEDSDDEEDLVPDAKNDTAYLAPNGAVGSDLTDKASQNGELKSAPSTQMIRSHSATGSLHAPQLNPIAADILRKEPEHETFSKINITAVETPSPDEIEAYKVLQKCLELRERYIFREEVAPWEKEIITDPSTPKPNPNPFNYEHQAKTDHHFEMVDGVIHVYPNKHSKERLYPVADATTFFTDMHYILRVLAAGDIRTVCHHRLNLLEQKFNLHLMVNTDRELLAQKAAPHRDFYNVRKVDTHVHHSACMNQKHLLRFIKSKLRKEPNEVVIFRDGTYLTLKEVFESLDLTGYDLNVDLLDVHADKSTFHRFDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLYEVTVDPASHPQLHVFLEQVVGLDLVDDESKPERRPTKHMPTPEQWTNVFNPAYAYYVYYCYANLYTLNKLRESKGMTTIKLRPHCGEAGDIDHLAAAFLTSHNIAHGVNLKKSPVLQYLYYLAQIGLAMSPLSNNSLFIDYHRNPFPTFFLRGLNVSLSTDDPLQIHLTKEPLVEEYSIAASLWKLSSCDLCEIARNSVYQSGFSHRLKSHWIGRNYYRRGPEGNDIHQTNVPHIRVEFRHTIWKEEMELIHFGNVKLPEEIDR

SEQ ID NO: 4880 - protein, 863 aa, Hordeum vulgare
MRVAVVGGGVSGLAAAHELTASGGDGVRVTLYEEEASLGGHARTVAVDDGAGCVKLDLGFMVFNQVTYPRMMEWLEGHGVEMERSDMSFSVSTQSKGGGGGCEWGNGNGISSLLAQKTNILKPSFWRMVCEILKFRNNALTYLEDHERNPDLDRNETLGQFIQSHGYSLSFQEAYLIPVCTGTWSCSSQDVLSLSAFLVLSFCRNHGLLQLFRHSQLPTVKPSSQSYVNKVKGELESIGCRIKTSCRVKSVSSLDGAGYRVLENDGSVETYDSVIFGVHASNALKLLGAEASHHERRILGACQYVQRDIYLHCDQNLMPRKSSAWSAWNFLGTTSRGFSITYWLNQIQKFESGRPFLVTLNPPCVPDHVLLKWNTSLPVPSVAAAKAYLQLHQIQGKRGIWFCGAYQGHGFHEDGLKSGKAAAQGLLGKKCELLLNPKNMIPSWIEAGARLLVARFFNQYISIGNLILVEEGGSVFSFGKACDKCCVKSVIQVHDPLFYWKVAIEGGMGLAESYIDGCFSVLDKREGLLNLILILIANRDERRNRRIARKGFWLSPFHVIAQLAYAKHFLRQATRKNTATQTRRNISEHYDLSNDFFSLFLDKSMTYSCAVFKENESLEAAQQRKLSLLINKAKVKREHHVLDIGSGWGSLAIETVKQTGCKYTGVTLSAEQHKYAERKVREAGLEDRINFLLCDYRKIPPFKYDAIISCGMIEHVGHEYMDEFFACCESYLAEDGILVLQFISVPEERYEQYRKRPDFIKEYIFPGGCLPSLARIMSAMTASSRFCIEHVENIGPNYYTTLMHWRDNFMANKDQVLALGFDERFLRIWEYYLIFSAAGFKSRAIGDYQVVFSRPGNRRLGQP

SEQ ID NO: 4881 - protein, 849 aa, Hordeum vulgare
MRVAVVGSGGDGVRVTLYEEEASLGGHARTVAVDDGAGCVKLDLGFMVFNQVTYPRMMEWLEGHGVEMERSDMSFSVSTQSKGGGGGCEWGNGNGISSLLAQKTNILKPSFWRMVCEILKFRNNALTYLEDHERNPDLDRNETLGQFIQSHGYSLSFQEAYLIPVCTGTWSCSSQDVLSLSAFLVLSFCRNHGLLQLFRHSQLPTVKPSSQSYVNKVKGELESIGCRIKTSCRVKSVSSLDGAGYRVLENDGSVETYDSVIFGVHASNALKLLGAEASHHERRILGACQYVQRDIYLHCDQNLMPRKSSAWSAWNFLGTTSRGFSITYWLNQIQKFESGRPFLVTLNPPCVPDHVLLKWNTSLPVPSVAAAKAYLQLHQIQGKRGIWFCGAYQGHGFHEDGLKSGKAAAQGLLGKKCELLLNPKNMIPSWIEAGARLLVARFFNQYISIGNLILVEEGGSVFSFGKACDKCCVKSVIQVHDPLFYWKVAIEGGMGLAESYIDGCFSVLDKREGLLNLILILIANRDERRNRRIARKGFWLSPFHVIAQLAYAKHFLRQATRKNTATQTRRNISEHYDLSNDFFSLFLDKSMTYSCAVFKENESLEAAQQRKLSLLINKAKVKREHHVLDIGSGWGSLAIETVKQTGCKYTGVTLSAEQHKYAERKVREAGLEDRINFLLCDYRKIPPFKYDAIISCGMIEHVGHEYMDEFFACCESYLAEDGILVLQFISVPEERYEQYRKRPDFIKEYIFPGGCLPSLARIMSAMTASSRFCIEHVENIGPNYYTTLMHWRDNFMANKDQVLALGFDERFLRIWEYYLIFSAAGFKSRAIGDYQVVFSRPGNRRLGQP

SEQ ID NO: 4882 - protein, 462 aa, Triticum aestivum
MEDANAVVDWNVDIIGPDGGSGACRKLAKTEDPDATECSSSFGDTLSGSQDDAKPSEISDIEVDSPFCRYPHNGDAAALLDAAAADNLDRLLKKKKVTDHWRSYISPLMWRCQWLELRMKDLQSQVSRYDRELAVLKHEKELQTKMIELDCSSSRSVPFSSHCCRKTMKRKKRKRNEEKINAPSYIATHTILSYYEKEKTEGDGHSIDDNGNLDDSTKGNNDADWLLGNGDDATVEQILVSIQSVQDRVCSLRSDLKKAMAKKSKGLLLKVNTQVNGAQSSNCSHGKGKVTEMPEISPQDASDCDMGDTDMPDSAVSSYGEANNMDIFESTMNLLSVEDPDKIGELRQTSEDVLIDNQPAEEGYQNFEVISHPCQRLRVSVKREQVPVKRETVAHSEDESVAAPMAVVKEEGGTTRMGLQGILKPCYTGKRKGRRPKILRRGGSSSALSSWRSARTRKKRKS

SEQ ID NO: 4883 - protein, 468 aa, Brachypodium distachyon
MEDVNGVVDWNVDIIGPDGGGPSSKLAKIEDPDATECSSSFGDTLSGSEDDARPSEISDIEVDSPFCRYHPNGDAAALLDTAAADNLDRSLKKKKVTDHWRTYISPLMWRCQWLELRMKELHSQVSRYDRELAVLKHEKELQTKMIELDCSSSRSVPFSSLCCRKTMKRRRRKRTEEKMNASSYIATHTILSYYEKEKAEADGHSIDDNGILADDSTKGNNDADWLLGNGSDATVEQILASIQSVQDRVLSLRSYLKTEIDKKSNGIDLKVNTRVNVAQSSNCAHGKGKVAEMLEISPQDASDCDMDDTDMPDSAVSSFGEANNMDIFESTMNLLSAEDPHKMGELQQSSEDVLIDNQPAEEGYQNFEVISHPCKRLRVSVKSEAGVVKRETGAHSEDESIAAPTVAIVKKEEPPEDGTTRFGLQGILKPCYTGKRKGRKPKILRRGGSSSSALSSWRSARTRKKRKL

SEQ ID NO: 4884 - protein, 326 aa, Hordeum vulgare
EFYAINTDSQALVNSQAQHPLQIGEQLTRGLGTGGNPNLGEQAAEESKEVIANALRDSDLVFITAGMGGGTGSGAAPVVAQIAKEAGYLTVGVVTYPFSFEGRKRSLQALEALEKLERSVDTLIVIPNDRLLDIADENMPLQDAFLLADDVLRQGVQGISDIITIPGLVNVDFADVKAVMKNSGTAMLGVGVSSSKNRAQEAAEQATLAPLIGSSIEAATGVVYNITGGKDITLQEVNKVSQIVTSLADPSANIIFGAVVDDRYNGEIHVTIIATGFPQSFQKSLLADPKGARILEAKEKAASLVSAAVQQPTPAAVPTWSRRLFS

SEQ ID NO: 4885 - protein, 770 aa, Gossypium hirsutum
MGASILSDLGTEILIPVCAVIGIAFSLLQWVLVSKVKLSPGRDPGSPRNNGAGGKNDCADYLIEEEEGLNDHNVVLKCAEIQSAISEGATSFLFTEYQYVGIFMVAFAILIFVFLGSVEAFSTKSQPCTYDQSRICKPALATAAFSTISFLLGAVTSVVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLIISSVGIIVCLITTLFATDFFEIKAVKEIEPSLKRQLIISTVLMTIGIGVVSWVALPSSFTIFNFGDQKVVKNWQLFLCVAVGLWAGLIIGFVTEYYTSNAYSPVQDVADSCRTGAATNVIFGLALGYKSCIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLVVGIFFGVETLSGVLAGSLVSGVQIAISASNTGGAWDNAKKYIEAGASEHAKTLGPKGSDPHKAAVIGDTIGDPLKDTSGPSLNILIKLMAVESLVFAPFFATHGGLLFKIF

SEQ ID NO: 4886 - protein, 770 aa, Gossypium hirsutum
MGASILSDLGTEILIPVCAVIGIAFSLLQWVLVSKVKLSPGRDPGSPRNNGAGGKNDCADYLIEEEEGLNDHNVVLKCAEIQSAISEGATSFLFTEYQYVGIFMVAFAILIFVFLGSVEGFSTKSQPCSYDQSKICKPALATAAFSTISFLLGAVTSVVSGFIGMKIATYANARTTLEARKGVGKAFITAFRSGAVMGFLLAANGLLVLYITINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLIISSVGIIVCLITTLFATDFFEIKAVKEIEPSLKRQLIISTVLMTIGIGVVSWVALPSSFTIFNFGDQKVVKNWQLFLCVAVGLWAGLIIGFVTEYYTSNAYSPVQDVADSCRTGAATNVIFGLALGYKSCIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLVVGIFFGVETLSGVLAGSLVSGVQIAISASNTGGAWDNAKKYIEAGASEHAKTLGPKGSDPHKAAVIGDTIGDPLKDTSGPSLNILIKLMAVESLVFAPFFATHGGLLFKIF

SEQ ID NO: 4887 - protein, 771 aa, Gossypium hirsutum
MGASSILPDLGTEILIPVCAVIGIAFSLVQWILVSRVKLSPGRDSGAPGNNGAAGKNGYADYLIEEEEGLNDHNVVVKCAEIQNAISEGATSFLFTEYQYVGIFMVAFAILIFLFLGSVEGFSMKSQPCTYDLSRMCKPALATAALSTLSFLLGAVTSVVSGFLGMKIATYANARTTLEARKGVGKAFITAFRSGAVMGFLLAANGLLVLYIAINVFKLYYGDDWGGLLEAITGYGLGGSSMALFGRVGGGIYTKAADVGADLVGKVERNIPEDDPRNPAVIADNVGDNVGDIAGMGSDLFGSYAESSCAALVVASISSFGMNHELTPMLYPLIISSVGIIVCLITTLFATDFFEIKAVDEIEPSLKRQLIISTVLMTIGIGVVSWIALPPSFTIFNFGDQKLVKNWQLFLCVAVGLWAGLIIGFVTEYYTSNAYSPVQDVADSCRTGAATNVIFGLALGYKSCIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTSKPDYATCVKISTDASIKEMIPPGALVMLTPLIVGIFFGVETLSGVLAGSLVSGVQIAISASNTGGAWDNAKKYIEAAASDHARALGPKGSDPHKAAVIGDTIGDPLKDTSGPSLNILIKLMAVESLVFAPFFATHGGLLFKIF

SEQ ID NO: 4888 - protein, 333 aa, Gossypium hirsutum
MGASILSDLGTEILIPVCAVIGIAFSLLQWVLVSKVKLSPGRDPGSPRNNGAGGKNDCADYLIEEEEGLNDHNVVLKCAEIQSAISEGATSFLFTEYQYVGIFMVAFAILIFVFLGSVEAFSTKSQPCTYDQSRICKPALATAAFSTISFLLGAVTSVVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLLVPMLNHLVLHLLLLPSLLLASIMSSLQCYILSS

SEQ ID NO: 4889 - protein, 767 aa, Gossypium hirsutum
MGASILSDFGAEILIPVCAVIGIAFSLVQWVLVSKVKLSPGRESVNNGSGAKNGYSDYLIEEEEGLNDHSVVLKCAEIQSAISEGATSFLFTEYQYVGIFMVAFAILIFLFLGSVEGFSSKSQPCTYDKSKICKPALATAAFSTISFLLGAITSVVSGFVGMKIATYANARTTLEARKGVGKAFITAFRSGAVMGFLLAANGLLVLYIAINLFKLYYGDDWSGLFEAITGYGLGGSSMALFGRVGGGIYTKAADVGADLVGKVERNIPEDDPRNPAVIADNVGDNVGDIAGMGSDLFGSYAESSCAALVVASISSFGINHELTPMLYPLIISSVGIIVCLITTLFATDFFEIKAVKEIEPSLKRQLIISTVLMTIGIGIVSWIALPSSFTIFNFGDQKAVKNWQLFLCVAVGLWAGLIIGFVTEYYTSNAYSPVQDVADSCRTGAATNVIFGLALGYKSCIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTTKPDYATCVKISTDASIKEMIPPGALVMLTPLVVGIFFGVETLSGVLAGSLVSGVQIAISASNTGGAWDNAKKYIEAGASTHAKSLGPKGSDPHKAAVIGDTIGDPLKDTSGPSLNILIKLMAVESLVFAPFFATHGGLLFKLF

SEQ ID NO: 4890 - protein, 767 aa, Gossypium hirsutum
SILPDLGTEILIPVCAVIGIAFSLVQWILVSRVKLSPGRDSGAPGNNGAAGKNGYADYLIEEEEGLNDHNVVVKCAEIQNAISEGATSFLFTEYQYVGIFMVAFAILIFLFLGSVEGFSMKSQPCTYDLSRMCKPALATAALSTLSFLLGAVTSVVSGFLGMKIATYANARTTLEARKGVGKAFITAFRSGAVMGFLLAANGLWVLYIAINVFKLYYGDDWGGLLEAITGYGLGGSSMALFGRVGGGIYTKAADVGADLVGKVERNIPEDDPRNPAVIADNVGDNVGDIAGMGSDLFGSYAESSCAALVVASISSFGMNHELTPMLYPLIISSVGIIVCLITTLFATDFFEIKAVDEIEPSLKRQLIISTVLMTIGIGVVSWIALPPSFTIFNFGDQKLVKNWQLFLCVAVGLWAGLIIGFVTEYYTSNAYSPVQDVADSCRTGAATNVIFGLALGYKSCIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTSKPDYATCVKISTDASIKEMIPPGALVMLTPLIVGIFFGVETLSGVLAGSLVSGVQIAISASNTGGAWDNAKKYIEAGASDHARALGPKGSDPHKAAVIGDTIGDPLKDTSGPSLNILIKLMAVESLVFAPFFATHGGLLFKIF

SEQ ID NO: 4891 - protein, 771 aa, Citrus sinensis
MGAAILPDLGAEILIPVCAVIGIAFALVQWVLVSNIKLSPARDASGNSPGAGGGKNGCTDYLIEEEEGLNDHNVVIKCAEIQSAISEGATSFLFTEYQYVGVFMVAFAILIFLFLGSVEGFSTKSQACTYDPFKMCKPALATAAFSTVSFLLGGITSVVSGFLGMKIATFANARTTLEARKGVGKAFIVAFRSGAVMGFLLAANGLLVLFIAINLFKLYYGDDWSGLFEAITGYGLGGSSMALFGRVGGGIYTKAADVGADLVGKVERNIPEDDPRNPAVIADNVGDNVGDIAGMGSDLFGSYAESSCAALVVASISSFGINHELTAMLYPLLISSAGIIVCLITTLFATDIFEIKAVKEIEPSLKKQLIISTVLMTVAIAIVSWIALPSSFTIFNFGSQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIWN

SEQ ID NO: 4892 - protein, 767 aa, Ricinus communis
MGDAILPDLGTEILIPICAIIGIGFSLIQWLLVSKVKLVPSGGAGNNNNNNKNGYSDYLIEEEEGVNDHNVVLKCADIQNAISEGATSFLFTEYQYVGIFMVAFAILIFVFLGSVEGFSTKSQPCTYDQFKMCKPALATAAFSTVSFLLGAFTSVVSGFLGMKIATYANARTTLEARKGVGKAFITAFRSGAVMGFLLAANGLLVLYIAINLFKLYYGDDWAGLFEAITGYGLGGSSMALFGRVGGGIYTKAADVGADLVGKVEKNIPEDDPRNPAVIADNVGDNVGDIAGMGSDLFGSYAESSCAALVVASISSFGMNHELTPMLYPLIISSVGILVCLLTTLFATDFFEIKAVNEIEPALKRQLIISTVLMTIGVAVVSWIALPSSFTIFNFGTQKVVKNWQLFLCVAVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGLMEGTTKPDYATCVKISTDASIKEMIPPGALVMLTPLIVGIFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 4893 - protein, 771 aa, Citrus clementina
MGAAILPDLGAEILIPVCAVIGIAFALVQWVLVSNIKLSPARDASGNSPGAGGGKNGCTDYLIEEEEGLNDHNVVIKCAEIQSAISEGATSFLFTEYQYVGVFMVAFAILIFIFLGSVEGFSTKSQACTYDPFKMCKPALATAAFSTVSFLLGGITSVVSGFLGMKIATYANARTTLEARKGVGKAFIVAFRSGAVMGFLLAANGLLVLFIAINLFKLYYGDDWSGLFEAITGYGLGGSSMALFGRVGGGIYTKAADVGADLVGKVERNIPEDDPRNPAVIADNVGDNVGDIAGMGSDLFGSYAESSCAALVVASISSFGINHELTAMLYPLLISSAGIIVCLITTLFATDIFEIKAVKEIEPSLKKQLIISTVLMTVAIAIVSWIALPSSFTIFNFGSQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSDLQIAISASNTGGAWDNAKKYIEAGASEHARTLGPKGSDPHKAAVIGDTIGDPLKDTSGPSLNILIKLMAVESLVFAPFFATHGGLLFKIWN

SEQ ID NO: 4894 - protein, 765 aa, Nicotiana tabacum
MGAALLPDLGAEIVIPVCAVIGIVFSLVQWYLVSNVKLTPESSSPSNNGKNGYGDYLIEEEEGINEQNVVVKCAEIQNAISEGATSFLFTEYQYVGIFMIAFAILIFLFLGSVEGFSTKSQPCTYNKEKLCKPALATAIFSTVSFLLGAVTSVVSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMLYPLLISSMGILICLITTLFATDFFEIKAVKEIEPALKNQLIISTALMTVGIAIVTWTCLPSSFTIFNFGAQKVVKNWQLFLCVAVGLWAGLIIGFVTEYYTSNAYSPVQDVADSCRTGAATNVIFGLALGYKSVIIPIFAIAIAIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPQVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 4895 - protein, 765 aa, Actinidia deliciosa
MGAGILSDLATEILIPVCAVIGIAFSLIQWVIVSRVQLSPEKHSPTNDGKNGFVESLIEEEEGLNDHNVVQKCAEIQNAISEGATSFLFTEYQYVGIFMGAFAVLIFLFLGSVEGFSTSSQPCTYDSSKRCKPALATAVFSTISFLLGAVTSVVSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDLTAMLYPLLISSMGILVCLITTLFATDFFEIKAVKDIEPTLKRQLIISTVLMTAGIAIISWISLPSSFTIFNFGVQKEVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLLVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSDPHKAAVIGDTVGDPLKDTSGPSLNILIKLMAVESLVFAPFFATHGGLLFKIF

SEQ ID NO: 4896 - protein, 765 aa, Glycine max
MGAVILPDLGTEILIPVCAIIGIGFALFQWVLVSKVKLSAARDASPNAAGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKI

SEQ ID NO: 4897 - protein, 766 aa, Vigna unguiculata
MGAAILPDLGTEILIPVCAVIGIAFALFQWLLVSKVKLSAVRDASPNAAAKNGYNDYLIEEEEGINDHNVVVKCAEIQNAISEGATSFLFTEYKYVGIFMVAFAILIFLFLGSVEGFSTSPQPCTYDKTKTCKPALATAIFSTVSFLLGGVTSLVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGLNHEFTAMLYPLIVSSVGILVCLLTTLFATDFFEIKAVKEIEPALKKQLVISTVLMTIGVAVVSFVALPTSFTIFNFGVQKDVKSWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKIF

SEQ ID NO: 4898 - protein, 490 aa, Glycine max
MGAVILPDLGTEILIPVCAIIGIAFALFQWVLVSKVKLSAARDASSNAGGGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIQFLLLQSVFLLVSPLLPCMVLPLLHLAC

SEQ ID NO: 4899 - protein, 769 aa, Manihot esculenta
MGSAVLSELGTEILVPVCAVVGIVFSLVQWYLVSRVTLTAERQGPGSSPSGANKNGYNDYLIEEEEGLNDPSVVAKCAEIQNAISEGATSFLFTEYQYVGVFMVAFAILIFLFLGSVEGFSTKSQPCTYDKQKTCKPALATAIFSTVSFLLGAFTSVVSGFLGMKIATYANARTTLEARKGVGKAFITAFRSGAVMGFLLAANGLLVLFIAINLFKLYYGEDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTSMLYPLLISSVGILVCLITTLFATDFFEIKAVKEIEPALKKQLIISTVLMTVGIAIVTWIALPSSFSIYNFGTQKVVKNWQLFLCVAVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGLMEGHTKPDYATCVKISTDASIKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 4900 - protein, 765 aa, Manihot esculenta
MGSAVLSELGTEILVPVCAVVGIVFSLVQWYLVSRVKLTAERHAPGSANKNGYNDYLIEEEEGLNDHSVVAKCAEIQSAISEGATSFLFTEYQYVGVFMVAFAILIFLFLGSVEGFSTKSQPCTYDKEKMCKPALATAIFSTVSFMLGAFTSVVSGFLGMKIATYANARTTLEARKGVGKAFITAFRSGAVMGFLLAANGLLVLYIAINLFKLYYGEDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTSMLYPLLISSVGILVCLITTLFATDFFEIKAVKEIEPALKKQLIISTILMTVGIAIVTWIGLPSSFTIYNFGTQKVVKNWQLFLCVAVGLWAGLIIGFVTEYYTSNAYSPVQDVADSCRTGAATNVIFGLALGYKSVIIPIFAIAIGIFVSFSFAAMYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYWFSAMTMKSVGSAALKMVEEVRRQFNTIPGIMEGHAKPDYATCVKISTDASIKEMIPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 4901 - protein, 768 aa, Quercus alba
MGVTLLPDLGTEILIPVCAVVGIAFSLIQWLLVSKVKLTPSSEHASANNGAGKNGFADHLIEEEEGINDHSVVLKCADIQTAISEGATSFLFTEYQYVGVFMAAFAVLIFLFLGSVEGFSTKNQPCTYDETKSCKPALATALFSTISFVLGAVTSVVSGFLGMKIATYANARTTLEARKGVGKAFITAFRSGAVMGFLLAANGLLVLFIAINLFKLYYGDDWGGLFESITGYGLGGSSMALFGRVGGGIYTKAADVGADLVGKIERDIPEDDPRNPAVIADNVGDNVGDIAGMGSDLFGSYAESSCAALVVASISSFGINHEFTPMLYPLIISSVGIIVCLITTLFATDFFEIKAVKEIEPALKRQLIISTILMTVGVAVVSWVALPSSFTIFNFGTQKVVHNWQLFLCVAVGLWAGLIIGFVTEYYTSNAYSPVQDVADSCRTGAATNVIFGLALGYKSVIIPIFAIALSIFVSFSFAAMYGIAMSALGMLSTIATGLAIDAYGPISDNAGGIAEMAGMSHRIRERTDALDAAGNTTAAIGKGFAIGSAALVSLALFGAFVSRAGISAVDVLTPKVFIGLIVGAMLPYWFSAMTMKSVGSAALKMVEEVRRQFNTIPGLMEGTAKPDYATCVKISTDASIKEMIPPGALVMLTPLIAGIFFGVETLSGVLAGSLVSGVQVAISASNTGGAWDNAKKYIEAGASEHARTLGPKGSDPHKAAVIGDTIGDPLKDTSGPSLNILIKLMAVESLVFAPFFATHGGLLFKFL

SEQ ID NO: 4902 - protein, 768 aa, Glycine max
MGAALLSELATEIVVPVCAVIGIVFSLVQWFLVSRVKLTPDRNGTTSSPRNNKNGYGDFLIEEEEGINDHSVVVKCAEIQNAISEGATSFLFTEYQYVGIFMVAFAILIFLFLGSVEGFSTKSQPCTYDKSKLCKPALATALFSTVSFLLGAITSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGILTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 4903 - protein, 768 aa, Glycine max
MGAALLSELATEIVVPACAVIGIVFSLVQWFLVSRVKLTPDRNGTTSSPRNNKNGYGDFLIEEEEGINDHSVVVKCAEIQNAISEGATSFLFTEYQYVGIFMVAFAILIFLFLGSVEGFSTKSQPCTYDKSKLCKPALATALFSTVSFLLGAITSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 4904 - protein, 764 aa, Amsonia hubrichtii
MASALLPDLGTEIVIPVCAIIGIIFSLIQWVIVSRVKVSPERSSSSNNNKNGYNDYLIEEEEGINDHNVVVKCAEIQNAISEGATSFLFTEYRYVGFFMVAFAILIFLFLGSVEGFSTKSQTCTYNKEKLCKPALATAIFSTVSFLLGAFTSVVSGFLGMKIATYANARTTLEARKGVGKAFITAFRSGAVMGFLLAANGLLVLYIAINLFKLYYGEDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTAMLYPLLISSMGILVCLITTLFATDFFEIKAVKEIEPALKMQLIISTVLMTVGVAIVTWTCLPSSFTIFNFGTQKVVKNWQLFLCVGVGLWAGLIIGFVTEYYTSNAYSPVQDVADSCRTGAATNVIFGLALGYKSVIIPIFAIAISIFVSFTFAAMYGIAMAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGQAKPDYATCVKISTDASIKEMIPPGALVMLTPIIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKI

SEQ ID NO: 4905 - protein, 768 aa, Castanea mollissima
MGVTLLPDLGTQVLIPACAVVGIAFSLIQWLLVSKVKLTPSSEHASANNGAGKNGFADHLIEEEEGLNDHSVVLKCAEIQTAISEGATSFLFTEYQYVGVFMAAFAVLIFLFLGSVEGFSTKSQPCTYDETKSCKPALATAVFSTVSFVLGAVTSVISGFLGMKIATYANARTTLEARKGVGKAFITAFRSGAVMGFLLAANGLLVLFIAINLFKLYYGDDWGGLFESITGYGLGGSSMALFGRVGGGIYTKAADVGADLVGKIERDIPEDDPRNPAVIADNVGDNVGDIAGMGSDLFGSYAESSCAALVVASISSFGINHEFTPMLYPLIVSSVGIIVCLITTLFATDFFEIKAVKEIEPALKRQLIISTILMTVGVAVISWVALPSSFTIFNFGTQKVVHNWQLFLCVAVGLWAGLIIGFVTEYYTSNAYSPVQDVADSCRTGAATNVIFGLALGYKSVIIPIFAIAISIFVSFSFAAMYGIAMSALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGTAKPDYATCVKISTDASIKEMIPPGCLVMLTPLIVGIFFGVETLSGVLAGSLVSGVQIAISASNTGGAWDNAKKYIEAGVSEHARSLGPKGSDPHKAAVIGDTIGDPLKDTSGPSLNILIKLMAVESLVFAPFFATHGGLLFKFL

SEQ ID NO: 4906 - protein, 765 aa, Prunus persica
MGATLLPDLGTEILIPLCAVIGIAFSVVQWMFVSQVKLSPGRDANSNAPGKNGYNDYLIEEEEGGNDHNVVLKCAEIQNAISEGATSFLFTEYKYVGGFMVAFAVLIFVFLGSVEGFSTSSRPCTYDQTKICKPALATAIFSTISFLLGAITSVVSGFLGMKIATYANARTTLEARKGVGKAFITAFRAGAVMGFLLASSGLLVLYIAINAFKLYYGDDWGGLFEAITGYGLGGSSMALFGRVGGGIYTKAADVGADLVGKVERNIPEDDPRNPAVIADNVGDNVGDIAGMGSDLFGSYAEASCAALVVASISSFGINHELTAMLYPLIVSSVGILVCLLTTLCATDFFEIKAVNEIEPALKRQLIISTVLMTVGIAIVTWISVPSSFTIFNFGTQKVVKSWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGISTVDVLSPKVVIGLLVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKI

SEQ ID NO: 4907 - protein, 764 aa, Tripterygium wilfordii
MGSGIMPDLASEILIPVCAVIGIAFALVQWVIVSRVKLSPGRGSNGRGKNGYSDCLIEEEEGLNDHNVVLKCAEIQTAISEGATSFLFTEYQYVGIFMVAFAILIFVFLGSVNGFSTKSQPCTYDLQSMCKPALATAAFSTVSFLLGAFTSVISGFLGMKIATYANARTTLEARKGVGKAFIVAFRSGAVMGFLLAASGLLVLYIIINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDLTAMLYPLIISSVGIVVCLITTLFATDFFEVKAVNEIEPALKNQLIISTVLMTVAFGIVTWISVPSSFTIFNFGTQKVVKNWQLFLCVAVGLWAGLIIGFVTEYYTSNAYSPVQDVADSCRTGAATNVIFGLALGYKSVIIPIFAIAVSIFVSVSFAAMYGVSVAALGMLSTIATGLAIDAYGPISDNAGGIAEMAGMSHRIRERTDALDAAGNTTAAIGKGFAIGSAALVSLALFGAFVSRASITTVDVLSPKVFIGLIVGAMLPYWFSAMTMKSVGSAALKMVEEVRRQFNTIPGLMEGTAKPDYATCVKISTDASIKEMIPPGALVMLTPLIVGILFGVETLAGVLAGSLVSGVQIAISASNTGGAWDNAKKYIEAGASEHARTLGPKGSDPHKAAVIGDTVGDPLKDTSGPSLNILIKLMAVESLVFAPFFATHGGLLFKLL

SEQ ID NO: 4908 - protein, 765 aa, Gossypium hirsutum
MGAVLLSEFATEIVVPVCAVIGIAFSLVQWLLVSRVKLNPERHASGNSNKNGYSDYLIEEEEGLNDPSVVTKCAEIQSAISEGATSFLFTEYQYVGIFMVAFAILIFLFLGSVEGFSSKSQPCTYDKEKTCKPALATAIFSTISFLLGAITSVLSGFLGMKIATYANARTTLEARKGVGKAFIVAFRSGAVMGFLLAANGLLVLFVAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSVGILVCLITTLFATDFFEIKAVKEIEPALKKQLIISTVLMTVGIAIVTWVGVPSSFTIYNFGDQKVVKNWQLFLCVGVGLWAGLIIGFVTEYYTSNAYSPVQDVADSCRTGAATNVIFGLALGYKSVIIPIFAIAICIFVSFSFAAMYGIAVAALGMLSTIATGLAIDAYGPISDNAGGIAEMAGMSHHIRERTDALDAAGNTTAAIGKGFAIGSAALVSLALFGAFVSLAAISTVDVLTPKVFIGLIVGAMLPYWFSAMTMKSVGSAALKMVEEVRRQFNTIPGLMEGRAKPDYATCVKISTDASIKEMIPPGALVMLTPLIVGTFFGVETLAGVLAGALVSGVQIAISASNTGGAWDNAKKYIEAGASEHARTLGPKGSDPHKAAVIGDTVGDPLKDTSGPSLNILIKLMAVESLVFAPFFATHGGLLFKIF

SEQ ID NO: 4909 - protein, 766 aa, Aristolochia fimbriata
MGAAILSELLTEILIPVAAVIGIAFALVQWMLVSSVKLSPERQPSTTTNNNKNGYTDYLIEEEEGLNDHNVVVKCAEIQNAISEGATSFLFTEYQYVGIFMVAFAILIFLFLGSVESFSTKMQPCTYNKEKMCKSALANAIFSTVSFLLGAITSLFSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHELTAMLYPLLISSMGIVVCLITTLFATDFFEIKAVKEIEPSLKNQLIISTALMTAGIAVVSWIGLPPSFTIYNFGVQKVVKNWELFFCVAIGLWAGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGSLVSGVQIAISASNTGGAWDNAKKYIEAGASEHARTLGPKGSEPHKAAVIGDTIGDPLKDTSGPSLNILIKLMAVESLVFAPFFARHGGLLFKI

SEQ ID NO: 4910 - protein, 765 aa, Medicago truncatula
MGAVILPDLGTEILIPVCAVIGIAFALFQWLLVSKVKLTAGRDSATEAPGKNGYNDSLIEEEEGINDHNVVLKCAEIQNAISEGSTSFLFTMYKYVGIFMVAFAILIFLFLGSVEGFSTSHQPCTYDETKMCKPALATALFSTIAFILGGITSVISGFLGMKIATYANARTTLEARKGVGKAFITAFRSGAVMGFLLAANGLLVLYITINLFKIYYGDDWGGLFEAITGYGLGGSSMALFGRVGGGIYTKAADVGADLVGKVERNIPEDDPRNPAVIADNVGDNVGDIAGMGSDLFGSYAEASCAALVVASISSFGVNHEFTPMLFPLIISSVGLLVCLLTTLFATDFFEIKLVKEIEPALKKQLVISTALMTVGIAIVSWIALPASFTIFNFGEQKDVKNWQLFLCVAVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGITTVDVLTPKVFIGLLVGSMLPYWFSAMTMKSVGSAALKMVEEVRRQFNTIPGLMEGTAKPDYATCVTISTDASIKEMIPPGALVMLTPLIVGIFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFATHGGLLFKI

SEQ ID NO: 4911 - protein, 768 aa, Quercus alba
MGVTLLPDLGTEILIPACAVVGIAFSLIQWLIVSKVKVTPSSEHASANNGAGKNGFADHLIEEEEGLNDHSIVLKCAEIQTAISEGATSFLFTEYQYVGVFMAAFAVLIFLFLGSVEGFSTKNQPCTYDETKTCKPALATALFSTISFVLGAVTSVVSGFLGMKIATYANARTTLEARKGVGKAFITAFRSGAVMGFLLAANGLLVLFIAINLFKMYYGDDWGGLFESITGYGLGGSSMALFGRVGGGIYTKAADVGADLVGKIERDIPEDDPRNPAVIADNVGDNVGDIAGMGSDLFGSYAESSCAALVVASISSFGINHEFTPMLYPLIVSSVGIIVCLITTLFATDFFEIKAVKEIEPALKRQLIISTILMTVGVAVISWVALPSSFTIFNFGTQKVVHNWQLFLCVAVGLWAGLIIGFVTEYYTSNAYSPVQDVADSCRTGAATNVIFGLALGYKSVIIPIFAIAISIFVSFSFAAMYGIAMSALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGALVSGVQIAISASNTGGAWDNAKKYIEAGVSEHAKSLGPKGSDPHKAAVIGDTIGDPLKDTSGPSLNILIKLMAVESLVFAPFFATHGGLLFKFL

SEQ ID NO: 4912 - protein, 765 aa, Unknown
  Sequence found in Organisms: Solanum tuberosum, Solanum phureja
MGVTILTDLGMEILIPICAVIGIAFSLFQWHLVSKVTVGTDKPHSSGDDKNGYAESLIEEEEGINDHNVVQKCAEIQNAISEGATSFLFTMYQYVGVFMVAFAILIFVFLGSVEGFSTKDQPCTYDSTKTCKPALATAVFSTISFLLGAVTSVVSGFLGMKIATYANARTTLEARKGVGKAFIVAFRSGAVMGFLLAANGLLVLFITILLFKMYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLLISSVGILVCLLTTLFATDFFEVKAVKEIEPALKKQLIISTALMTIGIAFVSWIALPSTFTIFNFGVQKEVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 4913 - protein, 765 aa, Solanum lycopersicum
MGVTILTDLGMEILIPVCAVVGIAFSLFQWYLVSKVTVGTDKSHSSGDDKNGYAESLIEEEEGINDHNVVQKCAEIQNAISEGATSFLFTMYQYVGVFMVAFAILIFVFLGSVEGFSTKNQPCTYDSTKTCKPALATAVFSTVSFLLGAVTSVVSGFLGMKIATYANARTTLEARKGVGKAFIVAFRSGAVMGFLLAANGLLVLFITILLFKMYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLLVSSVGILVCLLTTLFATDFFEVKAVKEIEPALKKQLIISTILMTIGIAFVSWIALPSTFTIFNFGVQKEVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 4914 - protein, 766 aa, Tripterygium wilfordii
MGSAIMPDLATEILIPVCAVIGIAFALVQWVIVSRVKLTPGGDSPANSGGKNGYSDYLIEEEEGLNDHNVVLKCAEIQTAISEGATSFLFTEYQYVGIFMVAFAILIFLFLGSVNGFSTKSQTCTYDPQSMCKPALATAAFSTVSFLLGAVTSVVSGFLGMKIATYANARTTLEARKGVGKAFITAFRAGAVMGFLLAASGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDLTAMLYPLIVSSVGIVVCLFTTLFATDFFEVKAVNEIEPALKKQLIISTVLMTVAVGIVTWISVPSSFTIFNFGTQKVVKNWQLFLCVAVGLWAGLIIGFVTEYYTSNAYSPVQDVADSCRTGAATNVIFGLALGYKSVIIPIFAIAVSMFVSFSFAAMYGVAVAALGMLSTIATGLAIDAYGPISDNAGGIAEMAGMSHRIRERTDALDAAGNTTAAIGKGFAIGSAALVSLALFGAFASRASITTVDVLSPKVFIGLIVGAMLPYWFSAMTMKSVGSAALKMVEEVRRQFNTIPGLMEGTTKPDYATCVKISTDASIKEMIPPGALVMLTPIIVGILFGVETLAGVLTGALVSGVQIAISASNTGGAWDNAKKYIEAGASEHARTLGPKGSDAHKAAVIGDTVGDPLKDTSGPSLNILIKLMAVESLVFAPFFATHGGILFKIL

SEQ ID NO: 4915 - protein, 765 aa, Vinca minor
MTSALLPDLGTEIVIPVCAIIGIAFSLIQWVIVSRVKLSPEQNGSTNNSKNGYNDYLIEEEEGINDHNVVAKCAEIQNAISEGATSFLFTEYKYVGFFMSAFAILIFLFLGSVEGFSTKSQPCTYNKEKTCKPALATAVFSTVSFVLGAVTSVVSGFLGMKIATYANARTTLEARKGVGKAFIVAFRSGAVMGFLLAANGLLVLYIAINLFKLYYGSDWEGLFEAITGYGLGGSSMALFGRVGGGIYTKAADVGADLVGKLERNIPEDDPRNPAVIADNVGDNVGDIAGMGSDLFGSYAEASCAALVVASISSFGIDHDFTAMLFPLLISSMGIIVCLITTLFATDFFEIKAVKEIEPALKNQLIISTALMTVGVAIVTWTCLPSSFTIFNFGTQKVVKNWQIFLCVGVGLWAGLIIGFVTEYYTSNAYSPVQDVADSCRTGAATNVIFGLALGYKSVIIPIFAIAISIFVSFSFAAMYGIAMAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASLKEMIPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKLW

SEQ ID NO: 4916 - protein, 760 aa, Gossypium hirsutum
LSEFATEIVVPVCAVIGIAFSLVQWLLVSRVKLNPERHASGNSNKNGYSDYLIEEEEGLNDPSVVTKCAEIQSAISEGATSFLFTEYQYVGIFMVAFAILIFLFLGSVEGFSSKSQPCTYDKEKTCKPALATAIFSRISFLLGAITSVLSGFLGMKIATYANARTTLEARKGVGKAFIVAFRSGAVMGFLLAANGLLVLFVAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSVGILVCLITTLFATDFFEIKAVKEIEPALKKQLIISTVLMTVGIAIVTWVGVPSSFTIYNFGDQKVVKNWQLFLCVGVGLWAGLIIGFVTEYYTSNAYSPVQDVADSCRTGAATNVIFGLALGYKSVIIPIFAIAICIFVSFSFAAMYGIAVAALGMLSTIATGLAIDAYGPISDNAGGIAEMAGMSHHIRERTDALDAAGNTTAAIGKGFAIGSAALVSLALFGAFVSLAAISTVDVLTPKVFIGLIVGAMLPYWFSAMTMKSVGSAALKMVEEVRRQFNTIPGLMEGRAKPDYATCVKISTDASIKEMIPPGALVMLTPLIVGTFFGVETLAGVLAGALVSGVQIAISASNTGGAWDNAKKYIEAGASEHARTLGPKGSDPHKAAVIGDTVGDPLKDTSGPSLNILIKLMAVESLVFAPFFATHGGLLFKIF

SEQ ID NO: 4917 - protein, 769 aa, Solanum lycopersicum
MGTTILPDLGTEILIPVCAVIGIGFALVQWVIVSKVTVSTDGKSSSPGAGADGKNGYAESLIEEEEGINDHSVVRKCAEIQNAIAEGATSFLFTEYQYVGVFMVAFALLIFLFLGSVEGFSTKSQECTYDSSKMCKPALATAVFSTISFLLGAITSVISGFLGMKIATYANARTTLEARKGVGKAFIVAFRSGAVMGFLLAANGLLVLYIAINVFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGVNHEFTAMLYPLLISSVGILVCLLTTLFATDFFEVKAVKEIEPALKKQLVISTVLMTIGIALVSWTALPSTFTIFNFGIQKEVQSWQLFLCVGVGLWAGLIIGFVTEYYTSNAYSPVQDVADSCRTGAATNIIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLLVGAMLPYWFSAMTMKSVGSAALKMVEEVRRQFNTIPGLMEGTAKPDYANCVKISTDASIKEMIPPGALVMLTPLIVGILFGVETLSGVLAGSLVSGVQIAISASNTGGAWDNAKKYIEAGTSEHAKTLGPKGSDPHKAAVIGDTVGDPLKDTSGPSLNILIKLMAVESLVFAPFFATHGGLLFKMF

SEQ ID NO: 4918 - protein, 765 aa, Orobanche aegyptiaca
MALLPDLGTEIVIPVCAIIGIVFSLVQWLLVSRVKLSPEKGGASAAKNGKTGHNDYLIEEEDGIHDQNVVAKCAEIQNAISEGATSFLFTEYQYVGIFMIAFAILIFLFLGSVEGFSTKSQPCTYEPEKLCKPALATAIFSTVSFLLGAITSVVSGFLGMKIATYANARTTLEARKGVGKAFIVAFRSGAVMGFLLAANGLLVLYIVINLFKLYYGDDWEGLFEAITGYGLGGSSMALFGRVGGGIYTKAADVGADLVGKLERNIPEDDPRNPAVIADNVGDNVGDIAGMGSDLFGSYAESSCAALVVASISSFGMTHDFTAMCYPLLISSMGILVCLITTLFATDFFEIKAVKEIEPALKKQLIISTVLMTVGIAIVTWTCLPSSFTIFNFGAQKVVKNWQLFLCVCVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLIVGAMLPYWFSAMTMKSVGSAALQMVEEVRRQFNTIPGLMEGLAKPDYATCVKISTDASIKEMIPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKMF

SEQ ID NO: 4919 - protein, 769 aa, Solanum phureja
MGTTILSDLGTEILIPVCALIGIGFALVQWVIVSKVTVSTDGKSSSSGAGTDGKNGYAESLIEEEEGINDHSVVHKCAEIQNAIAEGATSFLFTEYQYVGVFMVAFAILIFLFLGSVEGFSTKSQACTYDSSKMCKPALATAVFSTISFLLGAVTSVISGFLGMKIATYANARTTLEARKGVGKAFIVAFRSGAVMGFLLAANGLLVLYIAINVFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGVNHEFTAMLYPLLISSVGILVCLLTTLFATDFFEVKAVKEIEPALKKQLVISTVLMTIGIALVSWIALPSTFTIFNFGIQKEVQSWQLFLCVGVGLWAGLIIGFVTEYYTSNAYSPVQDVADSCRTGAATNIIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLLVGAMLPYWFSAMTMKSVGSAALKMVEEVRRQFNTIPGLMEGTAKPDYANCVKISTDASIKEMIPPGALVMLTPLIVGILFGVETLSGVLAGSLVSGVQIAISASNTGGAWDNAKKYIEAGASEHAKTLGPKGSDPHKAAVIGDTVGDPLKDTSGPSLNILIKLMAVESLVFAPFFATHGGLLFKMF

SEQ ID NO: 4920 - protein, 765 aa, Trigonella foenum-graecum
MGAVILPDLATQILIPVCAVIGIAFALFQWLLVSKVKLTAGRDSSSDAPGKNGYNDSLIEEEEGINDHNVVLKCAEIQNAISEGSTSFLFTMYKYVGIFMVFFAILIFLFLGSVEGFSTSHQPCTYDEKKMCKPALATALFSTIAFILGGITSVISGFLGMKIATYANARTTLEARKGVGKAFITAFRSGAVMGFLLAANGLLVLYITINLFKIYYGDDWGGLFEAITGYGLGGSSMALFGRVGGGIYTKAADVGADLVGKVERNIPEDDPRNPAVIADNVGDNVGDIAGMGSDLFGSYAEASCAALVVASISSFGVNHEFTAMLFPLIISSVGLLVCLLTTLFATDFFEIKLVKEIEPALKKQLVISTALMTVGIAVVSWIALPSSFTIFNFGEQKVVKNWQLFLCVAVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGITTVDVLTPKVFIGLLVGAMLPYWFSAMTMKSVGSAALKMVEEVRRQFNTIPGLMEGTAKPDYATCVTISTDASIKEMIPPGALVMLTPLLVGIFLGVETLSGVLAGSLVSGVQIAISASNTGGAWDNAKKYIEAGASDHARSLGPKGSDPHKAAVIGDTIGDPLKDTSGPSLNILIKLMAVESLVFAPFFATHGGLLFKI

SEQ ID NO: 4921 - protein, 766 aa, Gossypium hirsutum
MGAAMLSELATEIVVPVCAVIGIAFSLVQWVMVSRVKLTSERHASSANSSKNGYGDYLIEEEEGINDHSVVTKCADIQNAISEGATSFLFTEYQYVGIFMIAFAILIFLFLGSVEGFSMKSQPCTYDKEKMCKPALATAIFSTVSFLLGAITSVLSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTGMLYPLLISSVSILVCLITTLFATDLFEIKVVKEIEPALKKQLIISTILMTVGIAIVTWIGVPSSFTIYNFGVQKVVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGHAKPDYATCVKISTDASIKEMIPPGALVMLTPLIVGTFFGVETLSGVLAGALVSGVQIAISASNTGGAWDNAKKYIEAGVSEHARTLGPKGSDPHKAAVIGDTVGDPLKDTSGPSLNILIKLMAVESLVFAPFFATHGGLLFKIF

SEQ ID NO: 4922 - protein, 766 aa, Quercus alba
MALLSELATEIVIPVCAVIGIAFSFVQFILVSRVKVTPERHAPPQSGNNNKNGYGEYLIEEEDGINDQNVVVKCAEIQNAISEGATSFLFTEYQYVGVFMVAFAILIFLFLGSVKGFSTKNQPCTYDAEKLCKPALATAIFSTVSFVLGAFTSVLSGYLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMCYPLLISSMGILVCLITTLFATDFFEIKAVKEIEPALKKQLIISTVLMTVGIAIVSWVALPSSFTIYNFGVQKVVKNWELFLCVGVGLWAGLVIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFATHGGLLFKIF

SEQ ID NO: 4923 - protein, 769 aa, Eucalyptus grandis
MALLSPLATEIAIPACALVGIVFSLVQWLLVSRVKLTPEPRAPSSSSPGSNNNKNGYGEYLIEEEDGVNDHSVVAKCAEIQSAISEGATSFLFTEYQYVGVFMVAFAVLIFLFLGSVESFSTQSQPCTYDPSKLCKPALATAVFSTVSFLLGGFTSVVSGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGIDHDFTAMCYPLLISSMGILVCLITTLFATDFFEIKVVEEIEPALKKQLIISTILMTVGIAIVSWIALPSSFTIYNFGSQKVVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASLKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKIF

SEQ ID NO: 4924 - protein, 770 aa, Euphorbia peplus
MTSALLSELGTEIIVPVCAVIGIIFSLVQWFLVSRVTLTSDRKGSGTSPAGDNKNGFNDYLIEEEEGINDHSVVAKCAEIQNAISEGATSFLFTEYQYVGVFMVAFAGLIFVFLGSVEGFSTKSQPCTYAPERTCKPALATAMFSTISFVLGAVTSVISGFLGMKIATYANARTTLEARKGVGKAFIVAFRSGAVMGFLLAANGLLVLYIIINVFRIYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLVSSVGILVCLITTLFATDFFEIKAVKEIEPALKKQLIISTILMTVGIAIVSFVALPSSFTIFNFGTQKVVKNWQLFLCVAVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGKAALAMVEEVRRQFNTIPGLMEGTTKPDYATCVKISTDASIKEMIPPGALVMLTPIIVGTFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFATHGGLLFKIFN

SEQ ID NO: 4925 - protein, 766 aa, Nicotiana tabacum
MGAPILSDLGTEILIPVCAVVGIAFSLFQWFLVSKVTLSADKSSGAADDKNGYAAESLIEEEEGINDHNVVQKCAEIQNAISEGATSFLFTEYQYVGVFMVAFAILIFLFLGSVEGFSTKNQPCTYDSTKTCKPALATAVFSTVSFLLGAVTSVVSGFLGMKIATYANARTTLEARKGVGKAFIVAFRSGAVMGFLLAANGLLVLYITILLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTVGIAVVTWIALPSTFTIFNFGAQKEVKSWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSDAHKAAVIGDTVGDPLKDTSGPSLNILIKLMAVESLVFAPFFATHGGLLFKLF

SEQ ID NO: 4926 - protein, 762 aa, Beta vulgaris
MISDLATEIFIPVCAVIGIIFSLVQWFLVSKVKVSTDRHVNNGGSAKNGFNDYLIEEEEGVNDQNVVAKCAEIQNAISEGATSFLFTEYQYVGVFMCAFAVLIFVFLGSVEGFSTESQPCTYSPLKKCKPALATALFSTVSFLLGAITSVVSGFLGMKIATDANARTTLEARKGVGKAFIIAFRSGAVMGFLLAANGLLVLYIAINLLKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMCYPLLISSMGIIVCLVTTLFATDFFEIKAVKEIEPALKKQLIISTVLMTVGIAIITWIALPSSFTIFNFGTQKVVHNWQLFLCVCVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSEPHKAAVIGDTIGDPLKDTSGPSLNILIKLMAVESLVFAPFFATHGGLLFKLF

SEQ ID NO: 4927 - protein, 768 aa, Cucumis sativus
MGATILPDLGAQIFIPLCAIVGILFSLVQWYYVSQVKLSSARDSANNNSSSAKNGYSDYLIEEEEGVNDHNVVIKCAEIQNAISEGATSFLFTEYKYVGIFMILFAALIFVFLGSVEGFSTKPQPCSYDKTKTCKPALATATFSTISFLLGAVTSVVSGFLGMKIATYANARTTLEARKGVGKAFITAFRSGAVMGFLLAANGLLVLFIAINLFKLYYGEDWGGLFESITGYGLGGSSMALFGRVGGGIYTKAADVGADLVGKVERNIPEDDPRNPAVIADNVGDNVGDIAGMGSDLFGSYAESSCAALVVASISSFGNNHEFTAMLYPLIVSSMGILVCLITTLFATDFFEIKAVKEIEPALKNQLIISTVIMTFGIAIVTWVSVPAKFTIFNFGTQKVVQNWELFLCVAVGLWAGLIIGFVTEYYTSNAYSPVQDVADSCRTGAATNVIFGLALGYKSVIIPIFAIAASIFVSFSFAAMYGIAVAALGMLSTIATGLAIDAYGPISDNAGGIAEMAGMSHRIRERTDALDAAGNTTAAIGKGFAIGSAALVSLALFGAFVSRAGVVVVDLLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGTSEHARTLGPKGSDPHKAAVIGDTIGDPLKDTSGPSLNILIKLMAVESLVFAPFFASHGGILFKIF

SEQ ID NO: 4928 - protein, 761 aa, Gossypium hirsutum
LSEMATEIVVPVCAVIGIAFSLVQWVMVSRVKLTSERHASSANSSKNGYGDYLIEEEEGINDHSVVTKCADIQNAISEGATSFLFTEYQYVGIFMIAFAILIFLFLGSVEGFSMKSQPCTYDKEKMCKPALATAIFSTVSFLLGAITSVLSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTGMLYPLLISSVSILVCLITTLFATDLFEIKVVKEIEPALKKQLIISTILMTVGIAIVTWIGVPSSFTIYNFGVQKVVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGHAKPDYATCVKISTDASIKEMIPPGALVMLTPLIVGTFFGVETLSGVLAGALVSGVQIAISASNTGGAWDNAKKYIEAGASEHAKTLGPKGSDPHKAAVIGDTVGDPLKDTSGPSLNILIKLMAVESLVFAPFFATHGGLLFKIF

SEQ ID NO: 4929 - protein, 768 aa, Cucumis melo
MGATILPDLGAQIFIPLCAIIGILFSLVQWYYVSQVKLSSARDSANNNSSSAKNGYSDYLIEEEEGVNDHNVVIKCAEIQNAISEGATSFLFTEYKYVGIFMILFAALIFVFLGSVEGFSTKPQPCSYDKTKTCKPALATATFSTISFLLGAVTSVVSGFLGMKIATYANARTTLEARKGVGKAFITAFRSGAVMGFLLAANGLLVLFIAINIFKLYYGEDWGGLFESITGYGLGGSSMALFGRVGGGIYTKAADVGADLVGKVERNIPEDDPRNPAVIADNVGDNVGDIAGMGSDLFGSYAESSCAALVVASISSFGNNHEFTAMLYPLIVSSMGILVCLVTTLFATDFFEIKAVKEIEPALKNQLIISTVIMTFGIAIVTWVGVPAKFTIFNFGTQKVVQNWELFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGVVVVDLLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGTSEHARTLGPKGSDPHKAAVIGDTIGDPLKDTSGPSLNILIKLMAVESLVFAPFFASHGGILFKIF

SEQ ID NO: 4930 - protein, 765 aa, Triphysaria pusilla
MALLTDLGTEIVIPVCAIIGIIFSLVQWFLVSKVKVTPERGGSSAAKNGKNGYSDYLIEEEDGIDDQNVVAKCAEIQNAISEGSTSFLFTMYQYVGIFMVAFAILIFLFLGSVEGFSTKSQACTYDKEKLCKPALATAIFSTAAFMLGAITSVISGFLGMKIATYANARTTLEARKGVGKAFITAFRSGAVMGFLLAANGLLVLYITINLFKIYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGTTHDFTAMCYPLLISSMGILVCLITTLFATDFFEIKAVKEIEPALKKQLIISTVLMTLGVAVVTWTCLPSSFTIFNFGTQKVVKNWQLFLCVCVGLWAGLVIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAEISKVDVLTPKVFIGLLVGAMLPYWFSAMTMKSVGSAALKMVEEVRRQFNTIPGLMEGLAKPDYATCVKISTDASLKEMIPPGALVMLTPLIVGTFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKLF

SEQ ID NO: 4931 - protein, 1175 aa, Theobroma cacao
MGEAVLSEMATEIVVPVCAVIGIAFSLVQWVLVSRVKLTSERHASGGSGSNSKNGYSDYLIEEEEGINDHSVVTKCADIQTAISEGATSFLFTEYQYVGIFMIAFAILIFLFLGSVEGFSTKSQPCTYDKEKACKPALATAIFSTVSFLLGAVTSVLSGFLGMKIATYANARTTLEARKGVGKAFIIAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGVNHEFTAMLFPLLISSVGILVCLITTLFATDFFEIKVVKEIEPALKKQLIISTVLMTVGIAIVTLIGVPSSFTIYNFGTQKDVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGHARPDYSTCVKISTDASIKEMIPPGALVMLTPLIVGTFFGVETLSGVLAGALVSGVQIAISASNTGGAWDNAKKYIEAGASEHARDLGPKGSDPHKAAVIGDTVGDPLKDTSGPSLNILIKLMAVESLVFAPFFATHGPQREGKIKSPLKYSIPQLGEANGNTIFESVHCLPQFCVKFRILRMLLFSATRPLNPPQPLPFLSFSRFVSLSLPLPILPNPSRSTHFPSLQIYSIDAAQPFDYESHLKNRYLQSTSLKIAIIGFGNFGQFLSETFIRHHHTLLAHSRTNYTNLANQLGVSFFSDPNDLFEQHPDVVLLSTSILSTETLLQQLPFQRLRRNTLFVDVLSVKEFPRNLFLKYLPPDFDILCTHPMFGPESGKNTWAGLPFVYDKVRIGDEESRVKRCEKFLDIFEKEGCRMVEMSCMEHDKYAAGSQFVTHTMGRVLEQFGLESSPINTKGYETLLNLVENTKGDSFDLYYGLFMYNQNALEQLERLDMAFESIKKELFGRLHRVYRKQLFGDKEEKERERRFAQKLLGNGGLIDPPLDNVGQDGS

SEQ ID NO: 4932 - protein, 766 aa, Castanea mollissima
MALLSELATEIVIPVCAVIGIAFSFVQFVLVSRVKVTPERHAPPQSVNNNKNGYGEYLIEEEDGINDQNVVAKCAEIQNAISEGATSFLFTEYQYVGVFMVAFAILIFLFLGSVKGFSLKNQPCTYDAEKLCKPALATAVFSTVSFVLGALTSVLSGYLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGISHDFTAMCYPLLISSMGILVCLITTLFATDFFEIKAVKEIEPALKKQLIISTVLMTVGIAIVSWVALPSSFTIYNFGVQKVVKNWELFLCVGVGLWAGLVIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGLAKPDYATCVKISTDASIKEMIPPGALVMLTPLIVGIFFGVETLSGVLAGSLVSGVQIAISASNTGGAWDNAKKYIEAGASEHARSLGPKGSDAHKAAVIGDTIGDPLKDTSGPSLNILIKLMAVESLVFAPFFATHGGLLFKIF

SEQ ID NO: 4933 - protein, 764 aa, Citrus clementina
MGSTLLSELATEILVPVCAVVGIIFSLVQWFIVSRVRLTHERPTSSNSDKKNGFNDYLIEEEEGINDQSVVAKCADIQSAISEGATSFLFTEYQYVGVFMIAFAILIFVFLGSVEGFSTKGQACTYDQQKMCKPALATAAFSTVSFLLGAITSVLSGFLGMKIATYANARTTLEARKSVGKAFIVAFRSGAVMGFLLAANGLLVLFIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTSMLYPLLISSIGILVCLITTLFATDIFEVKAVKEIEPSLKKQLIISTVLMTVGIAIVSWIGLPSSFTIYNFGAQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGITTVDVLTPKVFIGLIVGAMLPYWFSAMTMKSVGSAALKMVEEVRRQFNTIPGLMEGTTKPDYATCVKISTDASIKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGFHQLR

SEQ ID NO: 4934 - protein, 764 aa, Citrus sinensis
MGSTLLSELATEILVPVCAVVGIIFSLVQWFIVSRVRLTHERPPSSNSDKKNGFNDYLIEEEEGINDQSVVAKCADIQSAISEGATSFLFTEYQYVGVFMIAFAILIFVFLGSVEGFSTKGQACTYDQQKMCKPALATAAFSTVSFLLGAITSVLSGFLGMKIATYANARTTLEARKSVGKAFIVAFRSGAVMGFLLAANGLLVLFIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTSMLYPLLISSIGILVCLITTLFATDIFEVKAVKEIEPSLKKQLIISTVLMTVGIAIVSWIGLPSSFTIYNFGAQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGITTVDVLTPKVFIGLIVGAMLPYWFSAMTMKSVGSAALKMVEEVRRQFNTIPGLMEGTTKPDYATCVKISTDASIKEMIPPGALVMLTPLIVGIFFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGFHQLR

SEQ ID NO: 4935 - protein, 764 aa, Triphysaria pusilla
MGEGPLLSDLGTQILIPICAVVGIAFSLVQWVLVAKVKVSDGKSDADGESGFTEALISEEEGGNDLSVVRKCADIQAAISEGSTSFLFTMYQYVGIFMIAFAMLIFLFLGSVKGFSTSHQTCTYDITKMCKPALATAIFSTVAFLLGAVTSVISGFLGMKIATYANARTTLEARKGVGKAFIIAFRSGAVMGFLLAANGLLVLYITINLFKIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSVGILVCLLTTLFATDFFEVKAVKEIEPALKNQLIISTILMTIGIAVVSWVALPSTFTIFNFGVQKDVKNWQLFLCVAVGLWAGLIIGFITEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHTIRERTDALDAAGNTTAAIGKGFAIGSAALVSLALFGAFVSRADITTVDVLTPKVFIGLLVGAMLPYWFSAMTMKSVGSAALKMVEEVRRQFNTIPGLMEGTAKPDYATCVKISTDASLKEMIPPGALVMLTPLIVGIFFGVETLSGVLAGSLVSGVQIAISASNTGGAWDNAKKYIEAGASEHARTLGPKGSDAHKAAVIGDTVGDPLKDTSGPSLNILIKLMAVESLVFAPFFAAHGGLLFKIF

SEQ ID NO: 4936 - protein, 765 aa, Orobanche aegyptiaca
MDEATLLPDLGTLIIIPICAVIGISFALVQWLVVAKVKVADGNSSSADGKSGFTEALISEEEGITDHSVVRKCADIQSAISEGATSFLFTMYQYVGIFMVAFAMLIFLFLGSVKGFSTSHQPCTYDRTKMCKPALATAIFSTLSFLLGAVTSVVSGFLGMKIATYANARTTLEARKGVGKAFIVAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDLTAMLYPLLVSSVGILVCLLTTLFATDFFEVKAVNEIEPALKKQLIISTILMTIGLAIVSWIALPSSFTIFNFGVQKEVKSWQLFLCVAVGLWAGLIIGFVTEYYTSNAYSPVQDVADSCRTGAATNIIFGLALGYKSVIIPIFAIAISIFVSFSFAAMYGIAVAALGMLSTIATGLAIDAYGPISDNAGGIAEMAGMSHTIRERTDALDAAGNTTAAIGKGFAIGSAALVSLALFGAFVSRADITTVDVLTPKVFIGLIVGAMLPYWFSAMTMKSVGSAALKMVEEVRRQFNTIPGLMEGTTKPDYATCVKISTDASIKEMIPPGALVMLTPLIVGVFFGVETLSGVLAGSLVSGVQIAISASNTGGAWDNAKKYIEAGASEHARILGPKGSDAHKAAVIGDTVGDPLKDTSGPSLNILIKLMAVESLVFAPFFAAHGGLLFKIF

SEQ ID NO: 4937 - protein, 759 aa, Silene vulgaris
MGSVLLPDLVTLIFIPVSAVIGIAFSLFQWYLVSTVKLSASPSSNNGVSDSLIEEEEGLNDHSVVAKCAEIQTAISEGSTSFLFTMYQYVGVFMVAFAVLIFVFLGSVEGFSTSSQPCTYDKTRRCKPALATAIFSTVSFLLGAITSLASGFLGMKIATYANARTTLEARKGVGKAFIVAFRSGAVMGFLLAANGLLVLYGTILLFKIYYGDDWEGLFESITGYGLGGSSMALFGRVGGGIYTKAADVGADLVGKIERNIPEDDPRNPAVIADNVGDNVGDIAGMGSDLFGSFAESSCAALVVASISSFGNNHQFTAMLYPLLISAVGIIMCLITTLFATDFFEIKAVKEIEPALKRQLVISTVLMTIGVAAVSFTALPSSFTIFDFGTQKEVKNWELFLCVAVGLWAGLIIGFVTEYYTSNAYSPVQDVADSCKTGAATNVIFGLALGYKSVIIPIFAIAISIFVSFSLAAMYGIAVAALGMLSTIATGLAIDAYGPISDNAGGIAEMAGMSHTIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGASEHARSLGPKGSDAHKAAVIGDTVGDPLKDTSGPSLNILIKLMAVESLVFAPFFATHGGLLFKL

SEQ ID NO: 4938 - protein, 766 aa, Helianthus annuus
MAPTVLSTFATEIIIPVCAVIGIAFSLIQWFLVSRVKMTPDRNANNNNNSNKNGYDDYLIEEEEGLNDHNVVVKCAEIQNAISEGATSFLFTEYQYVSIFMVVFAILIFLFLGSVEGFSTKSQKCTYNVHQMCKPALATAAFSTIAFLLGAITSLISGFLGMKIATYANARTTLEARKGVGKAFITAFRSGAVMGFLLAANGLLVLYIAINLFKLYYGDDWEGLFEAITGYGLGGSSMALFGRVGGGIYTKAADVGADLVGKIERNIPEDDPRNPAVIADNVGDNVGDIAGMGSDLFGSYAESSCAALVVASISSFGIEHDFTAMCYPLLVSSVGIIVCLITTLFATDFFEIKVVDEIQSALKKQLIISTVLMTVGIAIVSFIGLPTSFTIFNFGVQKVVYNWQLFLCVCVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGLAKPDYTTCVKISTDASIKEMIPPGALVILTPLIVGTFFGVETLSGVLAGALVSGVQVAISASNTGGAWDNAKKYIEAGASEHARTLGPKGSEPHKAAVIGDTIGDPLKDTSGPSLNILIKLMAVESLVFAPFFAAHGGLLFKL

SEQ ID NO: 4939 - protein, 769 aa, Mimulus guttatus
MALLSEQGTEIVIPVCAVIGIIFSLVQWYIVSKVKVSPERSGAAASPAANNGKNGGYNDYLIEEEDGIDDQNVVAKCAEIQNAISEGATSFLYTEYQYVGIFMIAFAILIFLFLGSVEGFSTKNQPCTYNKETLCKPALATAVFSTASFLLGAVTSVISGFLGMKIATYANARTTLEARKGVGKAFIVAFRSGAVMGFLLAANGLLVLYITINLFKIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGLTHDFTAMCYPLLISSMGILVCLITTLFATDFFEIKAVKEIEPALKKQLIISTVLMTVGVAIVTWTCLPSSFTIFNFGAQKVVKNWELFLCVCVGLWAGLIIGFVTEYYTSNAYSPVQDVADSCRTGAATNVIFGLALGYKSVIIPIFAIAVSIFVSFTFAAMYGIAVAALGMLSTIATGLAIDAYGPISDNAGGIAEMAGMSHRIRERTDALDAAGNTTAAIGKGFAIGSAALVSLALFGAFVSRAEIKTVDVLTPKVFIGLIVGAMLPYWFSAMTMKSVGSAALKMVEEVRRQFNTIPGIMEGTAKPDYARCVKISTDASIKEMIPPGCLVMLTPLIVGTFFGVETLAGVLAGALVSGVQVAISASNTGGAWDNAKKYIEAGASEHARTLGPKGSEPHKAAVIGDTIGDPLKDTSGPSLNILIKLMAVESLVFAPFFATHGGLLFKLF

SEQ ID NO: 4940 - protein, 764 aa, Mimulus guttatus
MALLSDLGTEIVIPVCAVIGIAFSLFQWYLVSRVKVKPDHGGEPAAKNGKNGYGDYLIDEEESINDQNVVAKCAEIQNAISEGATSFLFTEYQYVGIFMVAFAVLIFLFLGSVEGFSTKSQACTYNKDKLCKPALATALFSTISFVLGAITSVLSGFFGMKIATYANARTTLEARKGVGKAFIVAFRSGAVMGFLLAANGLLVLYITINVFKIYYGEDWEGLFEAITGYGLGGSSMALFGRVGGGIYTKAADVGADLVGKVERNIPEDDPRNPAVIADNVGDNVGDIAGMGSDLFGSYAEASCAALVVASISSFGLTHDFTAMCYPLLISSMGILVCLITTLFATDFFEIKAVKEIEPALKKQLIISTILMTVGIAIVTWTCLPSSFTIFNFGAQKVVKNWELFLCVCVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAGITKVDVLTPKVFIGLLVGAMLPYWFSAMTMKSVGSAALKMVEEVRRQFNEIPGLMEGTAKPDYATCVKISTDASLREMIPPGALVMLTPLIVGTFFGVETLSGVLAGSLISGVQIAISASNTGGAWDNAKKYIEAGASEHARTLGPKGSEPHKAAVIGDTIGDPLKDTSGPSLNILIKLMAVESLVFAPFFATHGGLLFKL

SEQ ID NO: 4941 - protein, 770 aa, Oryza sativa
MAAAAILPELAAQVVIPVAAAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 4942 - protein, 764 aa, Helianthus annuus
MTSATILSDLGTEILIPICAVIGILFSLFQWYLVSQVKLVAEKPDADGKNGFTESLIEEEEGVNDHTVVQKCAEIQNAISEGATSFLFTEYQYVGVFMVIFAVLIFVFLGSVEGFSTSNKTCTYDATKMCKPALMTAVFSTVSFLLGAITSVVSGFLGMKIATYANARTTLEARKGVSKAFIVAFRSGAVMGFLLAANGLLVLYITINLFKIYYGDDWEGLFESITGYGLGGSSMALFGRVGGGIYTKAADVGADLVGKIERNIPEDDPRNPAVIADNVGDNVGDIAGMGSDLFGSYAESSCAALVVASISSFGNTHDFTSMMYPLTVSSVGIIVCLITTLFATDFFEVKTVKQIEPSLKNQLIISTVLMTIGIAIVSWIALPSSFTIFNFGTQKVVKNWQLFLCVCVGLWAGLVIGFVTEYYTSNAYSPVQDVADSCRTGAATNVIFGLALGYKSVIIPIFAIAISIFVSFTFAAMYGVAVAALGMLSTIATGLAIDAYGPISDNAGGIAEMAGMSHRIRERTDALDAAGNTTAAIGKGFAIGSAALVSLALFGAFVSRAEITTVDVLTPKVFIGLLVGAMLPYWFSAMTMKSVGKAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGVSEHAKSLGPKGSDPHKAAVIGDTIGDPLKDTSGPSLNILIKLMAVESLVFAPFFATHGGLLFKLF

SEQ ID NO: 4943 - protein, 476 aa, Tropaeolum majus
MGSDLFGSYAESSCAALVVASISSFGIDHDFTAMCYPLLISSMGIIVCLITTLFATDFSEIKAVKEIEPALKKQLIISTLLMTVGIAVVSWVSLPESFTIFNFGTQKVVKNWHLFLCVGVGLWAGLIIGFVTEYYTSNAYSPVQDVADSCRTGAATNVIFGLALGYKSVIIPIFAIAVSIFVSFSLAAMYGVAVAALGMLSTIATGLAIDAYGPISDNAGGIAEMAGMSHRIRERTDALDAAGNTTAAIGKGFAIGSAALVSLALFGAFVSRAAISKVDVLTPKVIIGLLVGAMLPYWFSAMTMKSVGSAALKMVEEVRRQFNTIPGLMEGLAKPDYATCVKISTDASIKEMIPPGALVMLTPLIVGIFFGVETLAGVLAGSLVSGVQIAISASNTGGAWDNAKKYIEAGVSEHARSLGPKGSDPHKAAVIGDTIGDPLKDTSGPSLNILIKLMAVESLVFAPFFATHGGLLFKIF

SEQ ID NO: 4944 - protein, 767 aa, Distylium racemosum
MVEAMLSSMLTEILIPVAAVVGIIFALVQWVLVSRVKMVPGHANGANNNNSSKNGYTEYLIEEEEGVNDNNVVNKCAEIQNAISEGATSFLFTEYQYMGIFMVCFAVIIFLFLGSVEKFSTKSQPCTYNKEVMCKPALANAIFSTVSFLLGSLTSAMSGYLGMKIATYANARTTLEARKGVGKAFITAFRSGAVMGFLLAANGLLVLYITINVFKVYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGVNHEFTAMCYPLLISSMGIIVCLITTLFATDIFEIKAVKEIEPSLKKQLIISTVLMTIGIAVVSFVALPSSFTIFNFGEQKVVKNWELFFCVAVGLWAGLVIGFVTEYYTSNAYSPVQDVADSCRTGAATNVIFGLALGYKSVIIPIFAIAVSIFVSFSLAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFSTIPGLMEGLAKPDYATCVKISTDASLKEMIPPGCLVMLTPLIVGTFFGVETLSGVLAGALVSGVQVAISASNTGGAWDNAKKYIEAGVSEHARSLGPKGSDPHKAAVIGDTIGDPLKDTSGPSLNILIKLMAVESLVFAPFFATHGGLLFKL

SEQ ID NO: 4945 - protein, 759 aa, Taxus baccata
MLTEILIPVAAGVGIVFALVQWLIVSRVKVTPGHANGSNNGSNNKNGYSEYLIEEEDGGNDHSVVTKCAEIQSAISEGATSFLFTEYQYMGIFMIFFAVVIFLFLGSVEKFSTKSQPCTYNKEMMCKPALANAIFSTISFLLGSLTSVLSGYLGMKIATYANARTTLEARKGVGKAFITAFRSGAVMGFLLAANGLLVLYIAINLFKMYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGTSHDFTAMCYPLLISSMGIIVCLITTLFATDIFEIKAVKEIEPALKKQLIISTVLMTIGIAVVSLVALPPSFTIFNFGEQKVVKNWQLFFCVAVGLWAGLVIGFVTEYYTSNAYSPVQDVADSCRTGAATNVIFGLALGYKSVIIPIFAIAISIFVSFSLAAMYGIAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEGTAKPDYATCVKISTDASLKEMIPPGCLVMLTPLIVGTLFGVETLSGVLAGALVSGVQVAISASNTGGAWDNAKKYIEAGASEHARTLGPKGSDPHKAAVIGDTIGDPLKDTSGPSLNILIKLMAVESLVFAPFFATHGGLLFKL

SEQ ID NO: 4946 - protein, 765 aa, Helianthus annuus
MVTSPILSELGTEILIPICAVIGIIFSLFQWYLVSQVKLTVEKPAAGDGKNGFTEALIEEEEGVNDHAVVQKCAEIQNAISEGATSFLFTEYQYVGIFMVIFAVLIFVFLGSVEGFSTSSKICTYDATRMCKPALMTAVFSTVSFVLGAITSVVSGFLGMKIATYANARTTLEARKGVSKAFIVAFRSGAVMGFLLAANGLLVLYITINLFKIYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGNTHDFTSMMYPLTVSSVGILVCLITTLFATDFFEVKTVEQIEPSLKNQLIISTVLMTIGIAIVSWIALPSSFTIFNFGAQKVVKNWQLFLCVGVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAEITTVDVLTPKVFIGLLVGAMLPYWFSAMTMKSVGKAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGVSEHAKSLGPKGSDPHKAAVIGDTVGDPLKDTSGPSLNILIKLMAVESLVFAPFFATHGGLLFKLF

SEQ ID NO: 4947 - protein, 765 aa, Beta vulgaris
MGAALLPDLITEIIIPVCAVIGIAFSLFQWYIVSQVKLSPDSTRNNNNKNGFSDSLIEEEEGLNDQSVVAKCAEIQNAISEGATSFLFTEYQYVGIFMVAFAVLIFLFLGSVEGFSTSSQECTYDKTRRCKPALATAIFSTVAFLLGAITSLGSGFFGMKIATYANARTTLEARKGVGKAFIVAFRSGAVMGFLLAANGLLVLYITILLFKIYYGDDWEGLFEAITGYGLGGSSMALFGRVAGGIYTKAADVGADLVGKVERDIPEDDPRNPAVIADNVGDNVGDIAGYGVLIFLDSYAESSCAALVVRSISSFGISHDLTAMMYPLLVSSVGIIVCLITTLFATDFFEIKAVKEIEPALKKQLIISTALMTVGVAVISWIALPTSFTIFDFGSQKEVQNWQLFLCVAVGLWAGLIIGFVTEYYTSNAYSPVQDVADSCRTGAATNVIFGLALGYKSVIIPIFAIAISIFVSFSFAAMYGIAMAALGMLSTIATGLAIDAYGPISDNAGGIAEMAGMSHRIRERTDALDAAGNTTAAIGKGFAIGSAALVSLALFGAFVSRASIQTVDVLTPKVFIGLIVGAMLPYWFSAMTMKSVGSAALKMVEEVPKQFNTIPGLLEGTAKPDYATCVKISTDASIKEMIPPGALVMLTPLIVGTFFGVETLSGVLAGSLVSGVQIAISASNTGGAWDNAKKYIEAGASEHARTLGPKGSDAHKAAVIGDTIGDPLKDTSGPSLNILIKLMAVESLVFAPFFATHGGLLFKYL

SEQ ID NO: 4948 - protein, 761 aa, Plantago ovata
MVELTLLPDLATQIIIPACAVVGIIFALVQWQLVAKVKVSADKSPGNNGLVESLIEEDGVDDHEVVAKCAEIQNAISEGSTSFLFTEYQYVGIFMVAFAILIFVFLGSVEGFSTKPQTCTYDTTKMCKPALATAIFSTVSFILGAVTSVISGFLGMKIATYANARTTLEARKGVGKAFIVAFRSGAVMGFLLAANGLLVLYITINLFKIYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGINHEFTAMLYPLLVSSVGILVCLLTTLFATDFFEIKDVKEIEPALKNQLIISTVLMTVGIAIVSWIALPSSFTIFNFGVQKEVKNWQLFLCVAVGLWAGLIIGFVTEYFTSNAYRPVQDVADSCRTGAATNIIFGLALGYQSVIIPIFAIAISIFVSFTFAAMYGIAVAALGMLSTIATGLAIDAYGPISDNAGGIAEMAGMSHTIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTGKPDYATCVKISTDASIKEMIPPGALVMLTPLIVGVFFGVETLSGILAGSLVSGVQIAISASNTGGAWDNAKKYIEAGASEHAQTLGPKGSDAHKAAVIGDTVGDPLKDTSGPSLNILIKLMAVESLVFAPFFAAHGGLLFKIF

SEQ ID NO: 4949 - protein, 763 aa, Silene vulgaris
MVVTAGILPDLATEIIIPVCAVIGIAFSLFQWYLVSTVKLSPSTTHKNGVSDSLIEEEDGGNDHSVVAKCAEIQNAISEGSTSFLFTMYQYVGIFMIAFAVLIFLFLGSVEGFSTKSQACRYDKTKSCKPALATAIFSTVSFLLGAVTSLASGFLGMKIATYANARTTLEARKGVGKAFIVAFRSGAVMGFLLAANGLLVLYATILLFKIYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHELTAMMYPLLVSSVGIVMCLITTLFATDFFEIKAVKEIEPALKRQLIISTVLMTIGVAAVSFTALPSSFTIFDFGKQKEVKNWELFLCVAVGLWAGLIIGFVTEYYTSNAYSPVQDVADSCKTGAATNVIFGLALGYKSVIIPIFAIAVSIYVSFSFAAMYGIAVAALGMLSTIATGLAIDAYGPISDNAGGIAEMAGMSHTIRERTDALDAAGNTTAAIGKGFAIGSAALVSLALFGAYVSRASITTVDVLTPKVFIGLIVGAMLPYWFSAMTMKSVGKAALKMVEEVRRQFNTIPGLMEGTAKPDYATCVKISTDASIKEMVPPGALVMLTPLIVGILFGVETLSGVLAGSLVSGVQIAISASNTGGAWDNAKKYIEAGASEHARSLGPKGSDAHKAAVIGDTVGDPLKDTSGPSLNILIKLMAVESLVFAPFFATHGGLLFKLYR

SEQ ID NO: 4950 - protein, 771 aa, Oryza sativa
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 4951 - protein, 771 aa, Thellungiella halophila
MVASAFLPELWTEILVPVCAVIGIAFSLFQWFIVSRVRVTADQGASSSSGGSNNGKNGYGDYLIEEEEGLNEQSVVAKCAEIQTAISEGATSFLFTEYKYVGVFMVFFAAIIFVFLGSVEGFSTKNKPCTYDDTKTCKPALATAAFSTVAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMLYPLLISSMGILVCLITTLFATDFFEIKAVKEIEPALKNQLIISTVIMTVGIAIVSWVGLPSSFTIFNFGTQKVVKNWQLFLCVCVGLWAGLIIGFVTEYYTSNAYSPVQDVADSCRTGAATNVIFGLALGYKSVIIPIFAIAASIFVSFSFAAMYGVAVAALGMLSTIATGLAIDAYGPISDNAGGIAEMAGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 4952 - protein, 771 aa, Zea mays
MASSAFLPELGTQVVVPVAAVVGIAFAVLQWVLVSKVKLSPEPRRGDGSAGKSGAGAGASEYLIEEEEGLNEHNVVVKYAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIFNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEGITKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 4953 - protein, 818 aa, Zea mays
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTVLMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKGHLGPVPQHPDQAHGGGVPCVCPLLRHPRWPAVQVPVRATPIITAEIYDRPTVDISNNSCQIASSCVLCASRLAALLFFWSHCSYFLLGPSP

SEQ ID NO: 4954 - protein, 766 aa, Sorghum bicolor
MAAAAILPELATQVLIPVAAAVGIAFAVVQWVLVSKVRLTPERRADGGAAKSGPSDYLIEEEEGLNDHNVVVKCAEIQNAISEGATSFLFTEYKYVGLFMGIFAILIFLFLGSVEGFSTKSQPCHYSKGKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLVTTLFATDFFEIKAVSEIEPALKKQLIISTVVMTIGIALISWLGLPYTFTIFNFGEQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDSAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGASEHARTLGPKGSDPHKAAVIGDTIGDPLKDTSGPSLNILIKLMAVESLVFAPFFAAHGGILFKWL

SEQ ID NO: 4955 - protein, 770 aa, Arabidopsis lyrata
MVAPALLPELWTEILVPICAVIGIAFSLFQWYVVSRVKLTTDLGASSSGGANNGKNGYGDYLIEEEEGVNDQSVVAKCAEIQTAISEGATSFLFTEYKYVGVFMIFFAAVIFVFLGSVEGFSTDSKPCTYDTTRTCKPALATAGFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKVVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 4956 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 4957 - protein, 647 aa, Chelidonium majus
FSLVQWYIVSQVKLSPERHTPSNNSKNGYNDSLIEEEEGLNDHNVVLKCAEIQQAISEGATSFLYTEYQYVGIFMVAFAAIIFLFLGSVESFSTKSQPCTYNKHAMCKSALANAGFSTISFVLGAVTSVVSGFLGMKIATYANARTTLEARKGVGKAFITAFRSGAVMGFLLAANGLLVLYITINVFKIYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGINHEFTAMCYPLIISSVGIIVCLITTLFATDIFEIKAVKEIEPALKNQLIISTALMTVGIALVSWVALPAEFTIFNFGAQKVVKNWELFFCVAIGLWAGLVIGFVTEYYTSNAYSPVQDVADSCRTGAATNVIFGLALGYKSVIIPIFAIALSIFVSFSLAAMYGIAVAALGMLSTIATGLAIDAYGPISDNAGGIAEMAGMSHRIRERTDALDAAGNTTAAIGKGFAIGSAALVSLALFGAFVSRAAIKTVDVLTPKVFIGLLVGAMLPYWFSAMTMKSVGSAALKMVEEVRRQFNTIPGLMEGTAKPDYATCVKISTDASIKEMIAPGALVMLTPSLLVPSLVLRLYLVSLLVP

SEQ ID NO: 4958 - protein, 762 aa, Zea mays
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTVLMTFGIALISWLALPAKFTIYNFGTQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKYL

SEQ ID NO: 4959 - protein, 766 aa, Zea mays
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 4960 - protein, 767 aa, Zea mays
MAAAAILPELGTQVLIPVAAAVGIAFSVLQWVLVSKVRLAPERRADGGGAVKSGPSDYLIEEEEGLNDHNVVVKCAEIQNAISEGATSFLFTEYKYVGLFMGIFAILIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHQFTPMVYPLLVSSVGIIACLITTLFATDFFEIKAVNEIEPALKKQLIISTVVMTIGIALISWLGLPYTFTIYNFGAQKTVQSWQLFLCVAVGLWAGLVIGFITEYYTSNAYSPVQVVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLAGVLAGALVSGVQIAISASNTGGAWDNAKKYIEAGASEHARTLGPKGSDPHKAAVIGDTIGDPLKDTSGPSLNILIKLMAVESLVFAPFFAAHGGIIFKWL

SEQ ID NO: 4961 - protein, 606 aa, Brassica rapa
  misc_feature (243)..(243): Xaa can be any naturally occurring amino acid
MKIATYANARTTLEARKGVGKAFIVAFRSGAVMGFLLAASGLLVLYVTINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKAVKEIEPALKNQLIISTAIMTVGIAVVSWVGLPSSFTIFNFGTQKVVQNWXLFLCVCVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 4962 - protein, 762 aa, Mimulus guttatus
MAESTLLTDLGTQIIIPVCALVGIAFALLQWYFVAKVKVSSEKSDAKNGFSEPLIEEEDGVSDHAVVRKCAEIQAAISEGSTSFLYTEYKYVGIFMVAFAVVIFVFLGSVEGFSTKPQTCTYDATKLCKPALATAAFSTISFILGAVTSVISGFLGMKIATYANARTTLEARKGVGKAFIVAFRSGAVMGFLLAANGLLVLYIVINLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGINHEFTAMLYPLLVSSVGIIVCLLTTLFATDFFEVKEVDQIEPALKKQLVISTVLMTVGIALVSWIALPSSFTIFNFGVQKEVKSWQLFLCVAVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSAVIRERTDALDAAGNTTAAIGKGFAIGSAALVSLALFGAFVSRAAISKVDVLTPKVFIGLLVGAMLPYWFSAMTMKSVGSAALKMVEEVRRQFNTMPGIMLGTQKPDYATCVKISTDASIKEMIAPGALVMLTPLIVGVFFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 4963 - protein, 568 aa, Pennisetum glaucum
MASPAFLPELATQVIVPVAAVVGIAFAVLQWVLVSKVKLSPEPRRGDGSSGKAGAGASEYLIEEEEGLNEHNVVVKCAEIQNAISEGATSFLFTEYKYVGLFMSIFAVLIFLFLGSVEGFSTKSQPCHYSKGKMCKPALANALFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLVSSVGIIACLITTLFATDIFEIKAVDEIEPALKKQLIISTAVMTVGIALVSWLGLPSTFTIFNFGVQKTVYNWQLFLCVAVGLWAGLVIGFVTEYYTSNAYGPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGALSAVLRS

SEQ ID NO: 4964 - protein, 765 aa, Mimulus guttatus
MAEATLLSDLGTQIIIPICALVGIVFALVQWMLVAKVKISTGKSNSADGNNGFTEALIEEEEGISEHSVIRKCADIQAAISEGSTSFLFTMYQYVGIFMVAFALLIFLFLGSVKGFSTSHQPCAYDSTKMCKPALATAVFSTVAFLLGAVTSVISGFLGMKIATYANARTTLEARKGVGKAFIVAFRSGAVMGFLLAANGLLVLFITINLFKLYYGDDWEGLFEAITGYGLGGSSMALFGRVGGGIYTKAADVGADLVGKVEQNIPEDDPRNPAVIADNVGDNVGDIAGMGSDLFGSYAEASCAALVVASISSFGINHNFTAMLFPLLVSSVGILVCLLTTLFATDFFEVKAVNEIEPALKKQLIISTILMTAGIAFVSWIALPSSFTIFNFGVQKEVQSWQLFLCVAVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMARMSHTIRERTDALDAAGNTTAAIGKGFAIGSAALVSLALFGAFVSRADITTVDVLTPKVFIGLIVGAMLPYWFSAMTMKSVGKAALKMVEEVRRQFNTIVGIMDGSGKPDYATCVKISTDASIKEMIPPGALVMLTPLIVGIFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFAAHGGLLFKIF

SEQ ID NO: 4965 - protein, 773 aa, Brachypodium distachyon
MVLSELATQLVVPVAAVVGIAFAVLQWVLVSKVKVTPERRDGEGASSGAAAGAGKNGAAAGSEYLIEEEEGLNDHNVVVKCAEIQTAISEGATSFLFTEYKYAGGFMAIFAVLIFLFLGSIEGFSTKDQACHYSKGKTCKPALANALFSTIAFVLGAITSLVSGFLGMKIATYANARTTLEARKGVGKAFITAFRSGAVMGFLLAASGLFVLYVAINVFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKAVDEIEPALKKQLIISTALMTVGIALVSWLGLPSTFTIFNFGAQKTVHNWQLFLCVSVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTFFGVETLSGVLAGALVSGVQIAISASNTGGAWDNAKKYIEAGASEHARTLGPKGSDCHKAAVIGDTIGDPLKDTSGPSLNILIKLMAVESLVFAPFFATYGGILFKWL

SEQ ID NO: 4966 - protein, 771 aa, Hordeum vulgare
MVAAAILPELATQLVVPVAAAVGIAFAVLQWVLVSKVKVAPEPRAEGGSASAVGAKDGATEYLIEEEEGLNDHNVVLKCAEIQTAISEGATSFLFTEYKYAGGFMTIFAVLIFVFLGSIEGFSTKSQPCHYSVGKTCKPALANAAFSTIAFVLGAVTSLVSGFLGMKIATYANARTTLEARKGVGKAFITAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKEVDQIEPALKRQLIISTAVMTIGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKIL

SEQ ID NO: 4967 - protein, 763 aa, Avena sativa
MAASVILPDLATQVVVPVAAAIGIAFAVLQWVLVSKVKVTPERGSAGKDGASEALIEEEEGLNDHNVVLKCAEIQTAISEGATSFLYTEYKYAGAFMAFFAVLIFVFLGSIEGFSTKSQPCHYSVGKYCKPALANAVFSTIAFVLGAVTSLVSGFLGMKIATYANARTTLEARKGVGKAFIVAFRSGAVMGFLLAASGLFVLYLIINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKAVDQIEPSLKKQLIISTAVMTIGIALVSWLGLPYTFTIFNFGAQKTVHNWQLFLCVSVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITSVDVLTPNVFIGLLVGAMLPYWFSAMTMKSVGSAALKMVEEVRRQFNTIPGLMEGTAKPDYATCVKISTDASIKEMIPPGALVMLTPLIVGTIFGVETLSGVLAGALVSGVQIAISASNTGGAWDNAKKYIEAGVSDHAKSLGPKGSDCHKAAVIGDTIGDPLKDTSGPSLNILIKLMAVESLVFAPFFATYGGILFKYI

SEQ ID NO: 4968 - protein, 554 aa, Setaria italica
MAILSPLATEVFIPIAGIIGIAFAVVQWVIVSRVKLSPAAAASGGSKNGYGDYLIEEEEGLNDHNVVVKCAEIQSAISEGATSFLFTEYQYVGIFMSIFAVVIFLFLGSVEGFSTKSQPCTYSKGKYCKPALFTALFSTASFLLGAITSLVSGFLGMKIATYANARTTLEARKGVGKAFIVAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLLTTLFATDFFEIKAVKEIEPALKKQLIISTALMTVGIAIISWLALPAKFTIFNFGAQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDAPLLLLERDLPLDQLLLCPWPFLVPLSAELE

SEQ ID NO: 4969 - protein, 635 aa, Hordeum vulgare
MVAAAILPELATQLVVPVAAAVGIAFAVLQWVLVSKVKVAPEPRAEGGSASAVGAKDGATEYLIEEEEGLNDHNVVLKCAEIQTAISEGATSFLFTEYKYAGGFMTIFAVLIFVFLGSIEGFSTKSQPCHYSVGKTCKPALANAAFSTIAFVLGAVTSLVSGFLGMKIATYANARTTLEARKGVGKAFITAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKEVDQIEPALKRQLIISTAVMTIGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEECGGSSTPSLGSWRAPPSPTMRHV

SEQ ID NO: 4970 - protein, 775 aa, Triticum aestivum
MVAAAILPELATQLVVPVAAAVGIAFAVLQWVLVSKVKVAPEPRGEGGSAAGGGAGAGAKDGASEYLIEEEEGLNDHNVVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFIVAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINREFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 4971 - protein, 726 aa, Plantago ovata
SDGSAATKNGKNGYNARLIEEEDGVADEDVVGKCAEIQNAISEGATSFLFTMYQYVGIFMVAFAILIFLFLGSVEGFSTKSQPCTYAKENMCKPAIATALFSTVAFVLGAVTSVISGFLGMKIATYANARTTLEARKGVGKAFITAFRSGAVMGFLLAANGLLVLYVTINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGTSHDFTAMLYPLLISSVGILVCLITTLFATDFFEVKAVKEIEPALKNQLIISTVLMTVGIAIVTWTCLPSSFTIFNFGTQKVVKNWQLFLCVCVGLWAGLVIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHTIRERTDALDAAGNTTAAIGKGFAIGSAALVSLALFGAFVSRAGIVTVDVLTPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGSLVSGVQIAISASNTGGAWDNAKKYIEAGASAHAKSLGPKGSDPHKAAVIGDTIGDPLKDTSGPSLNILIKLMAVESLVFAPFFATHGGLLFKLF

SEQ ID NO: 4972 - protein, 764 aa, Zostera marina
MEGTLLSELVMEILIPLVAICGIAFSLLQWFIVSQVKMTSIAVHHPDPHHTHSDRLIEEGEDMNDHGVVARCAEIQTAISEGATSFLFTEYKFAGLFMSGFAVLIFLFLGSVEGFSTKEQPCTYKKDTYCKPALANAVFSTVAFILGAATSLFSGFFGMKIATYANARTTLEARKGVGKAFITAFRSGAVMGFLLASSGLLVLYITILLFKLYYGDDWEGLFEAITGYGLGGSSMALFGRVGGGIYTKAADVGADLVGKVEKNIPEDDPRNPAVIADNVGDNVGDIAGMGSDLFGSYAESSCAALVVASISSFGINHDLTAMCFPLLISSMGIIVCLITTLFATDFFEIKEEKEIEPALKKQLIISTVLMTIGIAIITWIALPSSFTIFNFGEQKIVKNWQLFFCVAIGLWAGLIIGFVTEYYTSNAYSPVQDVADSCRTGAATNVIFGLALGYKSVIIPIFAIAVSIYVSFSLAAMYGVAVAALGMLSTIATGLAIDAYGPISDNAGGIAEMACMSHRIRERTDALDAAGNTTAAIGKGFAIGSAALVSLALFGAFVSRAAITTVDVLTPEVIIGLLIGAMLPYWFSAMTMKSVGSAALKMVEEVRRQFNTIPGLMEGTSKPDYATCVKISTDASIKEMIPPGALVMLTPLIVGIFFGVDTLAGVLAGALVSGVQIAISASNSGGAWDNAKKYIEAGTSRHAKELGPKGSEPHKAAVIGDTIGDPLKDTSGPSLNILIKLMAVESLVFAPFFAAHGGLLFKLF

SEQ ID NO: 4973 - protein, 762 aa, Podocarpus macrophillus
MGTPMLSEMLTEILIPVSAVIGIGFALLQWVLVSRVKVTPSSATSNNGYNELLLEETDEEEGDGRIAVTKCAEIQHAISVGATSFLFTEYKYLGIFMVGFGGLIFLFLGSVEGFSTKSQPCTYQKEKMCKPALANALFSTVAFLLGALTSVLSGFLGMKIATYANARTTLEARKGVGKAFITAFRSGAVMGFLLAANGLLVLYISINVFKIYYGDDWEGLFEAITGYGLGGSSMALFGRVGGGIYTKAADVGADLVGKIEQNIPEDDPRNPAVIADNVGDNVGDIAGMGSDLFGSYAEASCAALVVASISSFGNSHDFTSMCYPLLISSMGIVVCLITTLFATDIFEIKAVKEIEPSLKKQLIISTVLMTIGIAVVSFIGLPSTFTIYNFGSAKVVKNWQLFFCVAVGLWAGLVIGYVTEYYTSNAYSPVQEVAQSCKTGAATNVIFGLALGYKSVIIPIFAIAIAIFVSFSLAAMYGIAVAALGMLSTIATGLAIDAYGPISDNAGGIAEMAGMSHKIRERTDALDAAGNTTAAIGKGFAIGSAALVSLALFGAFVSRAAITKVDVLTPKVFIGLIVGAMLPYWFSAMTMKSVGSAALKMVEEVRRQFRNIPGLMEGTAKPDYATCVKISTDASLKEMIPPGALVMLTPLIVGILFGVETLSGVLAGALVSGVQVAISASNTGGAWDNAKKYIEAGASKVARDLGPKGSDAHKAAVIGDTIGDPLKDTSGPSLNILIKLMAVESLVFAPFFAAHGGILFKL

SEQ ID NO: 4974 - protein, 533 aa, Pennisetum glaucum
MALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEIKAVKEIEPALKKQLIISTALMTVGIAIISWLALPAKFTIFNFGAQKEVSNWGLFFCVSIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTGKPDYATCVKISTDASIKEMIPPGALVMLTPLIVGTLFGVETLSGVLAGALVADCHLCFQHWAKKYIEAGASDHAKSLGPKGSDCHKAAVIGDTIGDPLKDTSGPSLNILIKLMAVESLVFAPFFATHGGLISTPSAAEVYTDPWTS

SEQ ID NO: 4975 - protein, 757 aa, Populus trichocarpa
MGMLSEGLTQVLIPVAALIGIIFALLQWYLVSKVKVSGDSSNGLSDKLIEDEEDGVDNREASIKCAEIQNAISVGATSFLFTQYKYLSVFMCVFAAIIFLFLGSVKGFSTKSEPCTYNKGSLCKPALANAAFSTVAFLLGALTSVLSGFLGMKIATYANARTTLEARKGVGKAFVTAFRSGAVMGFLLAANGLLVLYISILLFKLYYGDDWEGLYESITGYGLGGSSMALFGRVGGGIYTKAADVGADLVGKVELNIPEDDPRNPAVIADNVGDNVGDIAGMGSDLFGSYAESSCAALFVASISSFGINHDHTAMSFPLIISSVGIVVCLITTLFATDLFKIKDVSEIEPSLKRQLVVSTILMTVGIAMVSFFALPSEFTIFNFGTEKVVKNWHLFFCVAIGLWAGLVIGYTTEYYTSNAYSPVQDVADSCRTGAATNVIFGLALGYKSVIIPIFSIAIAIFVSFSLAAMYGIAVAALGMLSTIATGLAIDAYGPISDNAGGIAEMAGMSHKIRERTDALDAAGNTTAAIGKGFAIGSAALVSLALFGAFVSRAGINTVDVLTPKVFIGLIVGAMLPYWFSAMTMKSVGSAALKMVEEVRRQFKTIPGLMEGRAKPDYANCVKISTDASLREMIPPGALVMLTPLITGTLFGVETLAGVLAGSLVSGVQVAISASNTGGAWDNAKKYIEAGVSEHAKSLGPKGSDAHKAAVIGDTIGDPLKDTSGPSLNILIKLMAVESLVFAPFFAAHGGLLFKYL

SEQ ID NO: 4976 - protein, 759 aa, Vitis vinifera
MGVMGDAFTQLLIPVAALVGIGFALLQWLLVSKVKVSADSDLNNGYSDRLIEEEEEGIDHEDVAAKCAEIQNAISVGATSFLFTEYRYLSIFMGVFGAIIFLFLGSVKGFSTKSEPCTYNTGSLCKPALANALFSTIAFLLGAMTSVLSGFLGMKIATYANARTTLEARKGVGKAFIVAFRSGAVMGFLLAASGLLVLYVSIHLFSLYYGDDWEGLYESITGYGLGGSSMALFGRVGGGIYTKAADVGADLVGKVERNIPEDDPRNPAVIADNVGDNVGDIAGMGSDLFGSYAEASCAALFVASISSFGISHDYTAMSFPLIISSVGIVVCLGTTLFATDFVEIKNVSEIEPSLKRQLLISTILMTAGIAVVSFFALPSEFTLFNFGSTKTVKNWHLFFCVSIGLWAGLVIGYITEYYTSNAYSPVQDVADSCRTGAATNVIFGLALGYKSVIIPIFAIAIAIYVSFSMAAMYGIAVAALGMLSTIATGLAIDAYGPISDNAGGIAEMAGMSHKIRQRTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTGGAWDNAKKYIEAGASEHARSLGPKGSDPHKAAVIGDTIGDPLKDTSGPSLNILIKLMAVESLVFAPFFAAHGGLLFKLL

SEQ ID NO: 4977 - protein, 759 aa, Prunus persica
MGLLSEGLTQLLIPLAALVGLAFALLQWFLVSRVKVSGSYGEGNGYKDKLIGEAEEGVDSLEVTIKVAEIQNAISIGATSFLFTQYRYLSIFVGVFSAIIFLFLGSVKGFSTKSEPCTYNTGNTCKPALANALFTTIAFLLGALTSVLSGFFGMKIATYANARTTLEARRGVGKAFITAFRSGAVMGFLLAANGLLVLYITINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHDYTAMSYPLIISSMGIVVCLITTLFATDLFEIKKVNEIEPSLKRQLLISTVLMTAGIAAVTFVALPSEFTLFSFGTNKAVKNWYLFFCVAIGLWAGLVIGYTTEYYTSNAYSPVQDVADSCRTGAATNVIFGLALGYKSVIIPVFAIAFAIYVSFSLAAMYGIAVAALGMLSTISTGLAIDAYGPISDNAGGIAEMAGMSHEIRERTDALDAAGNTTAAIGKGFAIGSAALVSLALFGAYVSRAGIETVDVLTPKVFIGLLVGAMLPYWFSAMTMKSVGSAALKMVEEVRRQFNTIPGLMEGTAKPDYATCVKISTDASLKEMIPPGALVMLTPLIAGTFFGVETLAGILAGSLVSGVQIAISASNTGGAWDNAKKYIEAGASEHAKSLGPKGSDPHKAAVIGDTIGDPLKDTSGPSLNILIKLMAVESLVFAPFFAAHGGVLFKWL

SEQ ID NO: 4978 - protein, 757 aa, Populus trichocarpa
MGMLSEGLTQVLIPAAALVGIAFALLQWYLVSKVKVSGDSSNGYSGKLIEEEEDGIDSLEVSIKCAEIQNAISVGATSFLFTQYKYLSVFMVVFAAIIFFFLGSVKGFSTKSEPCTYSQGKLCKPALANAAFSTLAFLLGALTSVLSGFLGMKIATYANARTTLEARKGVGKAFITAFRSGAVMGFLLAANGLLVLYISIILFKIYYGDDWEGLYESITGYGLGGSSMALFGRVGGGIYTKAADVGADLVGKVERNIPEDDPRNPAVIADNVGDNVGDIAGMGSDLFGSYAEASCAALFVASISSFGISHDYTAMSYPLIISSVGIVVCLITTLFATDLSEIRDVSQIEPSLKRQLVVSTILMTVGIAMVSFFALPSEFTLFNFGTEKAVKNWHLFFCVTIGLWAGLVIGYTTEYYTSNAYSPVQDVADSCRTGAATNVIFGLALGYKSVIVPIFAIAIAIYVSFSLAAMYGIAVAALGMLSTIATGLAIDAYGPISDNAGGIAEMAGMSHKIRERTDALDAAGNTTAAIGKGFAIGSAALVSLALFGAFVSRAGINTVDVLTPKVFIGLIVGAMLPYWFSAMTMKSVGSAALKMVEEVRRQFNTIPGLMEGRVKPDYANCVKISTDASLREMIPPGALVMLTPLITGTLFGVETLAGVLAGSLVSGVQVAISASNTGGAWDNAKKYIEAGASEHAKSLGPKGSDAHKAAVIGDTIGDPLKDTSGPSLNILIKLMAVESLVFAPFFAAHGGLLFKFL

SEQ ID NO: 4979 - protein, 759 aa, Eucalyptus grandis
MAVLSEALTQILIPASALIGIGFALLQWLLVSKVKVSADYGKKDGYKDKLIEDEEEGAENADAVIKCAEIQNAISVGATSFLFTQYKYLGIFMVAFAVVIFLFLGSVKGFSTQSEPCTYNPGNLCKPALANAMFSTIAFLLGALTSVLSGFLGMKIATYANARTTLEARKGVGKAFITAFRSGAVMGFLLAANGLLVLYVTINLFKLYYGDDWEGLYESITGYGLGGSSMALFGRVGGGIYTKAADVGADLVGKVEKNIPEDDPRNPAVIADNVGDNVGDIAGMGSDLFGSYAESSCAALFVASISSFGITHDYSAMSYPLTISAMGIVICLITTLFATDLAEIRHVSEIEPSLKRQLLISTILMTAGIAVVSFLALPSEFTLFNFGTEKAVKNWHLFFCVSIGLWAGLAIGYITEYYTSNAYSPVQDVADSCRTGAATNVIFGLALGYKSVIIPIFAIAIAIYISFSLAAMYGVAVAALGMLSTIATGLAIDAYGPISDNAGGIAEMAGMSHKIRERTDALDAAGNTTAAIGKGFAIGSAALVSLALFGAFVSRAGIKTVDVLTPKVFIGLIVGAMLPYWFSAMTMKSVGSAALKMVEEVRRQFNTIPGLMEGRAKPDYANCVKISTDASLREMIPPGALVMLTPLIAGTLFGVETLAGVLAGSLVSGVQVAISASNTGGAWDNAKKYIEAGASEHAKSLGPKGSDSHKAAVIGDTIGDPLKDTSGPSLNILIKLMAVESLVFAPFFAAHGGLLFKLL

SEQ ID NO: 4980 - protein, 760 aa, Theobroma cacao
MSAMGEGLTQILIPVAALVGIGFALFQWFLVSRVKVSSNDSSNEYKEKLIEADEEEEGIDNLEVSIKCAEIQHAISVGATSFLFTEYKYLGIFMGVFGAIIFLFLGSVRGFSTKSEPCTYNQGNTCKPALANALFSTIAFLLGALTSVLSGFLGMKIATYANARTTLEARKGVGKAFITAFRSGAVMGFLLAANGLFVLYVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGIGHDFTAMSYPLIISSMGIVVCLITTLFATDLFEIKNVSEIEPSLKRQLLISTVLMTAGIAVVSFFALPSEFTLYNFGTEKEVKNWHLFFCVAIGLWAGLVIGYTTEYYTSNAYSPVQDVADSCRTGAATNVIFGLALGYKSVIIPIFAIAIAIYVSFSLAAMYGIAVAALGMLSTIATGLAIDAYGPISDNAGGIAEMAGMSHKIRERTDALDAAGNTTAAIGKGFAIGSAALVSLALFGAYVSRAGIKSVDVLTPKVFIGLIVGAMLPYWFSAMTMKSVGSAALKMVEEVRRQFNTIPGLMEGRTKPDYANCVKISTDASLKEMIPPGALVMLTPLIAGTFFGVETLAGVLAGSLVSGVQVAISASNTGGAWDNAKKYIEAGASEHAKSLGPKGSDCHKAAVIGDTIGDPLKDTSGPSLNILIKLMAVESLVFAPFFAAHGGLLFKLL

SEQ ID NO: 4981 - protein, 667 aa, Actinidia deliciosa
MVAFAILIFLFLGSVESFSTKSQPCTYNPLKMCKPALATAIFSTISFLLGAVTSVVSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVSSISSFGINHEFTAMCYPLLISSVGIIVCLITTLFATDFFEIKAVKEIEPALKKQLIISTILMTGGIAIVSWIALPSSFTIFNFGAQKVVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAGISTVDVLTPKVFIGLLVGAMLPYWFSAMTMKSVGSAALKMVEEVRRQFNTIPGIMEGTAKPDYATCVKISTDASIKEMIPPGALVMLTPLIVGTLFGVETLSGVLAGSLVSGVQIAISASNTGGAWDNAKKYIEAGASEHARTLGPKGSEPHKAAVIGDTIGDPLKDTSGPSLNILIKLMAVESLVFAPFFATHGGLLFKFF

SEQ ID NO: 4982 - protein, 757 aa, Manihot esculenta
MGVLSEGLTQVLILVASLVGIAFALFQWFLVSKVRVSGESGNGYSDRLIEEEEEGVDNFDVSLKCAEIQNAISVGATSFLFTEYRYLSIFMGVFGAIIFLFLGSVKGFSTQSEPCTYSKGNLCKPALANATFSTIAFLLGALTSVLSGFLGMKIATYANARTTLQARKGVGKAFITAFRSGAVMGFLLSANGLLVLYVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISQFGIGHDYTAMSYPLIISAMGIIVCLITTLFATDMFEVKNVSEIEPSLKRQLVISTILMTAGIALVSFLALPSEFTLFDFGTDKLVKNWHLFFCVAIGLWAGLVIGYTTEYYTSNAYSPVQDVADSCRTGAATNVIFGLALGYKSVIIPIFSIAIAIYVSFSMAAMYGIAMAALGMLSTISTGLAIDAYGPISDNAGGIAEMAGMSHKIRERTDALDAAGNTTAAIGKGFAIGSAALVSLALFGAFVSRAGIKAVDVLTPKVFIGLIVGAMLPYWFSAMTMKSVGSAALKMVEEVRRQFNTIPGLMEGRAKPDYANCVKISTDASLREMIPPGALVMLTPLVAGTFFGVETLAGILAGSLVSGVQVAISASNTGGAWDNAKKYIEAGASEHARLLGPKGSDPHKAAVIGDTIGDPLKDTSGPSLNILIKLMAVESLVFAPFFATHGGLLFKLL

SEQ ID NO: 4983 - protein, 757 aa, Ricinus communis
MAMLSEGITQVFILVASLVGIGFALLQWFLVSKVRVSGDSGNAYNDKLIGEEEDGIDNLEVTLKCAEIQTAISVGATSFLFTEYKYLGIFMGVFGAIIFLFLGSVKGFSTESEPCTYNKGNLCKPALANALFSTLAFLLGALTSVLSGFLGMKIATYANARTTLQARKGVGQAFIVAFRSGAVMGFLLAANGLLVLYVSINLFKIYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHDVTAMCYPLIISSMGIIVCLITTLFATDLFEIKDASEIEPSLKRQLLISTILMTAGIAMVSFLALPSEFTLFDFGTEKVVKNWHIFFCVAIGLWAGLVIGYTTEYYTSNAYSPVQDVADSCRTGAATNVIFGLALGYKSVIIPIFAIAIAIYVSFSMAAMYGIAMAALGMLSTIATGLAIDAYGPISDNAGGIAEMAGMSHKIRERTDALDAAGNTTAAIGKGFAIGSAALVSLALFGAFVSRAGIKTVDVLTPKVFIGLIVGAMLPYWFSAMTMKSVGSAALKMVEEVRRQFNTIPGLMEGTAKPDYANCVKISTDASLREMIPPGALVMLTPLIAGTFFGVETLAGVLAGSLVSGVQVAISASNTGGAWDNAKKYIEAGASEHAKSLGPKGSDPHKAAVIGDTIGDPLKDTSGPSLNILIKLMAVESLVFAPFFAAHGGLLFKLL

SEQ ID NO: 4984 - protein, 759 aa, Eucalyptus grandis
  misc_feature (260)..(260): Xaa can be any naturally occurring amino acid
  misc_feature (296)..(296): Xaa can be any naturally occurring amino acid
MAVLSEALTQILIPTSALIGIGFALLQWLLVSKVKVSVDYGKKDGYKDKLIEDEEEGAENADAVIKCAEIQNAISVGATSFLFTQYKYLGIFMVAFAVVIFLFLGSVKGFSTQSEPCTYNPGNLCKPALANAMFSTIAFLLGALTSVLSGFLGMKIATYANARTTLEARKGVGKAFITAFRSGAVMGFLLAANGLLVLYVTINLFKLYYGDDWEGLYESITGYGLGGSSMALFGRVGGGIYTKAADVGADLVGKVEKNIXEDDPRNPAVIADNVGDNVGDIAGMGSDLFGSYAESXCAALFVASISSFGITHDYSAMSYPLTISAMGIVICLITTLFATDLAEIRHVSEIEPSLKRQLLISTILMTAGIAVVSFLALPSEFTLFNFGTEKAVKNWHLFFCVSIGLWAGLAIGYITEYYTSNAYSPVQDVADSCRTGAATNVIFGLALGYKSVIIPIFAIAIAIYISFSLAAMYGVAVAALGMLSTIATGLAIDAYGPISDNAGGIAEMAGMSHKIRERTDALDAAGNTTAAIGKGFAIGSAALVSLALFGAFVSRAGIKTVDVLTPKVFIGLIVGAMLPYWFSAMTMKSVGSAALKMVEEVRRQFNTIPGLMEGRAKPDYANCVKISTDASLREMIPPGALVMLTPLIAGTLFGVETLAGVLAGSLVSGVQVAISASNTGGAWDNAKKYIEAGASEHAKSLGPKGSDSHKAAVIGDTIGDPLKDTSGPSLNILIKLMAVESLVFAPFFAAHGGLLFKLL

SEQ ID NO: 4985 - protein, 760 aa, Gossypium hirsutum
MSALSEGLTQILIPLASLVGIGFAVLQWFLVSRVKLSSQDSSNGYKQKLIESDEEEEGINNLEISIKCTEIQHAISVGATSFLFTEYKYLGIFMCVFGAIIFLFLGSVKGFSTKSEPCTYSQGNTCKPALANAIFSTIAFLLGALTSVLSGYLGMKIATYANARTTLEARKGVGKAFITAFRSGAVMGFLLAANGLLVLYVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHEFTAMSYPLLISSMGIVVCLITTLFATDLFEIKKVSDIEPSLKRQLLISTVLMTAGIAVVSFFALPSEFTLFNFGTEKEVKNWHLFFCVAIGLWAGLIIGYTTEYYTSNAYSPVQDVADACRTGAATNVIFGLALGYKSVIIPIFAIAIAIYVSFSLAAMYGIAVAALGMLSTIATGLAIDAYGPISDNAGGIAEMAGMSHKIRERTDALDAAGNTTAAIGKGFAIGSAALVSLALFGAYVSRAGIKTVDVLTPKAFIGLIIGAMLPYWFSAMTMKSVGSAALKMVEEVRRQFNTIPGLMEGRVKPDYANCVKISTDASLREMIPPGALVMLTPLIVGILFGVETLAGVLAGALVSGVQVAISASNTGGAWDNAKKYIEAGVSEHAKSLGPKGSECHKAAVIGDTIGDPLKDTSGPSLNILIKLMAVESLVFAPFFAAHGGFLFKFI

SEQ ID NO: 4986 - protein, 760 aa, Fragaria vesca
MALLSEGLTQVVIPVAAFVGLAFALLQWFLVSRVKVSYGSSDGNDYKDKLIPGEEEEGIDNFSVTLKCAEIQNAISEGATSFLYTEYRYLSIFMGVFGVVIFLFLGSVKGFSTQSEPCTYNTGNMCKPALANAFFTTVAFLLGALTSVISGFLGMKIATYANARTTLEARKGVGKAFITAFRSGAVMGFLLAANGLLVLYITINLFKLYYGDDWEGLYESITGYGLGGSSMALFGRVGGGIYTKAADVGADLVGKVERNIPEDDPRNPAVIADNVGDNVGDIAGMGSDLFGSYAEATCAALFVASISSFGITHDYTAMSYPLIISSMGIVVCLITTLFATDLFEIKIASEVEPSLKRQLIISTVLMTAGIAVVTFVALPSEFTMFSFGTNKTVKNWYLFFCVSIGLWAGLVIGYTTEYYTSNAYSPVQDVADSCRTGAATNVIFGLALGYKSVIIPVFAIAFAIYVSFSLAAMYGIAVAALGMLSTIATGLAIDAYGPISDNAGGIAEMAGMSHEIRERTDALDAAGNTTAAIGKGFAIGSAALVSLALFGAYVSRAGIETVDVLTPKVFIGLLVGAMLPYWFSAMTMKSVGSAALKMVEEVRRQFNTIPGLMEGTAKPDYATCVKISTDASLREMIPPGALVMLTPLIAGTFFGVETLAGILAGSLVSGVQVAISASNTGGAWDNAKKYIEAGNSEHAKSLGPKGSDPHKAAVIGDTIGDPLKDTSGPSLNILIKLMAVESLVFAPFFAAHGGLLFKWL

SEQ ID NO: 4987 - protein, 761 aa, Quercus alba
MGVLSEGLTQILIPVAAFIGLGFALFQWFLVSKVKVSGGYGDYSGYKDRLINEGETEEGVDTLEVSIKCAEIQNAISVGATSFLFTEYRYLGIFTAVFGIVIFLFLGSVKGFSTESEPCTYNTGNICKPALANALFTTIAFFLGALTSVLSGFLGMKIATYANARTTLEARKGVGKAFITAFRSGAVMGFLLAANGLLVLWVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGTSHDFTAMSYPLIVSSMGIVVCLITTLFATDLFEIKRVSEIEPTLKRQLVISTVLMTAGIAMVTFFALPSEFTLFNFGTEMSVKNWHLFFCVAIGLWAGLAIGYTTEYYTSSAYSPVKDVADSCRTGAATNVIFGLALGYKSVIIPIFAIAIAIYVSFSLAAMYGISVSALGMLSTIATGLAIDAYGPISDNAGGIAEMAGMSHEIRERTDALDAAGNTTAAIGKGFAIGSAALVSLALFGAFVSRAGIYTVDVLTPKVFIGLLVGAMLPYWFSAMTMKSVGSAALKMVEEVRRQFNTIPGLMEGRAKPDYATCVKISTDASLREMIPPGALVMLTPLIAGTFFGVETLAGVLAGSLVSGVQVAISASNTGGAWDNAKKYIEAGGNEHAKSLGPKGSDAHKAAVIGDTIGDPLKDTSGPSLNILIKLMAVESLVFAPFFAAHGGLLFKLF

SEQ ID NO: 4988 - protein, 760 aa, Gossypium hirsutum
MSALSEGLTQIVIPLASLVGIGFALLQWFLVSRVKLLSQDSSNGYKQKLIESDEEEEGINNLEISIKCTEIQHAISVGATSFLFTEYKYLGIFMCVFGAIIFLFLGSVKGFSTKSEPCTYSQGNTCKPALANAFFSTIAFLLGALTSVLSGYLGMKIATYANARTTLEARKGVGKAFITAFRSGAVMGFLLAANGLLVLYVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHEFTAMSYPLLISSMGIVVCLITTLFATDLFEIKKVSDIEPSLKRQLLISTVLMTAGIAVVSFFALPSEFTLFNFGTEKEVKNWHLFFCVAIGLWAGLIIGYTTEYYTSNAYSPVQDVADACRTGAATNVIFGLALGYKSVIIPIFAIAIAIYVSFSLAAMYGIAVAALGMLSTIATGLAIDAYGPISDNAGGIAEMAGMSHKIRERTDALDAAGNTTAAIGKGFAIGSAALVSLALFGAYVSRAGIKTVDVLTPKAFIGLIVGAMLPYWFSAMTMKSVGSAALKMVEEVRRQFNTIPGLMEGRVKPDYANCVKISTDASLREMIPPGALVMLTPLIVGTLFGVETLAGVLAGALVSGVQVAISASNTGGAWDNAKKYIEAGVSEHAKSLGPKGSECHKAAVIGDTIGDPLKDTSGPSLNILIKLMAVESLVFAPFFAAHGGFLFKFI

SEQ ID NO: 4989 - protein, 416 aa, Gossypium hirsutum
MSALSEGLTQIVIPLASLVGIGFALLQWFLVSRVKLLSQDSSNGYKQKLIESDEEEEGINNLEISIKCTEIQHAISVGATSFLFTEYKYLGIFMCVFGAIIFLFLGSVKGFSTKSEPCTYSQGNTCKPALANAFFSTIAFLLGALTSVLSGYLGMKIATYANARTTLEARKGVGKAFITAFRSGAVMGFLLAANGLLVLYVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHEFTAMSYPLLISSMGIVVCLITTLFATDLFEIKKVSDIEPSLKRQLLISTVLMTAGIAVVSFFALPSEFTLFNFGTEKEVKNWQCCYRIVGWTHYRLYYRILY

SEQ ID NO: 4990 - protein, 763 aa, Castanea mollissima
MGLLSEGLTQILIPVAAFIGLAFALFQWFLVSKVKVSGGYGDYSGYKDKDRLINEGDTEEGVDTLEVSIKCAEIQNAISVGATSFLFTEYRYLGIFTAVFGVVIFLFLGSVKGFSTASEPCTYNTGNICKPALANALFTTIAFFLGAITSVLSGFLGMKIATYANARTTLEARKGVGKAFITAFRSGAVMGFLLSANGLLVLWVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGINHDFSAMSYPLIISSMGIVVCLITTLFATDFFEIKRVSEIEPTLKRQLVISTVFMTAGIAMVTFFALPSEFTLFNFGTEMSVKNWHLFFCVAIGLWAGLVIGYTTEYYTSSAYSPVKDVADSCRTGAATNVIFGLALGYKSVIIPIFAIAVAIYVSFSLAAMYGISVSALGMLSTIATGLAIDAYGPISDNAGGIAEMAGMSHEIRERTDALDAAGNTTAAIGKGFAIGSAALVSLALFGAFVSRAGINTVDVLTPKVFIGLLVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTGGAWDNAKKYIEAGGNEHAKSLGPKGSDAHKAAVIGDTIGDPLKDTSGPSLNILIKLMAVESLVFAPFFAAHGGLLFKLF

SEQ ID NO: 4991 - protein, 346 aa, Gossypium hirsutum
MSALSEGLTQIVIPLASLVGIGFALLQWFLVSRVKLSSQDSSNGYKQKLIESDEEEEGINNLEISIKCTEIQHAISVGATSFLFTEYKYLGIFMCVFGAIIFLFLGSVKGFSTKSEPCTYSQGNTCKPALANAIFSTIAFLLGALTSVLSGYLGMKIATYANARTTLEARKGVGKAFITAFRSGAVMGFLLAANGLLVLYVSINLFKLYYGDDWEGLYESITGYGLGGSSMALFGRVGGGIYTKAADVGADLSVSERNIPEDDPRNPAVIADNVGDNVGDIAGMGSDLFGSYAESSCAALFVASISSFGISHEFTAMSYPLLISSMGIVVCLITTLFATDLLRSRK

SEQ ID NO: 4992 - protein, 667 aa, Gossypium hirsutum
MIAFAILIFLFLGSVEGFSMKSQPCTYDKEKMCKPALATAIFSTVSFLLGAITSVLSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHDFTGMLYPLLISSVGILVCLITTLFATDLFEIKVVKEIEPALKKQLIISTILMTVGIAIVTWIGVPSSFTIYNFGVQKVVKNWQLFLCVGVGLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGHAKPDYATCVKISTDASIKEMIPPGALVMLTPLIVGTFFGVETLSGVLAGALVSGVQIAISASNTGGAWDNAKKYIEAGVSEHARTLGPKGSDPHKAAVIGDTVGDPLKDTSGPSLNILIKLMAVESLVFAPFFATHGGLLFKIF

SEQ ID NO: 4993 - protein, 757 aa, Manihot esculenta
MGMLSEGHTQILILVASLVGIGFALLQWFLVSKVRVSGESGNIYNDILIGEEEEGVDKHDVSLKCAEIQNAISVGATSFLFTEYRYLCIFMGVFGVIIFLFLGSVKGFSTKSEPCTYNKGNLCKPALANAFFSTIAFLLGALTSVLSGFLGMKIATYANARTTLQARKSVGKAFITAFRSGAVIGFLLSANGLLVLFVSINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISQFGVNHDYTAMSYPLIISSMGIIVCLITTLFGTDMFEIKNVSEIEPSLKKQLLISTILMTVGIAMVSFLALPSEFTLFDFGTDKLVKNWQLFFCVSIGLWAGLVIGYTTEYYTSNAYSPVQDVADSCRTGAATNVIFGLALGYKSVIIPIFAIAIAIYVSFSMAAMYGIAMAALGMLSTISTGLAIDAYGPISDNAGGIAEMAGMSHKIRERTDALDAAGNTTAAIGKGFAIGSAALVSLALFGAFISRAGIKTVDVANPKVFIGLIVGAMLPYWFSAMTMKSVGSAALKMVEEVRRQFNTIPGLMEGRTKPDYANCVKISTDASLREMIPPGALVTLTPLVAGTLFGVETLAGVLAGSLVSGVQVAISASNTGGAWDNAKKYIEAGASEHARSLGPKGSDAHKAAVIGDTVGDPLKDTSGPSLNILIKLMAVESLVFAPFFAAHGGLLFKLL

SEQ ID NO: 4994 - protein, 590 aa, Pennisetum glaucum
MAAILPELATQVVIPVAAAVGIAFAVLQWVLVSKVRLTPERGRADGGAAKGGPSDYLIEEEEGLNDHNVVVRCAEIQSAISEGATSFLFTEYKYVGLFMGIFAILIFLFLGSVEGFSTKSQPCHYSKDKICKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVNEIEPALKKQLIISTVVMTIGIALISWLALPYTFTIFNFGVQKTVQSWQLFLCVAVGLWAGLIIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLSPKYSLDLLLVLCSHIGSQQ

SEQ ID NO: 4995 - protein, 423 aa, Gossypium hirsutum
MGASILSDFGAEILIPVCAVIGIAFSLVQWVLVSKVKLSPGRESVNNGSGAKNGYSDYLIEEEEGLNDHSVVLKCAEIQSAISEGATSFLFTEYQYVGIFMVAFAILIFLFLGSVERFSSKSQPCTYGKSKICKPALATAAFSTISFLLGAITSVVSGFLGMKIATYANARTTLEARKGVGKAFITAFRSGAVMGFLLAANGLLVLYIAINLFKLYYGDDWSGLFEAITGYGLGGSSMALFGRVGGGIYTKAADVGADLVGKVERNIPEDDPRNPAVIADNVGDNVGDIAGMGSDLFGSYAESSCAALVVASISSFGINHELTPMLYPLIISSVGIIVCLITTLFATDFFEIKAVKEIEPSLKRQLIISTVLMTIGIGIVSWIALPSSFTIFNFRRPESCEELATILMCCCWSLGRPNYRFRN

SEQ ID NO: 4996 - protein, 759 aa, Euonymus alatus
MGLLGEGLTQVLMPAAALLGIGFALLQWFLVSKVRVSDGSGEESGYSESLIEGEEEGVDNLQVSIKVAEIQNAISIGATSFLFTQYKYLGIFMGMFGAIIFLFLGSVKGFSTKSEPCIYNKDNLCKPALANAVFSTIAFLLGALTSVLSGFLGMKIATYANARTTMEARKGIGRAFTAAFRAGSVMGFLLAANGLLVLYISINLFKLYYGDDWEGLYESITGYGLGGSSMALFGRVGGGIYTKAADVGADLVGKVEQNIPEDDPRNPAVIADNVGDNVGDIAGMGSDLFGSYAESSCAALFVASISSFGISHDYVAMSYPLIISSMGIVVCLITTLFATDLFVIKNVSEIEPSLKRQLLISTVLMTAGIAMVSFFALPSEFTLFNFGTDKVVKNWHLFFCVSIGLWAGLAIGYTTEYYTSNAYSPVQDVADSCRTGAATNVIFGLALGYKSVIVPIFAIAIAIYVSFSLAATYGIAVAALGMLSTIATGLAIDAYGPISDNAGGIAEMAGMSSKIRERTDALDAAGNTTAAIGKGFAIGSAALVSLALFSAFVSRAGIQAVDVLTPKVFIGLIVGAMLPYWFSAMTMKSVGSAALKMVEEVRRQFKSIPGLIEGRAKPDYANCVKISTDASLREMIPPGALVILTPLIAGTFFGVETLAGVLAGSLVSGVQVAISASNTGGAWDNAKKYIEAGASEHAKVLGPKGSDAHKAAVIGDTIGDPLKDTSGPSLNILIKLMAVESLVFAPFFATHGGLLFKLL

SEQ ID NO: 4997 - protein, 785 aa, Gnetum gnemon
MEMAMEKEKRALLTETLTQVFIPVAAIIGIAFALVQWFLVSRVKVSPAAASAPAVPVRSSYSYGAAGGGGRAERLLVDDEVDEDGGDGRQTVAKCAEIQNAISVGATSFLFTEYKYLGIFMVCFGLIIFLFLGSVESFSTKPRPCTYDKTKMCKPALANAVFSSVAFVLGALTSVLSGYLGMKIATYANARHIGSQKGVGKAFITAFRSGAVMGFLLAANGLLVLYISINVFRIYYGDDWEGLFEAITGYGLGGSSMALFGRVGGGIYTKAADVGADLVGKVEQNIPEDDPRNPAVIADNVGDNVGDIAGMGSDLFGSYAESSCAALVVASISSFGNSHDFTSMCYPLLISSMGIIVCLITTLFATDFFEIRDVKQIEPSLKKQLIISTVLMTVGIAVVSLIGLPSKFYIYNFGASKSVKNWELFFCVGVGLWAGLVIGYVTEYFTSNAYSPVQEVAQSCKTGAATNVIFGLALGYKSVIIPIFAIAIAIYVSFKLAAMYGIAVAALGMLSTIATGLAIDAYGPISDNAGGIAEMAGMSHKIRERTDALDAAGNTTAAIGKGFAIGSAALVSLALFGAFVSRAAIAKVDVLTPKVFIGLIVGAMLPYWFSAMTMKSVGSAALKMVEEVRRQFKFIPGLMEGTTKPDYATCVKISTDASIKEMVPPGALVMLTPLIVGILFGVETLSGVLAGALVSGVQVAISASNTGGAWDNAKKFIEAGASKAARELGPKGSDAHKAAVIGDTIGDPLKDTSGPSLNILIKLMAVESLVFAPFFAAHGGLLFKI

SEQ ID NO: 4998 - protein, 763 aa, Glycine max
MVVLSEGLTQILIPVTAFIGIGFALLQWLLVSRVRVSSADHTEADNGYRKSLMGDSELENGVQSVEVTNKCTEIQHAISVGATSFLFTEYKYLTIFMGVFGAIIFVFLGSVKGFSTQSEPCTYNEGNICKPALANAIFSTVAFLLGALTSVLSGFLGMKIATYANARTTLEARKGIGKAFVIAFRSGAVMGFLLSANGLLVLYITINLFKLYYGDDWEGLYESITGYGLGGSSMALFGRVGGGIYTKAADVGADLVGKVEHNIPEDDPRNPAVIADNVGDNVGDIAGMGSDLFGSYAESSCAALFVASISSFGTNHDHTAMSYPLIISSMGIVVCLITTLFATDLFEIKNVSQIEPSLKRQLLISTILMTAGIAIVSFTALPSEFTLYNFGAKKVVKNWHLFFCVAIGLWAGLAIGYITEYYTSNAYSPVQDVADSCRTGASTNVIFGLALGYKSVIIPVFAIAIAIYVSFSLAAMYGIAVAALGMLSTMATSLAIDAYGPISDNAGGIAEMAGMRHEIRERTDALDAAGNTTAAIGKGFAIGSAALVSLALFGAYVSRAGIKTVNVMTPKVFIGLIVGAMLPYWFSAMTMKSVGSAALKMVEEVRRQFNTIPGLLEGRAKPDYANCVKISTDASLKEMIPPGALVLLTPLIAGTFFGVETLAGVLAGSLISGVQVAISASNTGGAWDNAKKYIEAGTTPHAVSLGPKGSDAHKAAVIGDTVGDPLKDTSGPSLNILIKLMAVESLVFAPFFAAHGGLIFKLL

SEQ ID NO: 4999 - protein, 540 aa, Sorghum bicolor
MAASSAFLPELGTQVVVPVAAVVGIAFAVLQWVLVSKVKLTPEPPRRGDGSAGKSGGAGASEFLIEEEEGLNEHNVVVKCAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIYNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGK

SEQ ID NO: 5000 - protein, 415 aa, Taxus baccata
MAGPLLSEMLTEILVPVAAVIGIAFALLQWVFVSRVKVTPSTASNGYNDHLLDEAEEDGIDGRRAVIKCAEIQNAISEGATSFLFTEYKYLGVFTVCFGAIIFLFLGSVENFSTKSQPCTYAKEKMCKPALANAIFSAIAFLLGALTSVLSGFLGMKIATYANARTTLEARKGVGKAFITAFRSGAVMGFLLAANGLLVLYISINVFKIYYGDDWEGLFEAITGYGLGGSAMALFGRVGGGIYTKAADVGADLVGKIEQNIPEDDPRNPAVIADNVGDNVGDIAGMGSDLFGSYAESSCAALVVASISSFGNSHDFTSMCYPLLISSMGIVICLITTLFATDFFEIKAVKEIEPALKRQLIISTVLMTIGIAIVSFVALPSTFTIFNFGSAKVVKNWYVKEILTLIKCIVFQVLI

SEQ ID NO: 5001 - protein, 253 aa, Lippia dulcis
MLLKAAVAFSLLDSHGEIPAALFSSSSFPPKSFAGRRGNVSLVCVTKQTNTKPLGVVFEPFEEVKKELMLVPTLPQDSLARQKFADESEAAINEQINVEYNVSYVYHAMFAYFDRDNVALKGLAKFFKESSLEEREHAEKLMEYQNKRGGKVKLQSILMPLSEFEHAEKGDALYAMELALSLEKLTNEKLLNLHEVASKNNDVQLTDFIESEFLAEQVESIKKISECVAQLRRVGKGHGVWHFDQMLLEEAVA

SEQ ID NO: 5002 - protein, 244 aa, Antirrhinum majus
MLLKSAPVFGLLNGSGENLTALFSSSFSQKKSGNGCVVCATKHTNNKPLTGVVFEPFEEVKKELSLVPSLPGASLARQKFADESEAAINEQINVEYNVSYVYHAMFAYFDRDNVALKGLAKFFKESSEEERQHAEKLMEYQNKRGGKVKLQSILMPLSEFDHAEKGDALYAMELALSLEKLTNEKLLNLHAVASKNNDAQLTDFVESEFLAEQVESIKKISEYVAQLRRVGKGHGVWHFNQMLL

SEQ ID NO: 5003 - protein, 260 aa, Gossypium hirsutum
MLLKAVPTFSSLNPQLENQGALFSPFSSSINHQLSSLRNGPGSLVVCAAKGANHKPLSGVVFQPFVEVKKELDLVPSVPQLSLARQKFTDDCEASINEQINVEYNVSYVYHAMFAYFDRDNVALKGLAKFFKESSLEEREHAEKFMEYQNKRGGKVKLQSIVMPLSEFDHAEKGDALYAMELALSLEKLTSEKLFNLRNVAVRNHDVQLTDFIEGEFLAEQVEAIKKISEYVAQLRRVGKGHGVWHFDQMLLHEGEEAIA

SEQ ID NO: 5004 - protein, 262 aa, Manihot esculenta
MLLKAAPALSLINTRGENLGPLFSSVSSSSNPPFPMILRGKTGTGFVVCASKGANDKPLTGVIFEPFEEVKKELNLVPTVPQVSLARQKYADECEAAINEQINVEYNVSYVYHAMFAYFDRDNVALKGLAKFFKESSEEEREHAEKFMEYQNKRGGKVKLQSIVMPLSEFDHVEKGDALYAMELALSLEKLTNEKLLNLQSVAERNHDVQLGDFVESEFLSEQVEAIKKISEYVAQLRRVGKGHGAWHFDQMLLHEEEAVVA

SEQ ID NO: 5005 - protein, 264 aa, Populus trichocarpa
MLLKAAPAFSLLNATGDNLGSLFPSVSSLSNKNLSVSPSFLRSKTGSGFVVCASKGANNRPLTGVVFEPFEEVKKELNLVPNVPQVSLARQKFTDESEAAINEQINVEYNVSYVYHAMFAYFDRDNVALKGLAKFFKESSIEEREHAEKLMEYQNKRGGKVKLQSILMPLSEFDHAEKGDALYAMELALSLEKLTNEKLLNLHSVAEKNKDVQLTDFVESEFLAEQVDAIKKISEYVAQLRRVGKGHGVWHFDQMLLHGEEVVA

SEQ ID NO: 5006 - protein, 287 aa, Theobroma cacao
MYAETGLFFPYMQNFCQDFQQFEEFCKTQKPNASMNNLVQTSTISEYDLGGEGDLFKAPEPIIEEPIVGLDPMTAAISLISCGEDVITSQGLKAADIESIQNEQLLEVLYECEKDLMAQAAIETPLSDVLDIKIPVVKTDENQNQGNKLLCDVPFQKSVSSGCLSSMEWMQGAAIKPSFLDFSGMDFGSVYGMRRAFSEGDIKTLGNGNTTVIHSPLERPLIVSSCSTEDRREKLSRYRNKKTKRNFGRKIKYACRKALADSQPRIRGRFARTEESDNSKRQELFSN

SEQ ID NO: 5007 - protein, 286 aa, Heritiera littoralis
MYAETELFFPHMQNFSLDFQQFEEYCKTQKPNASMDNLVQTSMIYEYDLGGEGDLFKAPEPIIEEPIVSLDPMTAAISLISFGEDVITSQRLKAADIESVQNQKLLEVLYECEKDLMAQAAIETPLSEVLDIKVSVVKTDENQNQENNMICDVPFQKSVSSGSLSSMEWMQGAVIKPNFLDFPGMDFGSVYGMRRAFSEGDIKTLGNGNMNIIQSSLERPLIVSSCSTEDRREKLSRYRNKKTKRNFGRKIKYACRKALADSQPRIRGRFARTEESDNSKRAIAVD

SEQ ID NO: 5008 - protein, 281 aa, Gossypium hirsutum
MYAETGLFFPYMQKVSQEFHQFEEFCETQKSNASMNNMVQTSAISEYYLGGEGDLFKAPEPIIEEPIVDLNPMTAAISLSFCGEDVITSQGFKAADIESIQNEQFLEVLYECEKDLMARAVIETPLSEVLDVKIPLKTDENQNHENEVLCDVQFQKSVSSDCLSSMEGMQGAAMKPNFLDFPGIDFGSAYGMRRAFSEGDMKTLGNGNASVIHSPLEQPIIVSSCSTKDRREKLSRYRNKKTKRNFGRKIKYACRKALADCQPRIRGRFAKTEESNNSKRQ

SEQ ID NO: 5009 - protein, 189 aa, Theobroma cacao
MAMWVFGYGSLIWKAGFNYDDRLVGFIKDYRRVFYQGSTDHRGTPEYPGRTVTLEPADGEVCWGAAYKISKKEDKENAIMHLEVREKQYDKKAYLDFFTDPTATTPAISGVMVYIASPDKKLNKNYLGPASLEEIAKQIIHAEGPSGPNRDYLFQLEKALLQLGCKDKHVIGLANEVRRILSEGQLIAS

SEQ ID NO: 5010 - protein, 189 aa, Humulus lupulus
MAMWVFGYGSLIWKAGFNFDERLAGFIKDYRRVFYQGSTDHRGTPEFPGRTVTLEPAEGEVCWGAAYKITKKEDQEIALMHLEVREKQYDKKAYVDFFTEPLATTPAVSGVMVYIASPDKKANVNYLGPASIEDIAKQIVRAEGPSGPNRDYLFQLEKALLQIGCKDEHVIGLANEVRRILSESEPTFA

SEQ ID NO: 5011 - protein, 185 aa, Heritiera littoralis
MAMWVFGYGSLIWKAGFNYDDRLVGFIKDYRRVFYQGSTDHRGTPEYPGRTVTLEPAHGEVCWGAAYKISEKEDKETALTYLEVREKQYDQKAYVDFFTDPTATTPAVSGVMVYIGSADKKLNENYLGPAPVEEIAEQIVHAEGPSGPNREYLFQLENALLQIGCKDKHVMDLAKEVRRILSERK

SEQ ID NO: 5012 - protein, 189 aa, Carica papaya
MVMWVFGYGSLIWKAGFNYDERLVGFIKGYRRVFYQGSTDHRGTIDYPGRTVTLIPADGEVCWGAAYKISKKEDKETAFTYLEVREKQYDKKAYLDFFTEPNASTPAISGVMVYIASPDKKLNKNYLGPASLEDIANQIVNAEGPSGPNRDYLFQLEKALVQSGCKDKHVIDLANEVRRILLERENTGS

SEQ ID NO: 5013 - protein, 187 aa, Quercus alba
MWVFGYGSLIWKAGFNYDQRLVGFIKDYRRVFYQGSTDHRGTLDYPGRTVTLEPAEGEVCWGAAYKVSKKEDQEVALTYLEVREKQYDQKAYLDFFTEPTATSPAVSGIMVYIASPDKKLNRNYLGPASLEDIAKQIVHAEGPSGPNREYLFQLEKALLQIGCKDEHVMDLANEVRGILSQGELTAS

SEQ ID NO: 5014 - protein, 189 aa, Manihot esculenta
MWVFGYGSLIWKAGFNYDARLVGFIKGYRRVFYQGSTDHRGTPENPGRTVTLEPADGEVCWGVAYKISKKEDEETAITYLEVREKQYDQKAYLDFFTDPTATTPAVSGVMVYIGSSDKKHNQNYLGPAPLEEIAKQIVHAEGPSGPNRDYLFQLEKALLQIGCKDKHIMDLANEVRRILSEREPDLIMP

SEQ ID NO: 5015 - protein, 189 aa, Humulus lupulus
MAMWVFGYGSLIWKAGFNFDERLTGSIKGYRRVFYQGSTDHRGTTEFPGRTVTLEPAEGEVCWGAAYKITKKEDQEIALTHLEVREKQYDKKAYVDFFTEPMAATPAVSGVMVYIASPDKKANVNYLGPASIEDIAKQIVRAEGPSGPNRDYLFQLEKALLQIGCKDEHVIGLANEVRRILSESKQPFA

SEQ ID NO: 5016 - protein, 191 aa, Fragaria vesca
MVMWVFGYGSLIWKAGFNFDERVVGFIKDYRRVFYQGSTDHRGTPEFPGRTVTLEPAEGEVCWGAAYKISKKEDQEIALEHLEVREKQYDKKAYLDFFTEPTATTPALSGVMVYIASPDKKRNVNYLGPASIEDIAKQIVEAKGPSGPNREYLFKLEEALLQIGYKDKHVLDLANEVRRIISERDMELTAL

SEQ ID NO: 5017 - protein, 189 aa, Euonymus alatus
MVMWVFGYGSLIWKAGFDYDDRLIGFIKGYRRVFYQGSTDHRGTPEYPGRTVTLEPAEGEVCWGIAYKITKKEDKETAFTYLEVREKQYDMKAYLDFFTEPSATTPAVTGVLVYIASPDKKLNKNYLGPESLEEIAKQIVCAQGPSGPNRDYLFQLEKYLLQIGCKDKHVMDLANEVRRIISDGEQQEQ

SEQ ID NO: 5018 - protein, 189 aa, Actinidia deliciosa
MVMWVFGYGSLIWKAGFHYDDRLFGFIKGYRRVFYQGSTDHRGTQEYPGRTVTLEAAEREVCWGVAYKISRMEDEQIALTYLEVREKQYDKKAYIDFFTDPMALTPAVSGVMVYIASPDRKLNPNYLGPASIEEIAKQIVRAEGPSGPNRDYLFQLEKALIQYGCEDKHVMGLANEVRRVLSEMELIFS

SEQ ID NO: 5019 - protein, 187 aa, Prunus persica
MWVFGYGSLIWKAGFNYDERLVGFIKGYRRVFYQGSTDHRGTPEYPGRTVTLEPAEGEVCWGVAYRISNKEDQEVALTYLEVREKQYDKKAYLDFFTEPNATTPAVSDVMVYIASPDKKHNVNYLGPASIEEIAKQIIQAEGPSGPNRDYLFQLEEALLQFGCKDAHVMDLASEVRRILSERELTST

SEQ ID NO: 5020 - protein, 192 aa, Malus domestica
MAISPIWVFGYGSLIWKAGFNYDERLVGFIKGYRRVFYQGSTDHRGTPEYPGRTVTLEPAEGEVCWGVAYKISNKEDQEVAITYLEVREKQYDKKAYLDFFTDPMATTAAVSGVMVYIASPDKKHNVNYLGPASTEEISKQIVQAEGPSGPNRDYLFRLEEALLQLGCKDKHVLDLANEVRRILSERELTSA

SEQ ID NO: 5021 - protein, 189 aa, Populus trichocarpa
MAMWVFGYGSLIWKAGFNYDDRVVGLIKGYRRVFYQGSTDHRGTPEYPGRTVTLEPADGEVCWGVAYKISKKEDQEVALTYLEVREKQYDEKAYLDFFTDPAATTPAVSGVMVYIGSPDKRHNQNYLGPAPLEEIAKQIFYAEGPSGPNRDYLFHLESALLQIGCKDKHVIDLANEVRRIRPETGLADS

SEQ ID NO: 5022 - protein, 192 aa, Malus domestica
MAISPIWVFGYGSLIWKAGFNYDERLVGFIKGYRRVFYQGSTDHRGTPEYPGRTVTLEPAEGEVCWGVAYKISNKEDQEVAITYLEVREKQYDKKAYLDFFTDPMATTAAVSGVMVYIASPDKKHNVNYLGPASTEEISKQIVQAEGPSGPNRDYLFRLEEALLQLGCKDRHVLDLANEVRRILSERELTSA

SEQ ID NO: 5023 - protein, 190 aa, Ricinus communis
MVMWVFGYGSLIWKAGFNYDDRLVGFIKGYRRVFYQGSTDHRGTPEYPGRTVTLLPADGEVCWGVAYKISDKEDEETALTYLEVRERQYDQKAYLDFFADPAATTPAVSRVMVYIGSEDKKHNKNYLGPAPLEDIAKQIIRAEGPSGPNRDYLFHLETALLQIGCKDKHVMDLANEVRRMLSDEQKEPTS

SEQ ID NO: 5024 - protein, 191 aa, Eucalyptus grandis
MVMWVFGYGSLIWKAGFHYDDRLVGFIKGYRRVFYQGSTDHRGTPEFPGRTVTLEPAEGEFCWGVAYRISDEQDKRTAITYLEVREKQYDQKASLDFFTDPAAVTPAVSGVMVYIGSPDKKINMNYLGPAPLEDIARQIVLAEGPSGPNRDYLFQLEKALLQIGCEDKHIKDLADEVRRLLSERKLKGEEV

SEQ ID NO: 5025 - protein, 187 aa, Euphorbia peplus
MVMWVFGYGSLIWKAGFNFDDRLVGFIKGYRRLFYQGSTDHRGTPEYPGRTVTLEPADGEICWGAAYKISNKEDEETALTYLEVREKQYDEKAYVDFYTESTATAPAITGVMVYIGSSDKKQNPNYLGPAPLEDIAKQIVNAEGPSGPNRDYLFQLDMALHQIGCKDRHVIDLANEVRRILSDEEQK

SEQ ID NO: 5026 - protein, 344 aa, Gossypium hirsutum
MLNSSKLFPKAINSTHLIRSPPLPSSVTSHMHKDVYQAFPYSDPMQCTINFKQSDDPVMSFDQEDLNIPWSELVLKERIGAGSFGTVHRAEFRGCEVAVKILMEQDFHIERFREFLREVSIMKCLRHPNIVLFMGAVTQPPKLSIVTEYLSRRSLFRLLQMPDAWKVLNEKLRLNMALDVARGMNYLHQLKPPIVHRDLKSPNLLVDSNYTVKVCDFGLSRSKANTFLSSKTAAGTPEWMAPEVLCNENSNEKSDVYSFGVVLWELMTLQQPWKHLNPPQVVAAVGFKGERLEIPSHVNRVVASLIEQCWAREASERPPFSHVIQCLQQVIQNTASQELNGLSL

SEQ ID NO: 5027 - protein, 304 aa, Gossypium hirsutum
MSATSASSLILPSLKPKVLSLSDSTPNSLSLFSLSPTPHAKPLFCSALPSFQLLTKKSSFSSRFLTKVAVSSEYDQEEDLFGSDDEERSPTFSPDLKLFVGNLPFTVDSAQLAGLFENAGNVEMVEVIYDKVTRRSRGFGFVTMSTIEEVEAATQQFNGYELEGRALRVNSGPPPPRREEFSPRGARGGPSMGARGGPPMGARGGPPMGARGGPPMGASNRVYVGNLSWGVDDIALETLFSEQGRVVEAKVVYDRESGRSRGFGFVTYRSADEVNSAIKSLNGCDLDGRPIRVTVAESRPRRQF

SEQ ID NO: 5028 - protein, 350 aa, Gossypium hirsutum
MGEEQQRIQIPRIKLGTQGLEVSKLGFGCMGLTGGYSCPVSEEVGISIIKHAFHRGITFFDTSDIYGPKTNEILVGKALKQLPREKVQLATKFGFEKLDSTGIKINGTPEYVRASIEASLKRLDVDYIDLYYQHRVDTNTPIEDTMSELKKLVEEGKIKYIGLSEASPETIKRAHAVHPISAFQTEWSLWTRDIEDEIVPLCRELGIGIVPYSPLGRGFFGGKGVVETVPANSHLLYFPRFQGENLDRNKMLYLKVEKLAEKHGCSPAQLALAWVLHQGDDVAPIPGTTKIKNLDSNIDSVKVKLTAEDLKEISDAVPINEVAGDVLPDRFSQLHWKFGNTPPKGSKVST

SEQ ID NO: 5029 - protein, 350 aa, Gossypium hirsutum
MGEEQQRIQIPRVKLGTQGLEVSKLGFGCMGLTGVYNDPVPEEIGISIIKHAFHRGITFFDTSDFYGPKTNEILIGKALKHLPREKVQLATKFGIENMDSTGFIVNGTPQYVRTCIEASLKRLDVDYIDLYYQHRVDTNTPIEDTMSELKKLVEEGKIKYIGLSEASPETIKRAHAVHPITALQMEWSLWTRDIEDEIVPLCRELGIGIVPYSPLGGGFFAGRGVMETVPANSMLTYISRFQGENLDKNKMLYLKTEKLAKKHGCTSAQVALAWVLHQGDDVAPLPGTTKIKNLDSNIGSLKVKLTAEDLKEISDAVPINEVAGNPMPDILSRFSWKFSNTPPKGSKVST

SEQ ID NO: 5030 - protein, 313 aa, Gossypium hirsutum
MVLLVQRLSKLYHKLENHYHHHHHHQAEVDALSASLQAFRSDVSNCVNQLLHPKPGSEILSFSWIQRCFELLPVINKAFLKLVGDIDYPMSCWDVASLDEYLNYGLHLLELLNCVTSSLSHLAQARLSFAHALNLVESSPSTAIEHLKAIQSQSSSKDLKGLVRNKEGGEGKLSSCKERVVHEALMEVKSVGLWVFGVVLATLSGETKPYLEIKQVIVRFNSALLIDVDSCVFKVMVEKGETLKEVKELNSAANSLVSAILSGKTSVAAMDFGGKLGVFEKEMDALEKQVDALFSSVLAARNELLNGVRQRKQ

SEQ ID NO: 5031 - protein, 487 aa, Gossypium hirsutum
MAAEYREPLLKKKYYKNCPGCKVDEMKELEQGLPIRPLLSIWIIVLCTALPISSLFPFLYFMIRDFHIAEREEDIGSYAGYVGSAFMLGRALTSVSWGIFADRYGRKPVIIMGTTSVVIFNTLFGLSVNFWMAVITRFLLGSLNGLLGPIKAYAVEIFRDEYQALGLSTVSTAWGIGLIIGPALGGFLAQPAEKYPNLFSRDSLFGRFPYFLPCLAISIFALAVTIATCWLPETLHKHNDNDQSSDDSYDALEAASNESNTKDITEKEEGRESTSKQSLLKNWPLMSSIIVYCVFSLHDMAYTEIFSLWAVSPRKYGGLSYSTEQVGEVLAVSGFSLLVFQMSLYPFVERLLGPVMVSRIGSILAIPLLQSYPWIAMLSGFTLTLVINCASVLKNVLSVSVITGLFILQNRAVDQHQRGAANGIAMTGMSLFKAVGPAGGGALFSWSEKRLDASFLPGTQMVFFVLNIVEAVGFLLTFEPFLAQHRQ

SEQ ID NO: 5032 - protein, 1190 aa, Theobroma cacao
MKSIKETAVAENGRFLGSISTSSLRNLLPKSKLKRSTKKPSSENTPPPDPNIIEVNNSAQFFPKSPLSKSLTSDALIVPSDGDREMLPPMETSIKNEIVESEKQGGELGNLDPSVKVVVRIRPINGQEKEVDRTVRKISSDSLSVSDRKFTFDSVLDSNSNQEDVFQLIGVPLVKNALSGYNTSILSYGQTGSGKSYTMWGPPSAMVEDPSPRSHQGIVPRIFQMLFSEIQREQENLDGKQINYQCRCSFLEIYNEHIGDLLDPTQRNLEIKDDPKNGLYVENLTEEYVSSYEDVTQILIKGLSSRKVGATTVNSKSSRSHIVFTFVIESWCKGASSKCFSSSKTSRISLIDLAGLDRNKLEDVGRQHVQEGKNVKKSLSQLGYLVNALAKETQPEDAPYQGSCLTRILRESLGGNAKLTVICNISADNRNSGEVLSTLRFGQRIKSIRNEPVINEISEDDVNGLSDQIRQLKEELIRAKSDVYSSVGSKSGYFIGRSARDSLNQLRVSLNRSLLLPHIDNNYEEELNIGEEDVKELRQQLDYLHSSGETNLRDPSEKRGSIQSSSVEECCETDLLSEDDIHCPEETGIEELDGEEPQKELPPKDILASADDLSITTKPLKAVDPSIRNSLSISSCHRSSVLQEPTLSESPKIGNNLRKSMAVPSALLASQNNVSESSESEQCIRESLKHNEHIRSSLRSSKIFPGPTESLAASLQRGLEIIDYHQSSSASNRSSVAFSFEHLMLKPCPEADKANASVQTLPEPSSDGSSTPLLCSSCQRKFDNNPNGVQDSLKTWIVAVDNQQTDGDTTAAANDLAKATEREKELESVCKEQAAKIEQLNNLVEQYKHKGENSAIEHGPESLKNEIIPFEQSNNDENGNEYCDMNEKEALLQETQTLTSKLQSSTAASPNRSSEKLRSSLLSRSIQLRKSVDCRDNSDEELERERQRWMEMESDWISLTDELRMDLESNRCRAEKVEMELKLEKKCTEELDDALSRAVLGHARMVEHYADLQEKYNDLVAKHRAIMEGIAEVKKAAAKAGAKGHGTRFAKSLAAELSALRVEREREKKLLKKENKSLRIQLRDTAEAVHAAGELLVRLREAEQAASVAEENFTNVQQENEKLKKQVEKLKRKHKMEMITMKQYLAESRLPESALKPLYHEDSESAHNSSIPDDDQAWRAEFGAIYQEHY

SEQ ID NO: 5033 - protein, 295 aa, Gossypium hirsutum
MNSSSKESQPNYPTISPDEYTNPFHQQPHMEPAAATAAAPASTSSSPPPPPPEQSEKWGTHIMGTPAVPTCHPDNKKAALWGAGDQAQYYHHPYLQYSPVEKSSNNPMDSMLQVFNTWSHKAETMANNIWHNLKTGPSVSGAAWGKMNVTAKAISGGGFESLYKQTFGTYSNEKLKKSFACYLSTSTGPVAGTLYLSNIHVAFCSDRPLSFTAPSGQETWSYYKVMIPLSKVGIINPVIMRENPSEKYIQIVTVDGHDFWYMGFVNYEKASKHLSESVSSFVATGIAVQPSPVAS

SEQ ID NO: 5034 - protein, 300 aa, Theobroma cacao
MNSSSKESQPLYPSISPPTGEDTNPFHQTVAQEKQPQMQSAAASSSSPSPPPPPPASDPNSEKWGTHIMGAPSVPTCHPDNKKAALWGAGDQAQYHHHPYVQYSPIEKSSNSPMESILQVFNSWSHKTETLANNIWHNLRTGSSVSGAAWGKMNVQAKALTGGGFESLYKQTFATFPNEKLKKSFACYLSTSTGPVAGTLYLSTIHVAFCSDRPLSFTAPSGQETWSYYKVMVPLSKVGIINPVIMRENPSEKYIQIVTVDGHDFWYMGFVNYEKASKHLSESLSNFVASGIAVQPAPVA

SEQ ID NO: 5035 - protein, 63 aa, Gossypium hirsutum
MADKCGNCDCSDKSQCVKKGNALVIETEKSYISTVVVEAVAENDGKCKCGTSCSCTNCTCGNH

SEQ ID NO: 5036 - protein, 63 aa, Gossypium hirsutum
MSDKCGNCDCSDKSQCVKKGNSLVIETEKSYISTVVVEAVAENDGKCKCGDSCSCTNCTCGTH

SEQ ID NO: 5037 - protein, 62 aa, Vaccinium corymbosum
MSDKCGNCDCADKSQCVKKGNSLVIETESYIETFVADAPAAENDGKCKCGTACACVNCTCGH

SEQ ID NO: 5038 - protein, 62 aa, Unknown
  Sequence found in Organisms: Theobroma cacao, Pteridium aquilinum
MSDKCGNCDCADKSQCVKKGNTLVIETEKSYITTVAVETPAENDGKCKCGANCTCTDCTCGH

SEQ ID NO: 5039 - protein, 62 aa, Heritiera littoralis
MSDKCGNCDCADQSQCTKKGNTLVIETEKSYINTVVVEVPAENDGKCKRGANCSCTNCTCGH

SEQ ID NO: 5040 - protein, 617 aa, Theobroma cacao
MDSDFGIPRELSDLQKLRSQYQPGLPPCLEGTTVRVEFGDATTALDPADAHTISRAFPHTYGQPLAHFLRATAKVPDAQIITEHPAMRVGLVFCGRQSPGGHNVIWGLHKALKIHNPNSTLLGFLGGTQGLFAQKTLEITDDILSTYKNQGGYDLLGRTQDQIRTTEQVNAALTACNDLKLDGLVIIGGVTSNTDAAQLAETFAEAKCQTKVVGVPVTLNGDLKNQFVEANVGFDTICKVNSQLISNVCTDALSAEKYYYFIRLMGRKASHVALECTLQSHPNMVILGEEVAASKLTLFDITKQICDAVQARAEQDKNHGVILLPEGLIESIPEVYALLKEIHSLLRQGVSAEKISSQLSPWASALFEFLPPFIRRQLLLHPESDDSAQLSQIETEKLLAHLVETEINKRLKAGTYKGKKFNAICHFFGYQARGSLPSKFDCDYAYVLGHICYHILAAGLNGYMATITNLKNPVNKWRCGAAPIAAMMSVKRWSQNPNALSIGKPAIHPATVDLKGKAYELLRQNAARFLLDDIYRNPGPLQFDGPGADAKAVTLCVEDQDYMGRIKKLQEYLEKVRTIVKPGCSQEVLKAALSVMASVTEVLSVMFSSSSGGQTTL

SEQ ID NO: 5041 - protein, 617 aa, Theobroma cacao
  misc_feature (241)..(241): Xaa can be any naturally occurring amino acid
  misc_feature (250)..(250): Xaa can be any naturally occurring amino acid
MDSDFGIPRELSDLQKLRSQYQPGLPPCLEGTTVRVEFGDATTALDPADAHTITRAFPHTYGQPLAHFLRATAKVPDAQIITEHPAMRVGLVFCGRQSPGGHNVIWGLHKALKIHNPNSTLLGFLGGTQGLFAQKTLEITDDILSTYKNQGGYDLLGRTQDQIRTTEQVNAALTACNDLKLDGLVIIGGVTSNTDAAQLAETFAEAKCQTKVVGVPVTLNGDLKNQFVEANVGFDTICKVXSQLISNVCXDALSAEKYYYFIRLMGRKASHVALECTLQSHPNMVILGEEVAASKLTLFDITKQICDAVQARAEQDKNHGVILLPEGLIESIPEVYALLKEIHSLLRQGVSAEKISSQLSPWASALFEFLPPFIRRQLLLHPESDDSAQLSQIETEKLLAHLVETEINKRLKAGTYKGKKFNAICHFFGYQARGSLPSKFDCDYAYVLGHICYHILAAGLNGYMATITNLKNPVNKWRCGAAPITAMMSVKRWSQNPNALSIGKPAIHPATVDLKGKAYELLRQNAARFLLDDIYRNPGPLQFDGPGADAKAVTLCVEDQDYMGRIKKLQEYLEKVRTIVKPGCSQEVLKAALSVMASVTEVLSVMFSSSSGGQTTL

SEQ ID NO: 5042 - protein, 619 aa, Cucumis melo
MDSDYGIPRQLSDLQKIRSLYQPDLPPCLQGTAVRVEFGDATTAVDPADAPTICRAFPHTYGQPLAHFLRATAKVPDAQIITEHPAIRVGVVFCGRQSPGGHNVIWGLHDALKIHNPNSILFGFLGGSEGLFAQKTLEITDDILSTYKNQGGYDLLGRTKDQIRTKEQVNAALKTCLDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNLVILGEEVAASKLTLFDLTTQICDAVQARAQQDKYHGVILLPEGLIESIPEIYALLKEIHSLLRQGVLVDNISSQLSPWASALFEFLPPFIRKQLLLHPESDDSAQLSQIETEKLLAHLVEAEINKRLKEGTYKGKKFNAICHFFGYQARGSLPSKFDCDYAFVLGHVCYHILAAGLNGYMATLTNLKNPVNKWRCGAAPIAAMMTVKRWAQNPGASSIGKPAIHPATVDLKGKAYELLRQNASQFLMDDLYRNPGPLQFDGPGADAKPVSLCVEDQDYMGRIKKLQEYLDKVRTIVKPGCSQEVLKAALSVMASVTDVLSVMSSSSFSGKASLEG

SEQ ID NO: 5043 - protein, 615 aa, Euonymus alatus
MDSDFGIPRELSDLQKLRSQYQPELPPCLQGTTVRVEFGDATTAQDPADAHTISRSFPHTYGQPLAHFLRATAKVPDAQIIADHPAIRVGIVFCGRQSPGGHNVIWGLHDALKIHNPNSTLLGFLGGSEGLFAQKTLEITDDVLATYKNQGGYDLLGRTRDQIRTTEQVNAALAACNNLKLDGLVIIGGVTSNTDAAQLAETFAETKCPTKIVGVPVTLNGDLKNQFVETNVGFDTICKVNSQLISNVCTDALSAEKYYYFIRLMGRKASHVALECTLQSHPNMVILGEEVAASKLTLFDITKQICDAVQARSDQDKYHGVILLPEGLIESIPEVYALLKEIHGLLRQGVTVDSISSQLSPWASALFEFLPPFIKKQLLLHTESDDSAQLSQIETEKLVAHLVETEMTKRLKEGSYKGKKFNAICHFFGYQARGSLPSKFDCDYAYVLGHISYHILAAGLNGYMATINNLKNPLNKWRCGAAPITAMMTVKRWAQSPGASSIGKPAIHPATVDLKGKAYELLRQNAAKFLIDDIYRNPGPLQFDGPGADAKPVTLCVEDQDYMGRIKELREYLDKVRTIVKPGCSPEVLKAALSVMASVTEVLSVMSSSSNQKIL

SEQ ID NO: 5044 - protein, 617 aa, Malus domestica
MDSDYGIPRELSDLQKLRSQYQPELPPCLQGATVRVEFGDTTTSLDPTDSHTISRYFPHTYGQPLAHFLRATAKVPGAQVITEHPPVRVGVVFCGRQSPGGHNVIWGLHNALKVHNPNNTLLGFLGGSEGLFAQKTLEITDEILATYKNQGGYDLLGRTKDQIRTVEQVNATLTACKDLKLDGLVIIGGVTSNTDAAQLAETFAEAKCSTKVVGVPVTLNGDLKNQFVEANVGFDTICKVNSQLISNMCTDALSAEKYYYFIRLMGRKASHVALECTLQSHPNLVILGEEVAASKLTLFDITTQICDAVEARAAQDKNHGVILLPEGLIESIPEVYALLKEIHGLHRQGVSADKISTQLSPWASALFEFLPPFIKKQVLLLPESDDSAQLSQIETEKLLAHLVEGEMNKRQKEGTYKGKKFNAICHFFGYQARGSLPSKFDCDYAYVLGHIGYHILAAGLNGYMATITNLRNPVNKWRCGAAPLTAMMTVKRWAQNPGTASIGKPAIHPATVDLKGKAYDLLRQNATKFLLDDIYRNPGPLQFDGPGADSKAVSLCVEDQDYMGRIKKLQEYLDKIRTIVKPGCSQEVLKAALSVMASVTEVLSVMSSSPINGQSTL

SEQ ID NO: 5045 - protein, 617 aa, Cajanus cajan
MDSDYGIPRELSDLQKLRSLYQPELPPCLQGTTVRVEFGDATTTADPTDALTISRAFPNTYGHPLAHFLRATAKVPDAQIITEFPPIRVGVVFCGRQSPGGHNVIWGLHNALKIHNSNSVLLGFLGGSEGLFAQKTLEITDSILSTYKNQGGYDLLGRTKDQIRTTEQVNAALAACNNLKLDGLVIIGGVTSNTDAAQLAETFAVAKCPTKVVGVPVTLNGDLKNQFVETNVGFDTICKVNSQLISNVCTDALSAEKYYYFIRLMGRKASHVALECTLQSHPNMVVLGEEVAASKLTLFEITKQITDAVQARAEQDKYHGVILLPEGLIESIPEVYALLKEIHGLLRQGVAVDNISSQLSPWASALFEFLPPFIRRQLLLYPESDDSAQLSQIETEKLLAYLVEVEINKRLKEGTYKGKKFNAICHFFGYQARGSLPSKFDCDYAYVLGHICYHILAAGLNGYMATVTNLKNPVNKWKCGAAPISSMMTVKRWSPNPGATSIGKPAIHPATVDLRGKAYELLRQNAASFLMDDIYRNPGPLQFDGPGADAKVITLSVEDQDYMGRIKKLQEYLEQVRTIVKPGCPQEVLKAALSVMASVTEVLAAMSSSSTHSLSAL

SEQ ID NO: 5046 - protein, 617 aa, Prunus persica
MDSDYGIPRELSDVQKFRSQYQPELPPCLQGATVRVEFGDTTTSLDPTDAHTIGRYFPHTYGQPLAHFLRATAKVPGAQVITEHPPFRVGVVFCGRQSPGGHNVIWGLHNALKVHNPKSTLLGFLGGSEGLFAQKTLEITDEILATYKNQGGYDLLGRTKDQIRTVEQVNATLTACKDLKLDGLVIIGGVTSNTDAAQLAETFAEAKCQTKVVGVPVTLNGDLKNQFVEANVGFDTICKVNSQLISNVCTDALSAEKYYYFIRLMGRKASHVALECTLQSHPNLVILGEEVAASKLTLFDITTQICDAVEARAAQDKNHGVILLPEGLIESIPEVYALLKEIHGLHRQGVSADKISSQLSPWASALFEFLPPFIKKQVLLLPESDDSAQLSQIETEKLVAHLVEVEMNKRVKEGTYKGKKFNAICHFFGYQARGSLPSKFDCDYAYVLGHIGYHILAAGLNGYMATVTNLRNPVNKWRCGAAPITAMMTVRRWSQNPGTASIGKPAIHPATVDLKGKAYELLRQNATKFLLDDIYRNPGPLQFDGPGADSKAVTLCVEDQDYMGRIKKLQEYLDKIRTIVKPGCSQEVLKAALSVMASVTEVLSVMSSSPINGQSSL

SEQ ID NO: 5047 - protein, 617 aa, Vigna unguiculata
MDSDYGIPRELSDLQKIRSLYQPELPPCLQGTTVRVEFGDATTTADPTDAPTIARAFPHTYGHPLAHFLRATAKVPDAQIITEFPPIRVGVVFCGRQSPGGHNVIWGLHNALKIHNSNSVLLGFLGGSEGLFAQKTLEITDSVLSTYKNQGGYDLLGRTKDQIRTTEQVNAALATCNNLKLDGLVIIGGVTSNTDAAQLAETFAVANCPTKVVGVPVTLNGDLKNQFVETNVGFDTICKVNSQLISNVCTDALSAEKYYYFIRLMGRKASHVALECTLQSHPNMVILGEEVAASKLTLFEITKQITDAVQTRAEQDKYHGVILLPEGLIESIPEVYALLKEIHGLLRQGVAVDKISSQLSPWASALFEFLPPFIRRQLLLYPESDDSAQLSQIETEKLLAYLVEAEINKRLKEGTYKGKKFNAICHFFGYQARGSLPSKFDCDYAYVLGHICYHILAAGLNGYMATVTNLKNPVNKWRCGAAPIAAMMTVKRWSPNPGATSIGKPAIHPATVDLRGKAYELLRQKAASFLMDDIYRNPGPLQFDGPGADAKVITLSVEDQDYMGRIKKLQEYLEQVRTIVKPGCPQEVLKAALSVMASVTEVLAAMSTTSTNSLAAL

SEQ ID NO: 5048 - protein, 619 aa, Cucumis sativus
MDSDYGIPRQLSDLQKIRSLYQPDLPPCLQGTAVRVEFGDGTTAVDPADAPTVSRAFPHTYGQRLAHFLRATAKVPDAQIITEHPAIRVGVVFCGRQSPGGHNVIWGLHDALKVHNPNSILFGFLGGSEGLFSQKTLEITDDILTTYKNQGGYDLLGRTKDQIRTKEQVNAALKTCLDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNLVILGEEVAASKLTLFDLTTQICDAVQARAQQDKYHGVILLPEGLIESIPEIYALLKEIHSLLRQGVLVDKISSQLSPWASALFEFLPPFIRKQLLLHPESDDSAQLSQIETEKLLAHLVEAEISKRLKEGTYKGKKFNAICHFFGYQARGSLPSKFDCDYAFVLGHVCYHILAAGLNGYMATLTNLKNPVNKWRCGAAPIAAMMTVKRWAQNPGSSSIGKPAIHPATVDLKGKAYELLRQNANQFLMDDLYRNPGPLQFDGPGADAKPVSLCVEDQDYMGRIKKLQEYLDKVRTIVKPGCSQEVLKAALSVMASVTDVLSVMSSSSFSGKASLEG

SEQ ID NO: 5049 - protein, 617 aa, Eucalyptus grandis
MESDYGIPRELSDLQKHRSLYQPDLPPCLQGTTVRVEFGDATTAADPAGSHTISRSFPHTYGQPLAHFLRATAKVADAQIITEHPAKRVGIVFCGRQSPGGHNVVWGLYSALKIHNPSSVLLGFLGGSEGLFAQKTLEITDEILSTYKNQGGYDLLGRTKDQIRTTEQVNAALTTCKNLKLDGLVIIGGVTSNTDAAQLAETFAEAKCSTKVVGVPVTLNGDLKNPFVETDVGFDTICKVNSQLISNVCTDALSAEKYYYFIRLMGRKASHVALECTLQSHPNMVILGEEVAASKLTLFDLAKQLCDAVQARAEQDKNHGVILIPEGLIESIPEVYSLLKEIHGLLRQGVSVDKISSQLSPWASALFEFLPPFIKKQLLLHPESDDSAQLSQIETEKLLAHLVEVEMNKRLKEGTYKGKKFNAICHFFGYQARGSLPSKFDCDYAYVLGHICYHILAAGLNGYMATVTNLKNPQNKWRCGAAPITAMMTVKRWAQNPNSSFIGKPAIHPATVDLKGKAYELLQQNAVKFLLDDLYRNPGPLQFDGPGADAKPVTLCVEDQDYMGRIKLLQEYLDKVRTIVKPGCSQEVLKAALSSMASVTEVLSVLSTPSSNGMNSL

SEQ ID NO: 5050 - protein, 617 aa, Glycine max
MDSDYGIPRELSDLQKIRSLYQPELPPCLQGTTVRVEFGDATTTADPTDALTISRAFPNTYGHPLAHFLRATAKVPDAQIITEFPPIRVGIVFCGRQSPGGHNVIWGLHNALKIHNPNSVLLGFLGGSEGLFAQKTLEITEDILSTYKNQGGYDLLGRTKDQIRTTEQVNAALAACNNLKLDGLVIIGGVTSNTDAAQLAETFAVAKCPTKVVGVPVTLNGDLKNQFVETNVGFDTICKVNSQLISNVCTDALSAEKYYYFIRLMGRKASHVALECTLQSHPNMVILGEEVAASKLTLSEIAKQITDAVQARAEQDKYHGVILLPEGLIESIPEVYALLKEIHGLLRQGVAVDKISSQLTPWASALFEFLPPFIRRQLLLYPESDDSAQLSQIETEKLLAYLVEVEINKRLKEGTYKGKKFNAICHFFGYQARGSLPSKFDCDYAYVLGHICYHILAAGLNGYMATVTNLKNPVNKWRCGAAPIASMMTVKRWSPNPGATSIGKPAIHPATVDLRGKAYELLRQKAQSFLMDDIYRNPGPLQFDGPGAGAKVITLSVEDQDYMGRIKKLQEYLEQVRTIVKPGCPQEVLKAALSVMASVTEVLAAMSTSSTNTLSAM

SEQ ID NO: 5051 - protein, 615 aa, Castanea mollissima
MDSDYGIPRELSDLQQLRSLYQPELPPCLQGTTVRVEFGDAAAAADPADAHSIARYFPNTYGQPLAHFLRATAKVPDAQIITEHPAFRVGIVFCGRQSPGGHNVVWGLYSALKIHNPKSTLLGFLGGSEGLFAKKTLEITDDILSTYKNQGGYDLLGRTKDQIRTTEQVNSALNACKDLKLDGLVIIGGVTSNTDAAQLAETFAVAKCPTKVIGVPVTLNGDLKNQFVETNVGFDTICKVNSQLISNVCTDALSAEKYYYFIRLMGRKASHVALECTLQSHPNMVILGEEVAASKLTLFDIAAQICDAVQARAEQDKYHGVILLPEGLIESIPEIYALLKEIHSLLRQGISTDNISTQLSPWASALFEFLPPFIKKQLLLYPESDDSAQLSQIETEKLLAHLVEAEMNKRLKEGTYKGKKFNAICHFFGYQARGSLPSKFDCDYAYVLGHICYHMLAAGLNGYLATVTNLKNPVNKWRCAAAPMTAMMTVRRWSQNPGALSIGKPAIHPATVDLRGKAYDLLRQNAARFLMDDIYRNPGPLQFDGPGADAKVVTLCVEDQDYMGRIKKLQEYLDKVRTIVKPGCSQEVLKAALSVMASVTDVLTALASPSTTTSP

SEQ ID NO: 5052 - protein, 619 aa, Cucurbita pepo
MDSDYGIPRQLSDLQKIRSLYQPDLPPCLQGTAVRVEFGDGTTAVDPADAPTVSRAFPHTYGQRLAHFLRATAKVPDAQIITEHPAIRVGVVFCGRQSPGGHNVIWGLHDALKVHNPNSILFGFLGGSEGLFSQKTLEITDDILTTYKNQGGYDLLGRTKDQIRTKEQVNAALKTCLDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNLVILGEEVAASKLTLFDLTTQICDAVQARAQQDKYHGVILLPEGLIESIPEIYALLKEIHSLLKQGVLVDKISSQLSPWASALFEFLPPFIRKQLLLHPESDDSAQLSQIETEKLLAHLVEAEINKRLKEGTYKGKKFNAICHFFGYQARGSLPSKFDCDYAYVLGHVCYHILAAGLNGYMATLTNLKNPVNKWRCGAAPIASMMTVKRWAQNPGASSIGKPAIHPATVDLKGKAYELLRENASKFLIDDLYRNPGPLQFDGPGADAKPISLCVEDQDYMGRIKKLQEYLDKVRTIVKPGCSQEVLKAALSVMGSVTDVLSVMSSSSFSGKASLEA

SEQ ID NO: 5053 - protein, 616 aa, Eucalyptus grandis
MDSDYGIPRELSDLQKQRSLYHPELPPCLQGTTVRVEYGDATTAADPADVHSISRYFPHTYGQPLAHFLRATANVPDALIITEHPPIRVGIVFCGRQSPGGHNVIWGLYHALKIHNPKNVLLGFLGGSEGLFAQKTLEITDDILSTYKNQGGYDLLGRTKDQIRTTEQVNAALISCNDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDITKQICDAVQARAVQEKYHGVILLPEGLIESIPEVYALLKEIHGLLKLGVSADNISSQLSPWASALFEFLPPFIRKQLILFPESDDSAQLSQIETEKLLAHLVEAEMKKRMKEGTYKGKKFNAICHFFGYQARGSLPSKFDCDYAYVLGHICYHILAAGLNGYMATVTNLKNPVNKWRCGAAPIASMMTVKRWAQNPAASSIGKPTIHPATVDLKGKAYELLRQNATKFLMEDVYRNPGPLQFDGPGVDSKPVTLCVEDQDYMGRIKKLQEHLDKVRTIVKPGCSQDVLKAALSIMASVTDVLSVMSMPTSNGSPL

SEQ ID NO: 5054 - protein, 615 aa, Quercus alba
MDSDYGIPRELSDLQQLRSLYHPELPPCLQGTTVRVEFGDAAAAADPADAHSIARYFPNTYGQPLAHFLRATAKVPDAQIITEHPAFRVGIVFCGRQSPGGHNVVWGLYSALKIHNPKSTLLGFLGGSEGLFAKKTLEITDDILSTYKNQGGYDLLGRTKDQIRTTEQVNSALNACKELKLDGLVIIGGVTSNTDAAQLAETFAVAKCPTKVIGVPVTLNGDLKNQFVETNVGFDTICKVNSQLISNVCTDALSAEKYYYFIRLMGRKASHVALECTLQSHPNMVILGEEVAASKLTLFNIAAQICDAVQARAEQDKYHGVILLPEGLIESIPEIYALLKEIHSLLRQGISTDKISTQLSPWASALFEFLPPFIKKQLLLYPESDDSAQLSQIETEKLLAHLVEAEMNKRLKEGTYKGKKFNAICHFFGYQARGSLPSKFDCDYAYVLGHICYHMLAAGLNGYLATVTNLKNPVNKWRCAAAPMTAMMTVKRWSQNPGALSIGKPAIHPATVDLRGKAYDLLRKNAAKFLMDDIYRNPGPLQFDGPGADAKVVTLCVEDQDYMGRIKKLQEYLDKVRTIVKPGCSQEVLKAALSVMASVTDVLTALASPSTTTSP

SEQ ID NO: 5055 - protein, 616 aa, Trigonella foenum-graecum
MDSDYGIPRELSDLQKLRSLYQPELPPCLQGTTVRVEFGDGTTSADPSDEPSISRSFPNTYGHPLAHFLRATAKVPDAQIITEHPPIRVGIVFSGRQSPGGHNVIWGLHSALKIHNPNSVLLGFLGGSEGLFAQKTLEITDDILSTYKNQGGYDLLGRTKDQIRTTEQVNAALAACNNLKLDGLVIIGGVTSNTDAAQLAETFAVAKCPTKVVGVPVTLNGDLKNQFVETNVGFDTICKVNSQLISNVCTDALSAEKYYYFIRLMGRKASHVALECTLQSHPNMVILGEEVAQSKLTLFEISRKISDAVQARAEQDKYHGVILIPEGLIESIPEVYALLKEIHGLLRQGVASEKISSQLSPWASALFEFLPPFIRRQLLLYPESDDSAQLSQIETEKLLAYLVEVEINKRQKEGTYKGKKFNAICHFFGYQARGSLPSKFDCDYAYVLGHISYHILAAGLNGYLATVTNLKNPVNKWKCGAAPISAMMTVKRWSPNPGATSIGKPAIHPATVDLRGKSYELLRQNATSFLMDDIYRNPGPLQFDGPGADAKPITLNVEDQDYMGRIKKLQEYLEQVRTIVKPGCPQEVLKAALSVMGSVTEVLTAMSSSSGNTSSL

SEQ ID NO: 5056 - protein, 612 aa, Tripterygium wilfordii
FGIPRQLSDLQKLRSQYQPELPPCLQGTTVRVEFGDATTAQDPADVHTISRSFPHTYGQPLAHFLRATAKVPDAHIIADHPAIRVGIVFCGRQSPGGHNVIWGLHDALKIHNPNSTLLGFLGGSEGLFAQKTLEITDDVLATYKNQGGYDLLGRTKDQIRTTEQVNAALTACNNLKLDGLVIIGGVTSNTDAAQLAETFAEAKCPTKVVGVPVTLNGDLKNQFVEANVGFDTICKVNSQLISNVCTDALSAEKYYYFIRLMGRKASHVALECTLQSHPNMVVLGEEVAASKLTLFDITKQICDAVQARSDQDKYHGVILLPEGLIESIPEVYALLKEIHGLLQQGVTVDSISSQLSPWASALFEFLPPFIKKQLLLHPESDDSAQLSQIETEKLVAHLVETEMTKRLKEGSYKGKKFNAICHFFGYQARGSLPSKFDCDYAYVLGHISYHILVAGLNGYMATINNLKNPLNKWRCGAAPITAMMTVKRWAQSPGASSIGKPSIHPATVDLKGKAYELLRQNAAKLLVDDIYRNPGPLQFDGPGADAKPVTLCVEDQDYMGRIKELQEYLDKVRTIVKPGCSVEVLKAALSVMASVTEVLSVMSSSPGNHKIL

SEQ ID NO: 5057 - protein, 618 aa, Lotus japonicus
MDSDYGIPRELSDLQKLRSLYQPELPPCLQGTTVRVEFGDATTTADPSDAPAISRAFPHTYGHPLAHFLRATAKVPDAQIITEHPPMRVGIVFCGRQSPGGHNVIWGLHTALKIHNPKSVLLGFLGGSEGLFAQKTLEITDSVLSTYKNQGGYDLLGRTKDQIRTTEQVNAALAACNSLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFEITKQISDAVQARAEQDKYHGVILLPEGLIESIPEVYALLKEIHTLLRQGVAVGKISSQLSPWASALFEFLPPFIRKQLLLYPESDDSAQLSQIETEKLLAYLVEAEINKRQKEGTYKGKKFNAICHFFGYQARGSLPSKFDCDYAYVLGHICSHILAAGLNGYMASLTNLKNPVNKWRCGAAPISSMMTVKRWSPNPGATSIGKPAIHPATVELRGKAYDLLRKNATSFLLDDIYRNPGPLQFEGPGADAKPITLSVEDQDYMGRIKQLQVYLEQVRNIVKPGCPQEVLKAALSAMGSVTEVLSVMTSSAASNGLSSL

SEQ ID NO: 5058 - protein, 617 aa, Glycine max
MDSDYGIPRELSDLQKIRSLYQPELPPCLQGTTVRVEFGDATTTADPTDALTVCRAFPNTYGHPLAHFLRATAKVPDAQIITEFPPIRVGIVFCGRQSPGGHNVIWGIHNALKIHNPNSVLLGFLGGSEGLFAQKTLEITDDILSTYKNQGGYDLLGRTKDQIRTTEQVNAALAACNNLKLDGLVIIGGVTSNTDAAQLAETFVVAKCPTKVVGVPVTLNGDLKNQFVETNVGFDTICKVNSQLISNVCTDALSAEKYYYFIRLMGRKASHVALECTLQSHPNMVILGEEVAASKLTLSEIAKQITDAIQARAEQDKYHGVILLPEGLIESIPEVYALLKEIHGLLRQGVEVDKISSQLTPWASALFEFLPPFIRRQLLLYPESDDSAQLSQIETEKLLAYLVEVEINKRLKEGTYKGKKFNAICHFFGYQARGSLPSKFDCDYAYVLGHICYHILAAGLNGYMATLTNLKNPVNKWKCGAAPIASMMTVKRWSPNPGATSIGKPAIHPATVDLRGKAYELLRQKAQSFLMDDIYRNPGPLQFDGPGADAKVITLSVEDQDYMGRIKKLQEYLEQVRTIVKPGCPQEVLKAALSVMASVTEVLAAMSTSYTNTLASL

SEQ ID NO: 5059 - protein, 617 aa, Populus trichocarpa
MDSDFGIPRELSDLQKLRSLYQPGLPPCLQGTTVRVEFGDVTTCADPADVHAISRAFPHTYGQPLAHFLRATAKVPDAQIITDHPAVRVGIVFCGRQSPGGHNVVWGLQNALKIHNPKSTLLGFLGGSEGFFAQKTLEITDDILETYKNQGGYDLLGRTKDQIRTTEQVRAALTACKDLKLDALVIIGGVTSNTDAAQLAETFAVEKCQTKVVGVPVTLNGDLKNQFVETNVGFDTICKVNSQLISNVCTDALSAEKYYYFIRLMGRKASHVALECTLQSHPNMVILGEEVAASKLTLFDLTKKICDAVQARAEQDKNHGVILLPEGLIESIPEVYALLKEIHSLLKQGVAPDSISSQLSPWASALLEFLPPFIKRELLLHPESDDSAQLSQIETEKLLAHLVEAEMNRRLKEGTYKGKKFNAICHFFGYQARGSLPSKFDCDYAYVLGHICYHILAAGLNGYMATVSNLKNPSNKWRCGAAPITAMMTVKHWAQSPGASSIGKPAIHPATVDLKGKAYELLRVNAGRFLMEDLYRNPGPLQFDGPGADSKAVSLSVEDADYMGRIKKLQEYLDKVRNIVKPGCSQDVLKAALSVMSSVTEVLSVMSSTSSSGLTTL

SEQ ID NO: 5060 - protein, 616 aa, Medicago truncatula
MDSDYGIPRELSDLQKLRSLYQPELPPCLQGTTVRVEFGDGTTTADPADEPTISRSFPNTYGHPLAHFLRATAKVPDAQIITEHPPIRVGIVFSGRQSPGGHNVIWGLHSALKIHNPKSVLLGFLGGSEGLFSQKTLEITDDILSTYKNQGGYDLLGRTKDQIRTTEQVNAALATCNNLKLDGLVIIGGVTSNTDAAQLAETFAVAKCPTKVVGVPVTLNGDLKNQFVETNVGFDTISKVNSQLISNVCTDALSAEKYYYFIRLMGRKASHVALECTLQSHPNMVILGEEVAQSKLTLFEISRKIADAVQARSEQDKYHGVILIPEGLIESIPEVYALLKEIHGLLRQGVDVEKIASQLSPWASALFEFLPPFIRRQLLLYPESDDSAQLSQIETEKLLAYLVEVEINKRQKEGTYKGKKFNAICHFFGYQARGSLPSKFDCDYAYVLGHICYHILAAGLNGYLATVTNLKNPVNKWKCGAAPISAMMTVKRWSPNPGATSIGKPAIHPATVDLRGKAYELLRQNATSFLMDDIYRNPGPLQFDGPGADAKPITLNVEDQDYMGRIKKLQEYLEQVRTIVKPGCPQEVLKAALSVMGSVTEVLTAMSSSSGNTSSL

SEQ ID NO: 5061 - protein, 617 aa, Manihot esculenta
MDSDFGIPRELSELQKLRSLYQPDLPPCLQGTTVRVEFGDGTTAADAAGAHTISRSFPHTYGQPLAHFLRATTKVPDAHIITEHPAMRVGIVFCGRQSPGGHNVIWGLLSALKIHNPNSNLLGFLGGSEGLFAQKTLEITDEVLATYKNQGGYDLLGRTKDQIRTTEQVNAALATCKDLKLDGLVIIGGVTSNTDAAQLAETFADAKCPTKVVGVPVTLNGDLKNQFVETNVGFDTICKVNSQLISNVCTDALSAEKYYYFIRLMGRKASHVALECTLQSHPNMVILGEEVASSKLTLFDLTKQICDAVQARAEQDKYHGVILLPEGLIESIPEIYALLKEIHGLLRQGVPPNNISSQLSPWASALFEFLPPFIKKQLLLHPESDDSAQLSQIETEKLLAHLVEVEMSKRLKEGTYKGKKFNAICHFFGYQARGSVPSKFDCDYAYVLGHICYHILAAGLNGYMATVTNLKNPVNKWRCGAAPITAMMTVRHWAQSPGATSVGKPAIHPAAVDLKGKAYELLRENAMQFLMDDLYRNPGPLQFEGPGADAKPLTLCVEDQDYMGRIKKLQEYLDQVRTIVKPGCSQEVLKAALSVMASVTDVLSAMSSTSFNSQTPL

SEQ ID NO: 5062 - protein, 617 aa, Vinca minor
MDSDYGIPRELSDLQRLRSQYKPELPPCLQGSTVRVEFSDATITADSMGAHTISRAFPHTYGQPLVHFLRVTAQVPAAQVITEHPSIRVGLVFCGRQSPGGHNVIWGLYEAIKGHNPNSTLLGFLGGSDGLFAQKTLEITDDVLATYKNQGGYDLLGRTKDQIRTTEQVNAAMAACKALKLDGLVVIGGVTSNTDAAYLAETFAEAKCPTKVVGVPVTLNGDLRNQFVETNVGFDTICKVNSQLISNVCTDALSAEKYYYFIRLMGRKASHVALECTLQSHPNMLILGEEVAASKLTLFDITKQICDAVQDRAEQDKYHGVILLPEGLIESIPEVYALLKEIHGLLRQGVSSDNISSQLSPWASALFEFLPPFIKKQLLLYPESDDSAQLSQIETEKLLAHLVEEEMNKRLKEGTYKGKKFNGICHFFGYQARGSLPSKFDCDYAYVLGHICYHILAAGLNGYMATVTNLKNPLNKWRCGAAPITAMMTVKRYGHGLGALHVGKPALHPATVDLKGKAYELLRQNATKFLLDDVYRNPGPLQFDGPGADSKAVTLCVEDQDYMGRIKQLQEYLDKVRTIVKPGCSQDVLKAALSAMASVTDILSVMSSPSNGGHTPF

SEQ ID NO: 5063 - protein, 616 aa, Tropaeolum majus
MDSDFGIPRELSDLQKLRSLYHPELPPCLQGTTVRVEFGDGTTPSDPADGHIIARAFPHTYGQPLAHFLRKTAKVPDAQIINEHPEKRVGILFCGRQSPGGHNVIWGLHDALKTHNPKSTLLGFLGGSEGLFAQKTLEITDDILSTYQNQGGYDMLGRTKDQIRTTEQVKAALSACQNLKLDSLIIVGGVTSNTDAAQLAETFAEANCPTKVVGVPVTLNGDLKNSFVETNVGFDTICKVNSQLISNVCTDALSAEKYYYFVRLMGRKASHVALECTLQSQPNMVILGEEVAASKLTLFDLTTQICDAVQARAEQDKNHGVILLPEGLIESIPEVYALLKEIHGLLRLGVSIDMISSQLSPWAAALFEFLPPFIKKQLLLYPESDDSAQLSQIETEKLLAHLVEAEMNKRQKEGKYTGKKFNSICHFFGYQARGSLPSKFDCDYAYVLGHICYHILVAGLNGYMATVTNLKNPVNKWKCGAAPITAMMTVKHWSESPGSTSIGKPAIHPSTVDLKGKAYDLLRQNAQKFLLDDLYRNPGPLQFEGPGADAKPVTLCVEDQDYMGRIKKLQEYLDKVRTIVKPGCSQEVLKAALSVMGSVTEVLAAMSSPSGNLSYH

SEQ ID NO: 5064 - protein, 617 aa, Euphorbia peplus
MDSDFGVPRELSGLQKLRSLYQPELPPCLEGTTVRVEFGDTTTAADAADAHTISRSFPHTYGQPLAHFLRKTAKVADAHIITEHPVKRVGIVFCGRQSPGGHNVIWGLHHALKTHNPKNILLGFLGGSEGLFAQKTLEITDDVLATYKNQGGYDLLGRTKDQIKTTEQVNAALATCNNLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDLTTQICDAVQARAAQDKYHGVVLLPEGLIESIPEVYALLKEIHSLLRQGINSNNISSQLSPWASALFEFMPLFIKKQLLLYPESDDSAQLSQIETEKLLAHLVEVEMNRRQKEGTYKGKKFNAICHFFGYQARGSVPSKFDCDYAYVLGHVCYHILAAGLNGYMATITNLKNHVNKWRCGAAPIAAMMTVRRWAQSPGATSIGKPAIHPATVDLKGKAYELLRLNAHKFLVDDLYRNPGPLQFDGPGADSKPLTLCVEDQDYMGRIKKLQEYLDQVKTIVKPGCSQDVLKAALSVMGSVTEVLTTMSSNSLNGHSTL

SEQ ID NO: 5065 - protein, 616 aa, Amsonia hubrichtii
MDSDYGIPRELSDLQKLRAQYKPELPPCLQGTTVRVELGDATTAADSVGAHTISRSFPHTYGQPIAHFLRATAKVPAAQIITEHPVIRVGLVFCGRQSPGGHNVIWGLHDAIKGHNPNSTLLGFLGGSEGLFAQKTLEITDDVLASYKNQGGYDLLGRTKDQIRTTEQVHDAMAACNALKLDGLVVIGGVTSNTDAAYLAETFAEAKCPTKVVGVPVTLNGDLKNQFVEANVGFDTICKVNSQLISNVCTDALSAEKYYYFIRLMGRKASHVALECTLQSHPNMVILGEEVSANKLTLFDITKQICDAVQARAEQDKNHGVILLPEGLIESIPEVYALLKEIHGLLKQGVSIDKISTQLSPWASALFEFLPPFIKKEVLLYPESDDSAQLSQIETEKLLAHLVEEEMNKRLKEGTYKGKKLNGICHFFGYQARGSLPSKFDCDYAYVLGHICYHILAAGLNGYLATVTNLKNPLNKWRCGAAPITAMMTVKRYGRGPGASYIGKPALHPAIVDLKGKAYELLRQNATKFLLDDVYRNPGPLQFDGPGADSKAVSLCVEDQDYMGRIKQLQEHLDMVRTIVKPGCSQDVLKAALSAMSSVTDILSVMSSPSNSGTPF

SEQ ID NO: 5066 - protein, 617 aa, Chelidonium majus
MDSDFGIPRELSDLQKHRSLYQPELPPCLQGTTVRVELGDATTATDLSSSNIISRGFPHTYGQPLVHFFRANAQVPDAKIITEHPVVRVGLVFCGRQSPGGHNVVWGLHDALKAHNPKNTLLGFLGGSEGLFAQKTLEITDDVLSTYKNQGGYDMLGRTKDQIRTTEQVNAALATCKALKLDGLVIVGGVTSNTDAAQLAETFAEAKCSTKVVGVPVTLNGDLKNQFVETDVGFDTICKVNSQLISNLCTDALSAEKYYYFVRLMGRKASHVALECTLQSHPNMVILGEEVASSKLTIFDITKQICDAVQARAEQDMNHGVILLPEGLIESIPEVYALLQEIHSLHRQGVSIDNISSQLSPWASALFEFLPLFIKKQLLLHPESDDSAQLSQIETEKLLAHLVETEMSKRLKEGTYKGKKFNAICHFFGYQARGSLPSKFDCDYAYVLGHICYHILAAGLNGYMATVTNLKNPSNKWRCGAAPITAMMTVKRWARGPGTSLIGKPAVHPATVDLKGKAYELLRENASTFLLDDVYRNPAPLQFDGPGADSKTMTLCVEDQDYMGRIKKLQEYLDKVRNIVKPGCSQDVLKAALSSMASVTEVLSIMSTPSFSGSAPL

SEQ ID NO: 5067 - protein, 613 aa, Manihot esculenta
MAFPENFPTFKNSDLFTSQSSPPCLQGTAVRVEFGDATTAADAAGSHTISRSFPHTYGQPLAHFLRATAKVPDAHIITEHPATRVGIVFCGRQSPGGHNVIWGLHNALKIHNPNNSLFGFLGGSEGLFAQKTIEITDDILSTYKNQGGYDLLGRTKDQIRTTEQVNAALTTCKDLKLDGLVIIGGVTSNTDAAQLAETFAEAKCPTKVVGVPVTLNGDLKNQFVETNVGFDTICKVNSQLISNVCTDALSAEKYYYFIRLMGRKASHVALECTLQSHPNMVILGEEVAASKLTLFDLTKQICDAVQARAEQDKYHGVILLPEGLIESIPEVYALLKEIHGLLRQGVIPNNISSQLSPWASALFEFLPPFIKKQLLLYPESDDSAQLSQIETEKLLAHLVEAEMSKRLKEGTYKGKKFNAICHFFGYQARGSVPSNFDCDYAYVLGHICYHILAAGLNGYMATVTNLKNPVNKWRCGAAPITAMMTVKRWAQSPGATSIGKPAIHPSTVDLKGKAYELLRQNAMKFLMDDLYRNPGPLQFEGPGADAKPLTLCVEDQDYMGRIKELQEYLDKVRTIVKPGCSQEVLKAALSVMASVTDVLSTMSSTSFNSQTPL

SEQ ID NO: 5068 - protein, 619 aa, Raphanus sativus
  misc_feature (293)..(293): Xaa can be any naturally occurring amino acid
  misc_feature (417)..(417): Xaa can be any naturally occurring amino acid
  misc_feature (595)..(595): Xaa can be any naturally occurring amino acid
  misc_feature (609)..(609): Xaa can be any naturally occurring amino acid
MDSDFGIPRELSPLQQLRSQYQPELPPCLQGTAVRVEFGDGTTVSEASDSHIIARAFPHTLGQPLAHFLRETAKVPDAQIITQLPSIRVGIVFCGRQAPGGHNVIWGLYEALKMHNAKSTLLGFLGGSEGLFAQKTLEITDDILQTYKNQGGYDLLGRTKDQIRTTEQVNAALKACTDLKLDGLVIIGGVTSNTDAAHLAEFFAEAKCSTKVVGVPVTTNGDLKNQFVEANVGFDTICKVNSQLISNACTDALSAEKYYYFIRLMGRKHSHVALECTLQSHPNMVILGEEVAXSKLTIFDISKQICDAVQARAGQDKNHGVILIPEGIIESIPEVYALLKEIHGLLREGVAADKISTQLSPWSSALFEFLPPFIKKQLLLHPESDDSAQLSQIETEKLLAYLVETEMNKRLKEGTYXGKKFNAICHFFGYQARGSLPSKFDCDYAYVLGHICYHILAAGLNGYMATVSNLKSPVNKWKCGAAPITAMMTVKNWSQNASSTSTSIGRPAIHPAMVDLKGKAYELLRQNADKFLMEDLYRNPGPLQYDGPGADAKAVSLCVEDQDYMGRIKKLQEYLDQVRTIVKPGCSQDVLKAAXSVMASVTDVLTTIXSSSNAGQQFA

SEQ ID NO: 5069 - protein, 617 aa, Brassica napus
MDSDFGIPRELSPLQQIRSQYLPQLPPCLQGTTVRVEFGDGTTVAKAGDAHIIARAFPHTLGQPLAHFLRATAKVPDAQIITEHPAIRVGIVFSGRQAPGGHNVIWGLYEALKVHNAKNTLLGFLGGSEGLFAQKALEITDDVLQTYKNQGGFDLLGRTKDQIRTTEQVNAALKACTDLKLDGLVIIGGVTSNTDAAHLAEFFAEAKCSTKVVGVPVTINGDLKNQFVEANVGFDTICKVNSQLISNVCTDALSAEKYYYFVRLMGRKHSHVALECTLQSHPNMVILGEEVTASKLTIFDITKQICDAVQARAGQDKNHGVILIPEGIVESIPELYALLKEIHGLLKEGVHADNISTKLSPWSSALFEFLPPFIKKQLLLHPESDDSAQLSQIETEKLLAYLVETEMNKRTKEGTYKGKKFNAICHFFGYQARGSLPSKFDCDYAYVLGHICYHILAAGLNGYMATVTNLKSPVNKWKCGAAPMTAMMTVKRWSQNCGSTSIGRPAIHPATVDLKGKAYELLRQNEQKFLMEDMYRNPGPVQYDGPGADVKAVTLCVEDQDYMGRIKKLQEYLDQVRTLVKPGCSQDVLKAALSVMASVTDVLSTISSSSTSGQQFA

SEQ ID NO: 5070 - protein, 617 aa, Brassica napus
MDSDFGIPRELSPLQQLRSQYQPQLPPCLQGRTVRVEFGDGTTVAKSGDSHIIARAFPHTLGQPLAHFLRATAKVPDAQIITEHPAIRVGIVFSGRQAPGGHNVIWGLYEALKVHNAKNTLLGFLGGSEGLFAQKTVEITDEVLQTYKNQGGFDLLGRTKDQIRTTEQVNAALKACTYLKLDGLVIIGGVTSNTDAAHLAEFFAEAKCSTKVVGVPVTINGDLKNQFVEANVGFDTICKVNSQLISNVCTDALSAEKYYYFVRLMGRKHSHVALECTLQSHPNMVILGEEVTASKLTIFDITKQICDAVQARAGQDKNHGVILIPEGIVESIPELYALLKEIHGLLKEGVHADNISTQLSPWSSALFEFLPPFIKKQLLLHPESDDSAQLSQIETEKLLAYLVETEMNKRTKEGTYKGKKFNAICHFFGYQARGSLPSKFDCDYAYVLGRICYHILAAGLNGYMATVTNLKSPVNKWKCGAAPMTAMMTVKRWSQNSGSTSIGRPAIHPATVDLKGKAYELLRQNAQKFLMEDMYRNPGPVQYDGPGADAKAVSLCVEDQDYMGRIKKLQEYLDQVRTLVKPGCSQDVLKAALSVMASVTDVLSTISSSSTSGQQFA

SEQ ID NO: 5071 - protein, 617 aa, Arabidopsis lyrata
MDSDFGIPRELSPLQQLRSQYHPELPPCLQGTTVRVELGDGTTVAKAGDAHIIARAFPHTLGQPLAHFLRATAKVPDAQIITEHPAKRVGIVFSGRQAPGGHNVVWGLYEALKVHNAKNTLLGFLGGSEGLFAQKTLEITEDVLQTYKNQGGYDMLGRTKDQIRTTEQVNAALKACTDLKLDGLVIIGGVTSNTDAAHLAEFFAEAKCPTKVVGVPVTINGDLKNQFVEANVGFDTTCKVNSQLISNICTDALSAEKYYYFVRLMGRKHSHVALECTLQSHPNMVILGEEVTASKLTIFDIIKQICDAVQARAEQDKNHGVILIPEGLVESIPELYALLKEIHGLLKEGVQADNISTQLSPWSSALFEFLPPFIKKQLLLHPESDDSAQLSQIETEKLLAYLVETEMNKRLKEGTYKGKKFNAICHFFGYQARGSLPSKFDCDYAYVLGHVCYHILAAGLNGYMATVTNLKSPVNKWKCGAAPILAMMTVKRWSQNSGSTSIGKPVIHPASVDLKGKAYDLLRQNAQKFLMEDMYRNPGPVQYDGPGADAKAVSLCVEDQDYMGKIKKLQEYLDQVRTIVKPGCSQDVLKAALSVMASVTDVLTTISSSSTSGQQFA

SEQ ID NO: 5072 - protein, 614 aa, Arabidopsis thaliana
MDSDFGIPRELSPLQQLRSQYKPELPPCLQGTTVRVELGDGTTVAEAADSHTMARAFPHTLGQPLAHFLRETAQVPDAHIITELPSVRVGIVFCGRQAPGGHNVIWGLFEALKVHNAKSTLLGFLGGSEGLFAQKTLEITDDILQTYKNQGGYDLLGRTKDQIKTTEQVNAALKACTDLKLDGLVIIGGVISNTDAAHLAEFFAAAKCSTKVVGVPVTTNGDLKNQFVEANVGFDTICKVNSQLISNACTDALSAEKYYYFIRLMGRKHSHVALECTLQSHPNMVILGEEVAASKLTIFDIAKQICDAVQARAVEDKNHGVILIPEGLIVSIPEVYALLKEIHGLLRQGVSADKISTQLSPWSSALFEFLPPFIKKQLLLHPESDDSAQLSQIETEKLLAYLVETEMNKRLKEGTYKGKKFNAICHFFGYQARGSLPSKFDCDYAYVLGHICYHILAAGLNGYMATVTNLKSPVNKWKCGATPITAMMTVKHWSQDASYTLTSIGRPAIHPAMVDLKGKAYDLLRQNAQKFLMEDLYRNPGPLQYDGPGADAKAVSLCVEDQDYMGRIKKLQEYLDQVRTIVKPGCSQDVLKAALSVMASVTDVLTTISSNGGQ

SEQ ID NO: 5073 - protein, 614 aa, Arabidopsis lyrata
MDSDFGIPRELSPLQQLRSQYHPELPPCLQGTTVRVELGDGTTVAEAADSHTMARAFPHTLGQPLAHFLRETAQVADAHIITELPSVRVGIVFCGRQAPGGHNVIWGLFEALKVHNTKSTLLGFLGGSEGLFAQKTLEITDDILQTYKNQGGYDLLGRTKDQIKTTEQVNAALKACTDLKLDGLVIIGGVISNTDAAHLAEFFAAAKCPTKVVGVPVTTNGDLKNQFVEANVGFDTICKVNSQLISNACTDALSAEKYYYFIRLMGRKHSHVALECTLQSHPNMVILGEEVSASKLTIFDIAKQICDAVQARAVEDKNHGVILIPEGLIVSIPEVYALLKEIHGLLRQGVAADKISTQLSPWSSALFEFLPPFIKKQLLLHPESDDSAQLSQIETEKLLAYLVETEMNKRLKEGTYKGKKFNAICHFFGYQARGSLPSKFDCDYAYVLGHICYHALAAGLNGYMATVTNLKSPVNKWKCGAAPITAMMSVKHWSQDASYTLTSIGRPAIHPAMVDLKGKAYDLLRQNAQKFLMEDLYRNPGPLQYDGPGADAKAVSLCVEDQDYMGRIKKLQEYLDQVRKIVKPGCSQDVLKAALSVMASVTDVLTTISSTGGQ

SEQ ID NO: 5074 - protein, 617 aa, Arabidopsis thaliana
MDSDFGIPRELSPLQQLRSQYHPELPPCLQGTTVRVELGDGTTVAKAGDAHIIARAFPHTLGQPLAHFLRATAKVADAQIITEHPVKRVGIVFCGRQAPGGHNVVWGLYEALKVHNAKNTLLGFLGGSEGLFAQKTLEITDEVLQTYKNQGGYDMLGRTKDQIRTTEQVNAALKACTDLKLDSLVIIGGVTSNTDAAHLAEFFAEAKCSTKVVGVPVTINGDLKNQFVEANVGFDTTCKVNSQLISNICTDALSAEKYYYFVRLMGRKHSHVALECTLQSHPNMVILGEEVTASKLTIFDIIKQICDAVQARAEQDKNHGVILIPEGLVESIPELYALLKEIHGLLKEGVQVDNISTQLSSWSSALFEFLPPFIKKQLLLHPESDDSAQLSQIETEKLLAYLVETEMNKRLKEGTYKGKKFNAICHFFGYQARGSLPSKFDCDYAYVLGHVCYHILAAGLNGYMATVTNLKSPVNKWKCGAAPISAMMTVKRWSQNSGSTTIGRPVIHPASVDLKGKAYDLLRQNAQKFLMEDMYRNPGPVQYDGPGADAKAVSLCVEDQDYMGKIKKLQEYLDQVRTIVKPGCSQDVLKAALSVMASVTDVLTTISSSSTSGQQFA

SEQ ID NO: 5075 - protein, 612 aa, Vinca minor
IRRELSDLQKLRSQYKPDLPPCLQGSTVRVELSDATITADSMGAHTISRAFPHTYGQPLVHFLSATAQVPAAQVISEHPSIRVGLVFCGRQSPGGHNVIWGLYDAIKGHNPNSTLLGFLGGSEGLFAQKTLEITDDVLATYKNQGGYDLLGRTKDQIRTTEQVNAAMAACKTLKLDGLVVIGGVTSNTDAAYLAETFAEAKCPTKVVGVPVTLNGDLRNQFVETNVGFDTICKVNSQLISNICTDALSAEKYYYFIRLMGRKASHVSLECTLQSHPNMLILGEEVAASKLTLFCTSQNKFSDAVQDRAEQDKYHGVILLPEGLIESIPEVYALLKEIHGLLRQGVSSDNISSQLSPWTSALFEFLPPFIKKQVLLYPESDDSAQLSQIETEKLLAHLVEEEMNKRLKEGTYKGKKFNGICHFFGYQARGSLPSKFDCDYSYVLGHICYHILAAGLNGYMATVTNLKNPLNKWRCGAAPITAMMTVTRYGHGPGALHLGRPALHPATVDLKGKAYELLRQNATKFLLDDVYRNPGPLQFDGPGADSKAVTLCVEDQDYMGRIKQLQDYLDKVRTIVKPGCSQDVLKAALSAMSSVTDILSVMSSPSNSSHTPF

SEQ ID NO: 5076 - protein, 616 aa, Setaria italica
MDSDYGVPRELSEVQKKRALYQPEVPPCLQGTTVRVEYGDAAIAADPAGAHVISQAFPHTYGQPLAHFLRKTAVVPDAKVISEHPAVRVGIVFCGRQSPGGHNVIWGLYEAIKAHNQNSKLIGFLGGSDGLLAQKTLEITDEVLSSYKNQGGYDMLGRTKDQIRTTEQVKGAMASCQALKLDALVIIGGVTSNTDAAQLAETFAEAKCATKVVGVPVTLNGDLKNQFVETTVGFDTICKVNSQLISNMCTDALSAEKYYYFIRLMGRKASHVALECSLQSHPNMVILGEEVAASKLTIFDITKQICDAVQARAEKDKNHGVVLIPEGLVESIPELYALLQEIHGLHGKGVSAENISSQLSPWASALFEFLPPFIGKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISAMMTVKQWSRGPSAAQIGKPAVHMASVDLKGKAYELLRQNSSSFLLEDIYRNPGPLQFEGPGADSKPISLCVEDQDYMGRIKKLQEYLEKVKSIVKPGCSQDVLKAALSAMSSVTETLNIMTSSSTGQAPL

SEQ ID NO: 5077 - protein, 616 aa, Pennisetum glaucum
MDSDYGVPRELSEVQKKRTLYQPEVPPCLQGTTVRVEYGDVAIAADPAGAHVISHAFPHTYGQPIAHFLRKTAVVPDAKVISEHPAVRVGIVFCGRQSPGGHNVIWGLYEAIKAHNQNSKLIGFLGGSDGLLAQKTLEITDEVLSSYKNQGGYDMLGRTKDQIRTTEQVNGAMASCQALKLDALVIIGGVTSNTDAAQLAETFAEAKCATKVVGVPVTLNGDLKNQFVETTVGFDTICKVNSQLISNMCTDALSAEKYYYFIRLMGRKASHVALECSLQSHPNMVILGEEVAASKLTIFDITKQICDAVQARAEKDKNHGVVLIPEGLVESIPELYALLQEIHGLHGKGVSAENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISSMMTVKRWSRGPSAAQIGKPAVHMASVDLKGKAYELLRKNSSSFLLEDIYRNPGPLQFEGPGADSKPISLCVEDQDYMGRIKKLQEYLDKVKSIVKPGCSQDVLKAALSAMSSVTETLNIMTSSSTGQTPL

SEQ ID NO: 5078 - protein, 617 aa, Panicum virgatum
MDSDYGVPRELSEVQKKRALYQPEVPPCLQGTTVRVEYGDAAIAADPAGAHVISQAFPHTYGQPLAHFLRKTAVVPDAKVISEHPAVRVGIVFCGRQSPGGHNVVWGLYEAIKAHNQSSKLVGFLGGSDGLLAQKTLEITDEVLSSYKNQGGYDMLGRTKDQIRTKEQVNGAMASCQALKLDALVIIGGVTSNTDAAQLAETFAEAKCATKVVGVPVTLNGDLKNQFVETTVGFDTICKVNSQLISNVCTDALSAEKYYYFIRLMGRKASHVALECTLQSHPNMVILGEEVAASKLTIFDITKQICDAVQARADKDKNHGVILIPEGLVESIPELYALLQEIHGLHGRGVSAENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISSMMTVKRWSRGPSATQIGKPAVHMASVDLKGKAYELLRQSSSSFLLEDIYRNPGPLQFEGPGADSKPISLCVEDQDYMGRIKKLQEYLEKVKSIVKPGCSQDVLKAALSAMASVTETLNIMTSSSTGQTQLS

SEQ ID NO: 5079 - protein, 617 aa, Oryza sativa
MDSDYGVPRELSEVQKKRALYQPELPPCLQGTTVRVEYGDAAIAADPAGAHVISHAFPHTYGQPLAHFLRKTANVPDATVISEHPVVRVGVVFCGRQSPGGHNVIWGLHEAIKAHNPNSKLIGFLGGSDGLLAQKTLEITDEVLSSYKNQGGYDMLGRTKDQIRTTEQVNGAMASCQALKLDALVIIGGVTSNTDAAQLAETFAEAKCATKVVGVPVTLNGDLKNQFVETTVGFDTICKVNSQLISNVCTDALSAEKYYYFIRMMGRKASHVALECALQSHPNMVILGEEVAASKLTIFDITKQICDAVQARAEKDKYHGVVLIPEGLVESIPELYALLQEIHGLHGKGVSMENISSQLSPWASALFEFLPPFIRKQLLLHPESDDSAQLSQIETEKLLAQLVEDEMNRRMKEGTYKGKKFNAICHFFGYQARGSLPSKFDCDYAYVLGHVCYHILAAGLNGYMATVTNLKSPANKWRCGAAPISSMMTVKRWSRGPAATQIGKPAVHMATVDLKGKAFELLRNNSTSFLIDDIYRNPGPLQFEGAGADSKPISLCVEDQDYMGRIKKLQEYLEKVKSIVKPGCSQDVLKAALSAMSSVTETLAIMTSSSTGQGTPL

SEQ ID NO: 5080 - protein, 616 aa, Sorghum bicolor
MDSDYGVPRELSEVQKKRALYQPELPPCLQGTTVRVEYGDAAIAADPAGAHVISHVFPHTYGQPLAHFLRKTAVVPDAKVISEHLAVRVGIVFCGRQSPGGHNVVWGLYEAIKAHNQNSKLIGFLGGSDGLLAQRTLEITDEVLASYKNQGGYDMLGRTKDQIRTTEQVNGAMASCQALKLDALVIIGGVTSNTDAAQLAETFAEAKCATKVVGVPVTLNGDLKNQFVETTVGFDTICKVNAQLISNMCTDALSAEKYYYFIRLMGRKASHVALECALQSHPNMVILGEEVAASKLTIFDITKQICDAVQARAEKDKNHGVILIPEGLVESIPELYALLQEIHGLHGQGVSVENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISSMMTVKRWSRGPSATQIGKPAVHMASVDLKGKAYDVLRQNSSSFLLEDVYRNPGPLQFEGPGADSKPISLCVEDQDYMGRIKKLQEYLEKVKSIVKPGCSQDVLKAALSAMSSVTETLNIMTSSSAGQTLL

SEQ ID NO: 5081 - protein, 616 aa, Saccharum officinarum
MDSDYGVPRELSEVQKKRALYQPELPPCLQGTTVRVEYGDAAIAADPAGAHVISHVFPHTYGQPLAHFLRKTAVVPDAKVISEHLAVRVGIVFCGRQSPGGHNVVWGLYEAIKAHNQNSKLIGFLGGSDGLLAQRTLEITDEVLASYKNQGGYDMLGRTKDQIRTTEQVNGAMASCQALKLDALVIIGGVTSNTDAAQLAETFAEAKCATKVVGVPVTLNGDLKNQFVETTVGFDTICKVNAQLISNMCTDALSAEKYYYFIRLMGRKASHVALECALQSHPNMVILGEEVAASKLTIFDITKQICDAVQARAEKDKNHGVILIPEGLVESIPELYALLQEIHGLHGQGVSVENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISSMMTVKRWSRGPSATQIGKPAVHMASVDLKGKAYDVLRQNSSSFLLEDVYRNPGPLQFEGPGADSKPISLCVEDQDYMGRIKKLQEYLEKVKSIVKPGCSQDVLKAALSAMSSVTETLNIMTSSSNGQTPL

SEQ ID NO: 5082 - protein, 617 aa, Zostera marina
MSSNYGIQRDIPDLQKKRALYQPELPPCLQGTDVRVEFGDGTTTADLTGHHVISHSFPCTYGQPLAHFLRPTAKVADAQIITEHPTIRVGFVFSGRQSPGGHNVVWGLYNALRIHNPNSSLFGFIGGTEGLFAQKFLKITEEVLSTYKNQGGYDMLGRTQDQIRTTEQVNAAMASCQTLKLNGLVIVGGVTSNTDAAQLAETFASAKCPTKVVGVPVTLNGDLKNQFVETNVGFDTICKVNSQLISNICTDALSAEKYYYFVRLMGRKASHVALECTLQSHPNMVILGEEVSSAKLTLFDITTQICDAVQERAEHGKSHGVVLIPEGLVETVPELYALLQEIHGLQKNGVPTDNISKQLSPWASALFKFLPPFFRRQLLLLPESDESAQLSQIEMEKLLAQLVETEINKRLKAGIYKGKKFNAICHFFGYQARGSLPSKFDSDYAYVLGHICYHILAAGLNGYMATITNLKNPVNKWKCGAAPITAMMTVKQWSYGPRTNSIGKPAIHPATVDLRGKAYELLRQNAANYLIDDDYRNPGPLQFEGPGSDAKAFTLCVEDQDYMGRIKKLQSYLDKVKTIVKPGCSQDVLVAALSSMSSVIDVLSVMTAPSYSGQSYL

SEQ ID NO: 5083 - protein, 617 aa, Oryza sativa
MDSDYGVPRELSALQKARALYRPDLPPCLQGTTVKVEYGDAAIAADVAGAHVISHAFPHTYGQPLAHFLRKTAAVPDATVITEHPVVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQLLLHPESDDSAQLSQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 5084 - protein, 618 aa, Zea mays
MDSDYGVPRELSEVQKKRTLYQPELPPCLQGTTVRVEYGDAAIAADPAGAHVISHAFPHTYGQPIAHFLRKTAVVPDAKVISEHQAVRVGIVFCGRQSPGGHNVVWGLYEAIKAHNQNSKLIGFLGGSDGLLAQRTLEITDKVIASYKNQGGYDMLGRTKDQIRTTEQVNGAMASCQALKLDALVIIGGVTSNTDAAQLAETFAEAKCATKVVGVPVTLNGDLKNQFVETTVGFDTICKVNAQLISNVCTDALSAEKYYYFIRLMGRKASHVALECALQSHPNMVILGEEVAASKLTIFDITKQICDAVQARAEKDKNHGVILIPEGLVESIPELYALLQEIHGLHGKGVSVENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNSYMATVTNLKNPVNKWRCGATPISSMMTVKRWSRGPSATQIGKPAVHMASVDLKGKAYDVLRQNSSSFLLEDVYRNPGPLQFEGPGADSKPISLCVEDQDYMGRIKKLQEYLEKVKRIVKPGCSQDVLKAALSAMSSVTETLNIMTSSSTGQTPLSH

SEQ ID NO: 5085 - protein, 228 aa, Panicum virgatum
MDSDYGAPRELSALQKARALYQPDLPPCLQGTAVRVEYGDTATAADVAGAHVISQAFPHTYGQPLAHFLSKTANVPDATIITEHPVVRVGIVFSGRQSPGGHNVIWGLYDAIKAHNSNSKFIGFLGGTDGLFAQKTMEITEEALSSYKNQGGYDMLGRTRDQIRTTEQVKAAMATCQALKLDALVIIGGVTSNTDAAQLAETFAELKCPTKGSWCSCNSQRRPQEPVC

SEQ ID NO: 5086 - protein, 616 aa, Zea mays
MDSDYGVPRELSEVQKKRALYQPEVPPCLQGTTVRVEYGDAAIAADQAGAHVISHAFPHTYGQPLAHFLRKTAVVLDAKVISEHPVVRVGIVFCGRQSPGGHNVVWGLYEAIKAHNQNSKLIGFLGGSDGLLAQRTLEITNEVLASYKNQGGYDMLGRTKDQIRTTEQVNGAMASCQALKLDALVIIGGVTSNTDAAQLAETFAEAKCATKVVGVPVTLNGDLKNQFVETTVGFDTICKVNAQLISNVCTDALSAEKYYYFIRLMGRKASHVALECALQSHPNMVILGEEVAASKLTIFDITKQICDAVQARAEKDKNHGVVLIPEGLVESIPELYALLQEIHGLHGKGVSVENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNVKSPVNKWRCGAAPISSMMTVQRWSRGPSATQIGKPAVHMASVDLKGKAYDVLRQNSSRFLLEDVYRNPGPLQFEGPGADSKPISLCVEDQDYMGRIKKLQEYLEKVKSIVKPGCSQDVLKAALSAMSSVTETLNIMTSSSTGQTAL

SEQ ID NO: 5087 - protein, 421 aa, Theobroma cacao
MAEICCGMVSEGEASAPCEPSSRAARKRRMEIRRIKFVTDVAPSEAENGRKRQKLQIYTASLSLDCENAVDNSVSDEDGNKQKVKVKNGRSKTKGAIVKSHSSPSLLSPVTDSELYPKFGVASVCGRRRDMEDAVAIHPSFQRQGQFSAATGFHYFGVYDGHGCSHVAMRCRERLHELVKEELQGEEEEWKGAMERSFTRMDKEVIKWNEGVVGANCRCELQSPECDAVGSTAVVAIVTPDKIIVANCGDSRAVLCRNGKPVPLSSDHKPDRPDELNRIQAAGGRVIYWDGPRVLGVLAMSRAIGDNYLKPYVSCEPEVMITDRAAEDDCLILASDGLWDVVSNDTACGVARMCLRGKGNLHAPPYSPAEGVEREAVLGSTMGEISDKACTDASMLLTKLALARHSTDNVSVVVVDLRRAT

SEQ ID NO: 5088 - protein, 596 aa, Manihot esculenta
MVSDASKKKAAQKKAAAAAKRGGKAAASSKAAASADNGSVDKLSSGVGAIQISDRTCTGVLCSHPLSRDIRIESLSVTFHGHDLIVDSLLELNYGRRYGLLGLNGCGKSTLLTAIGCRELPIPDHMDIYHLSREIEASDMSALQAVISCDEERLKLEKEAEILSAQDDGGGETLERIYERLEAIDASTAEKRAAEILYGLGFNKQMQAKKTQDFSGGWRMRIALARALFMNPTILLLDEPTNHLDLEACVWLEETLKRFDRILVVVSHSQDFLNGVCTNIIHMQSKKLKIYTGNYDQYVQTRSELEENQMKQYKWEQEQIASMKEYIARFGHGSAKLARQAQSKEKTLAKMERGGLTEKVVRDKVLVFRFVDVGKLPPPVLQFVEVKFGYTPDNLIYRNLDFGVDLDSRIALVGPNGAGKSTLLKLMTGDLAPSDGMVRRHNHLRIAQFHQHLAEKLDLDMSALQYMIKEYPGNEEERMRAAIGKFGLTGKAQVMPMKNLSDGQRSRVIFAWLAYRQPQLLLLDEPTNHLDIETIDSLAEALNEWDGGLVLVSHDFRLINQVAEEIWVCENQAVTRWEGDIMDFKEHLKKKAGLSD

SEQ ID NO: 5089 - protein, 598 aa, Vitis vinifera
MVSDASKKKAAAKKAAAAAKRGGKSAAAASSKAAASAAAADVQNGVDKMADMKISDRTCTGVLCSHPLSRDIRIESLSVTFHGHDLIVDTELELNYGRRYGLLGLNGCGKSTLLTAIGCRELPIPEHMDIHHLTREIEASDMSALEAVISCDEERLKLEKEAEVLAAQDDGGGEALDRVYERLEAMDASTAEKRAAEILFGLGFNKTMQAKKTQDFSGGWRMRIALARALFMNPTILLLDEPTNHLDLEACVWLEETLKNFDRILVVVSHSQDFLNGVCTNIIHMQNRKLKLYTGNYDQYVQTRAELEENQMKQYKWEQDQIASMKEYIARFGHGSAKLARQAQSKEKTLAKMERGGLTEKVVRDKILVFRFTDVGKLPPPVLQFVEVTFGYTPDNLIYKNIDFGVDLDSRIALVGPNGAGKSTLLKLMTGDLFPIDGMVRRHNHLRIAQFHQHLTEKLDLEMSALLYMMREYPGNEEEKMRAAIGKFGLTGKAQVMPMKNLSDGQRSRVIFAWLAYRQPHMLLLDEPTNHLDIETIDSLAEALNEWDGGLVLVSHDFRLINQVAQEIWVCENQKVTRWEGDIMDFKEHLKSKAGLSG

SEQ ID NO: 5090 - protein, 592 aa, Oryza sativa
MVSDASKKKAAQKKAAAAAKRGAKASSSSSSSSSAADKAANGIAALKLSDRTCTGVLASHPLSRDIHIESLSLTFHGHDLIVDSELELNYGRRYGLLGLNGCGKSTLLTAIGCRELPIPEHMDIYHLSSEIEASDMSALQAVICCDEERMKLEKEAEILSAQDDGGGDALDRIYERLEALDASTAEKRAAEILFGLGFNKQMQAKKTQDFSGGWRMRIALARALFMNPTILLLDEPTNHLDLEACVWLEETLKKFDRILVVISHSQDFLNGVCTNIIHMQSKKLKLYSGNYDQYVQTRSELEENQMKQYKWEQEQIASMKEYIARFGHGSAKLARQAQSKEKTLAKMERGGLTEKVVRDKVLVFRFTDVGKLPPPVLQFVEVSFGYTPDNLIYKNLDFGVDLDSRIALVGPNGAGKSTLLKLMTGDLAPLDGMVRRHNHLRIAQYHQHLAEKLDLDMPALQYMMREYPGNEEEKMRAAIGKFGLSGKAQVMPMRNLSDGQRSRVIFAWLAYRQPQLLLLDEPTNHLDIETIDSLAEALNEWDGGLVLVSHDFRLINQVAQEIWVCEKQAVTRWEGDIMDFKEHLRSRAGLSD

SEQ ID NO: 5091 - protein, 597 aa, Setaria italica
MVSEASKKKAAQKKAAAAAKRGGKAAAASSSSSSSSAAAAAEKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVSCDEERVQLEKEAEILAAQDDGGGEALDRVYERLDAMDAATAEKRAAEILFGLGFSKQMQAKKTKDFSGGWRMRIALARALFMNPTILLLDEPTNHLDLEACVWLEEMLKNFDRILVVISHSQDFLNGVCTNIIHMQNKKLKLYTGNYDQYVQTRSELEENQMKQYKWEQEQIASMKEYIARFGHGSAKLARQAQSKEKTLAKMERGGLTEKVVRDKVLVFRFTDVGKLPPPVLQFVEVKFGYTPDNLIYKCLDFGVDLDSRIALVGPNGAGKSTLLKLMTGDLVPLDGMVRRHNHLRIAQYHQHLAEKLDLDMSALAYMMKEYPGTEEEKMRSAVGRFGLSGKAQVMPMKNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 5092 - protein, 595 aa, Sorghum bicolor
MVSEASKKKAAQKKAAAAAKRGGKAAVASSSSSSAAAAADKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVTCDEERVKLEKEAEILAAQDDGGGEALDRVYERLDAMDAGTAEKRAAEILFGLGFNKEMQAKKTKDFSGGWRMRIALARALFMNPTILLLDEPTNHLDLEACVWLEETLKKFDRILVVISHSQDFLNGVCTNIIHMQSKKLKLYTGNYDQYVQTRSELEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLVPLDGMVRRHNHLRIAQYHQHLAEKLDLDMPALAYMMKEYPGTEEEKMRAAVGRFGLSGKAQVMPMKNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 5093 - protein, 595 aa, Zea mays
MVSEASKKKAAQKKAAAAAKRGGKASVASSSSSSAAAAADKVANGVVALKLSDRTCTGVLASHPLSRDIHIESLSLTFHGHDLIVDSDLELNYGRRYGLLGLNGCGKSTLLTAIGCRELPIPEHMDIYHLSHEIEASDMSALQAIVSCDEERVKLEKEAEILAAQDDGGGEALERVYERLDAMDAGTAEKRAAEILFGLGFDKQMQAKKTKDFSGGWRMRIALARALFMNPTILLLDEPTNHLDLEACVWLEETLKKFDRILVVISHSQDFLNGVCTNIIHMQNKKLKLYTGNYDQYVQTRSDLEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLAPLDGMVRRHNHLRIAQYHQHLADKLDLDMPALAYMMKEYPGTEEEKMRAAVGRFGLSGKAQVMPMRNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 5094 - protein, 605 aa, Zea mays
MVSDASKKKAAQKKAAAAAKRGGKAAAASSSSSSAAAAAAVDKAANGVAALKLSDRTCTGVLASHPLSRDIHIESLSLTFHGHDLIVDSELELNYGRRYGLLGMNGCGKSTLLTAIGCRELPIPEHMDIYHLSHEIEASDMSALQAVVTCDEERVKLEKEAEILAAQASSWNHRIDDGGGEALERVYERLDAMDAGTAEKRAAELLFGLGFNKQMQTKKTKDFSGGWRMRIALARALFMNPTILLLDEPTNHLDLEACVWLEETLKKFDRILVVISHSQDFLNGVCTNIIHMQSKKLKLYTGNYDQYVQTRSELEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLVPLDGMVRRHNHLRIAQYHQHLAEKLDLDMSALAYMMKEYPGTEEEKMRAAVGRFGLSGKAQVMPMKNLSDGQRSRVIFAWLAYRQPQLLLLDEPTNHLDIETIDSLAEALNEWDGGLVLVSHDFRLINQVAQEIWVCENQEVTRWEGDIMDFKAHLKSKAGLSD

SEQ ID NO: 5095 - protein, 342 aa, Panicum virgatum
MVSEASKKKAAASSSSSSSSSSAAAAVDKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVSCDEERVKLEKEAEILAAQEDGGGEALDRVYERLDAMDAATAEKRAAEILFGLGFTKQMQAKKTKDFSGGWRMRIALARALFMNPTILLLDEPTNHLDLEACVWLEETLKKFDRILVVISHSQDFLNGVCTNIIHMQNKKLKLYTGNYDQYVQTRSELEENQMKQYKWEQEQIASMKEYIARFGHGSAKLARQHKAKRKLLQRWSVVV

SEQ ID NO: 5096 - protein, 596 aa, Silene vulgaris
MVSDASKKKAAQKKAAAAAKRGNKAAAASASAKAASIGQGGTDQLADEVDQLLLSDRTCTGILCSHPLSRDIRIESLSVTFHGHDLVLDSLLELNYGRRYGLLGLNGCGKSTLLTAIGLRELPIPDHMDIYHLTREIEASDMSALDAVICCDEERMKLEQEAEALAASDDGGGDRLDRIYERLDALDASTAEKRAAEILNGLGFNKEMQAKKTKDFSGGWRMRIALARSLFMNPTILLLDEPTNHLDLEACVWLEESLKKFNRILVVVSHSQDFLNGVCTNIIHMQSKQLKIYTGNFDQYLQTRAELEENQMKQYKWEQDQIANMKEYIARFGHGSAKLARQAQSKEKTLAKMERGGLTEKVARDQVLVFRFTDVGKLPPPVLQFVEVSFGYTPENILYKNLDFGVDLDSRIALVGPNGAGKSTLLKLMTGELAPVEGTVRRHNHLRIAQYHQHLAEKLDMEMSALQYMMREYPGTEEEKMRAAIGRFGLSGKPQVMPMKNLSDGQRSRVIFAWLAYRQPQMLLLDEPTNHLDIETIDSLAEALNEWDGGLVLVSHDFRLINQVAHEIWVCENQTVSRWGGDIIQFKEHLKKRAGL

SEQ ID NO: 5097 - protein, 595 aa, Cycas rumphii
  misc_feature (466)..(466): Xaa can be any naturally occurring amino acid
  misc_feature (515)..(515): Xaa can be any naturally occurring amino acid
MVSDASKKKAAAKKAAAAAKRGSKSAVAASSKADESQNGNANKGTNAASVLPISDRTCTGVLGSHPMSRDIHIESLSVTFHGHELIVDSELELNYGRRYGLLGLNGCGKSTLLTAIGRRELPIPEHMDIYHLTREIDATDMTALEAVMNCDEERLQLEKEAETLAAQDDGGGEALDRIYERLEILDAATAEKRAAEILFGLGFTKKMQAKKTCDFSGGWRMRIALARALFMNPTILLLDEPTNHLDLEACVWLEETLKKFDRILVVVSHSQDFLNGVCTNIIHMQNKKLKLYTGNYDQYVQTRSELEENQMKQYKWEQEQISAMKEYIARFGHGSAKLARQAQSKEKTLAKMERGGLTDKVVRDKVLVFRFTDVGKLPPPVLQFVEVTFGYTPENLIYKNVDFGVDLDSRIALVGPNGAGKSTLLKLMTGDLVPLDGMVRRHNHLRIAQYHQHLAEKLHLDMSALXYMMSEYPGLEEEKMRAAIGKFGLTGKAQIMPMQNLSDGQKSRVIFAWLXWRQPQLLLLDEPTNHLDIETIDSLAEALNEWDGGLVLVSHDFRLINQVAKEIWVCENKTVTRWEGDIMDFKQHLKSKAGL

SEQ ID NO: 5098 - protein, 599 aa, Sciadopitys verticillata
MVSDASKKKAAAKKAAAAAKRGSKSSAATVSKPETSQNGKASASVEKAADDMAAMHISDRTCTGVLCSHPLSRDIHIESLSVTFHGHELIVDSELELNYGRRYGLLGLNGCGKSTLLTALGCRELPIPEHMDIYHLTREIEATDMTALEAVMNCDEERLRLEKEAEALAAQDDGGGEALDLIYERLDLLDAATAEKRAAEILFGLGFTKKMQAQKTCDFSGGWRMRIALARALFMNPTILLLDEPTNHLDLEACVWLEETLKKFDRILVVVSHSQDFLNGVCTNIIHMQNMKLKLYTGNYDQYVQTRSELEENQMKQYRWEQEQISSMKEYIARFGHGSAKLARQAQSKEKTLAKMERGGLTEKVVRDKVLVFRFTDVGKLPPPVLQFVEVDFGYTPENIIYKSIDFGVDLDSRIALVGPNGAGKSTLLKLMTGELTPLDGMVKRHNHLRIAQYHQHLADKLDLEVSALQYMMNEYTGIEEEKMRAAIGKFGLTGKAQIMPMTNLSDGQRSRVIFAWLAWRLPHLLLLDEPTNHLDIETIDSLAEALNEWDGGLVLVSHDFRLINQVAKEIWVCENKSVTRWQGDIMDFKQHLKSKAGL

SEQ ID NO: 5099 - protein, 575 aa, Oryza sativa
MVSDASKKKAAQKKAAAAAKRGDKAKAAITLSERTCTAVLTSHPLSRDIHIESLSLTFHGHDLLLDTDLELNYGRRYGLLGLNGCGKSCLLKAIGCRELPIPPHMDIYHLTHEIEASDMSALQAVISCDEQRLQLEKEAEILAAQDDGGGEALDRVYERLEAIDASTAEKRAAEILFGLGFNKHMQAKKTCDFSGGWRMRIALARALFMNPTILLLDEPTNHLDLEACVWLEETLKKFDRILVVISHSQDFLNGVCTNIIHMQNRKLKLYTGNYDQYVQTRAELEENQMKQYRWEQDQIASMKEYIARFGHGSAKLARQAQSKEKTLAKMERGGLTEKVVRDKVLTFRFTDVGTLPPPVLQFVEVTFGYTPDNLIYKNLDFGVDLDSRVALVGPNGAGKSTLLKLMTGDLIPLDGMVRRHNHLRIAQFHQHLAEKLDLDMSALQYMMKEYPGNEEERMRAAIGKFGLSGKAQVMPMRNLSDGQRSRVIFAWLAWREPHMLLLDEPTNHLDIETIDSLAEALNEWDGGLVLVSHDFRLINQVAQEIWVCEKQAVTRWEGDIMEFKEHLRSKAGVDD

SEQ ID NO: 5100 - protein, 599 aa, Pinus pinaster
MVSDASKKKAAAKKAAAAAKRGSKSATAATSSKATSTEVSQNGHAETAADQLADLQISDRTCTGVLTSHALSRDIHIESLSVTFHGHELIVDSELELNYGRRYGLLGLNGCGKSTLLTALGCREIPIPDHMDIYHLTREIEATDMTALEAVMNCDEERLKIEKEAEALAAQDDGGGEALDRLYERLESLDAATAEKRAAEILFGLGFDKKMQAKKTSDFSGGWRMRIALARALFMNPTVLLLDEPTNHLDLEACVWLEEMLKKFDRILVVISHSQDFLNGICTNIIHMQNKKLKLYTGNYDQYVQTRTDLEENQMKQYRWEQEQIASMKEYIARFGHGSAKLARQAQSKEKTLAKMERGGLTERVVRDKVLVFRFTDVGKLPPPVLQFVEVDFGYTPENLIYKNIDFGVDLDSRIALVGPNGAGKSTLLKLMTGELTPLDGMVKRHNHLRIAQFHQHLADKLDLSVSALQYMMNEYPGIEEEKMRAAIGKFGLTGKGQIMPMQNLSDGQRSRVIFAWLAWRLPHLLLLDEPTNHLDIETIDSLAEALNEWDGGLVLVSHDFRLINQVAKEIWVCENKKVTRWGGDIMDFKRHLKSKAGL

SEQ ID NO: 5101 - protein, 599 aa, Pinus taeda
MVSDASKKKAAAKKAAAAAKRGSKSATAATSSKATSTEVSQNGHAETVADQLADLQISDRTCTGVLTSHALSRDIHIESLSVTFHGHELIVDSELELNYGRRYGLLGLNGCGKSTLLTALGCREIPIPDHMDIYHLTREIEATDMTALEAVMNCDEERLKIEKEAEALAAQDDGGGEALDRLYERLESLDAATAEKRAAEILFGLGFDKKMQAKKTSDFSGGWRMRIALARALFMNPTVLLLDEPTNHLDLEACVWLEEMLKKFDRILVVISHSQDFLNGICTNIIHMQNKKLKLYTGNYDQYVQTRTDLEENQMKQYRWEQEQIASMKEYIARFGHGSAKLARQAQSKEKTLAKMERGGLTEKVVRDKVLVFRFTDVGKLPPPVLQFVEVDFGYTPENLIYKNIDFGVDLDSRIALVGPNGAGKSTLLKLMTGELTPLDGMVKRHNHLRIAQFHQHLADKLDLSVSALQYMMNEYPGIEEEKMRAAIGKFGLTGKGQIMPMQNLSDGQRSRVIFAWLAWRLPHLLLLDEPTNHLDIETIDSLAEALNEWDGGLVLVSHDFRLINQVAKEIWVCENKKVTRWGGDIMDFKRHLKSKAGL

SEQ ID NO: 5102 - protein, 599 aa, Picea glauca
MVSDASKKKAAAKKAAAAVKRGSKSATAATSSKAASTDVSQNGNAERVADQLADLQISDRTCTGVLTSHALSRDIHIESLSVTFHGHELIVDSELELNYGRRYGLLGLNGCGKSTLLTALGCREIPIPDHMDIYHLTREIEATDMTSLEAVMNCDEERLKLEKEAEALAAQDDGGGEALDLLYERLESLDAATAEKRAAEILFGLGFDKKMQTKKTSDFSGGWRMRIALARALFMNPTVLLLDEPTNHLDLEACVWLEEMLKKFDRILVVVSHSQDFLNGICTNIIHMQNKKLKLYTGNYDQYVQTRTDLEENQMKQYRWEQEQIASMKEYIARFGHGSAKLARQAQSKEKTLAKMERGGLTEKVVRDKVLVFRFTDVGKLPPPVLQFVEVDFGYTPENLIYKSIDFGVDLDSRIALVGPNGAGKSTLLKLMTGELTPLDGMVKRHNHLRIAQFHQHLADKLELSVSALQYMMNEYPGIEEEKMRAAIGKFGLTGKAQIMPMENLSDGQRSRVIFAWLAWRLPHLLLLDEPTNHLDIETIDSLAEALNEWDGGLVLVSHDFRLINQVAKEIWVCENKRVTRWGGDIMDFKRHLKSKAGL

SEQ ID NO: 5103 - protein, 226 aa, Cedrus atlantica
MVSDASKKKAAAKKAAAAAKRGSKSATAATSSKAASTDESQNGNVEKAADQMGELHISDRTCTGVLTSHALSRDIHIESLSLTFHGHELIVDSELELNYGRRYGLLGLNGCGKSTLLTSLGCREIPIPDHMDIYHLTREIEATDMTSLEAVINCDEERLKLEKEAEALAAQDDGGGEALDRLYERLEALDAATAEKRAAEILFGLGFDKKCRQKRQVTFLVVGVCE

SEQ ID NO: 5104 - protein, 594 aa, Arabidopsis lyrata
MVSDASKKKAAQKKAAAAAKRGGKAAASSKSAATSSNGVDSLSSGVDALQISDRTCTGVLCSHPQSRDIRIESLSVTFHGYDLIVDSMLELNYGRRYGLLGLNGCGKSTLLTAIGRREIPIPDHMDIYHLSHEIEATDMSSLEAVVSCDEERLRLEKEVEILVEQDAGGERLESIYERLEAMDAATAEKRAAEILFGLGFDKEMQAKKTKDFSGGWRMRIALARALFIMPTILLLDEPTNHLDLEACVWLEESLKNFDRILVVVSHSQDFLNGVCTNIIHMQSKQLKYYTGNFDQYCQTRSELEENQMKQYRWEQEQISHMKEYIARFGHGSAKLARQAQSKEKTLAKMERGGLTEKVARDSVLVFRFADVGKLPPPVLQFVEVSFGYTPDYLIYKNIDFGVDLDSRVALVGPNGAGKSTLLKLMTGELHPTEGMVRRHNHLKIAQYHQHLAEKLDLELPALLYMMREFPGTEEEKMRAAIGRFGLTGKAQVMPMKNLSDGQRSRVIFAWLAYKQPNMLLLDEPTNHLDIETIDSLAEALNEWDGGLVLVSHDFRLINQVAHEIWVCEKQCITKWNGDIMDFKRHLKAKAGLED

SEQ ID NO: 5105 - protein, 595 aa, Arabidopsis thaliana
MVSDASKKKAAQKKAAAAAKRGGKAAAPSKSAATSSNGVDSLSSGVDALQISDRTCTGVLCSHPQSRDIRIESLSVTFHGYDLIVDSMLELNYGRRYGLLGLNGCGKSTLLTAIGRREIPIPDQMDIYHLSHEIEATDMSSLEAVVSCDEERLRLEKEVEILVQQDDGGGERLQSIYERLDAMDAETAEKRAAEILFGLGFDKEMQAKKTKDFSGGWRMRIALARALFIMPTILLLDEPTNHLDLEACVWLEESLKNFDRILVVVSHSQDFLNGVCTNIIHMQSKQLKYYTGNFDQYCQTRSELEENQMKQYRWEQEQISHMKEYIARFGHGSAKLARQAQSKEKTLAKMERGGLTEKVARDSVLVFRFADVGKLPPPVLQFVEVSFGYTPDYLIYKNIDFGVDLDSRVALVGPNGAGKSTLLKLMTGELHPTEGMVRRHNHLKIAQYHQHLAEKLDLELPALLYMMREFPGTEEEKMRAAIGRFGLTGKAQVMPMKNLSDGQRSRVIFAWLAYKQPNMLLLDEPTNHLDIETIDSLAEALNEWDGGLVLVSHDFRLINQVAHEIWVCEKQCITKWNGDIMDFKRHLKAKAGLED

SEQ ID NO: 5106 - protein, 571 aa, Pennisetum glaucum
ASSSSSSSSAAAAAAEKAANGVAALKLSDRTCTGVLASHPLSRDIHIESLSLTFHGHDLIVDSELELNYGRRYGLLGLNGCGKSTLLTAIGCRELPIPEHMDIYHLSHEIEASDMSALQAVVSCDEERVKLEKEAEILAAQDDGGGEALDRIYERLESMDAATAEKRAAEILFGLGFTKQMQAKKTKDFSGGWRMRIALARALFMNPTILLLDEPTNHLDLEACVWLEEMLKKFDRILVVVSHSQDFLNGVCTNIIHMQNKTLKLYTGNYDQYVQTRSELEENQMKQYRWEQEQIASMKEYIARFGHGSAKLARQAQSKEKTLAKMERGGLTEKVVRDKVLVFRFTDVGKLPPPVLQFVEVKFGYTPDNLIYKCLDFGVDLDSRIALVGPNGAGKSTLLKLMTGDLVPLDGMVRRHNHLRIAQYHQHLAEKLDMDMSALAYMMKEYPGTEEEKMRSAVGRFGLSGKAQVMPMKNLSDGQRSRVIFAWLAYRQPQMLLLDEPTNHLDIETIDSLAEALNEWDGGLVLVSHDFRLINQVAKEIWVCENLAVTRWEGDIMDFKAHLKSKAGLSD

SEQ ID NO: 5107 - protein, 226 aa, Pseudotsuga menziesii
MVSDASKKKAAAKKAAAAAKRGSKSAAAATSSKAASTEASQNGNADKAADQLAELQISDRTCTGVLTSHALSRDIHIESLSVTFHGHELIVDSELELNYGRRYGLLGLNGCGKSTLLTALGCREIPIPDHMDIYHLTREIEATDMTSLEAVMNCDEERLKLEKEAEALAAQDDGGGEALDRLYERLESLDAATAEKRAAEILFGLGLIKKGNPKRRVTSLVVGVCE

SEQ ID NO: 5108 - protein, 385 aa, Pinus taeda
MVSDASKKKAAAKKAAAAAKRGSKSATAATSSKATSTEVSQNGHAETVADQLADLQISDRTCTGVLTSHALSRDIHIESLSVTFHGHELIVDSELELNYGRRYGLLGLNGCGKSTLLTALGCREIPIPDHMDIYHLTREIEATDMTALEAVMNCDEERLKIEKEAEALAAQDDGGGEALDRLYERLESLDAATAEKRAAEILFGLGFDKKMQAKKTSDFSGGWRMRIALARALFMNPTVLLLDEPTNHLDLEACVWLEEMLKKFDRILVVISHSQDFLNGICTNIIHMQNKKLKLYTGNYDQYVQTRTDLEENQMKQYRWEQEQIASMKEYIARFGHGSAKLARQAQSKEKTLAKMERGGLTEKVVRDKVLVFRFTDVGKLPPRK

SEQ ID NO: 5109 - protein, 217 aa, Triticum aestivum
MVSDASKKKAAQKKAAAAAKRGAKVPTSSASSSASNNKTTDKGALAAVQLSDRTCTAVLTSHPLSRDIHIESLTLTFHGHDLLVDTELELNYGRRYGLLGLNGCGKSCLLKAIGCRELPIPDHMDIYHLSHEIEASDMSALGAVISCDEERVKLEKEAEVLAAQDDGGGAALERVYERLEAIDASTAEKRAAEILFGLGFNKQMQAKKTRTSLAVGA

SEQ ID NO: 5110 - protein, 244 aa, Zostera marina
MERGGLTERVTRDKVLVFRFVDVGNLPPPVLQFVQVTFGYTPDNLIYNKIDFGVDLDSRIALVGPNGAGKSTLLKLMTGDLTPLDGMVRRHNRLQIAQFHQHLAEKLDMDMSALQYMMSEYKGIDEEKMRSVVGRFGLTGKAQIMPMKNLSDGQRSRVIFAWLAYREPHMLLLDEPTNHLDIETIDSLANALKEWNGGLVLVTHDFRLINQVAEEIWVCENQAVTRWNGDIMGFKEHLKDKTGL

SEQ ID NO: 5111 - protein, 425 aa, Brassica napus
MVSDASKKKALQKKAAAAAKRGGKAAAAAAASKSAATSSNGVDALSSGVDAIHISDRTCTGILCSHPQSRDIRIESLSVTFHGYDLIVDSMLELNYGRRYGLLGLNGCGKSTLLTSIGLRELPIPDHMDIYHLSHEIEATDMTSLEAVMSCDEERLKLEKEIETLVEQDDGGGERLDTIYERLEAMDASTAEKRAAEILFGLGFDKEMQAKKTKDFSGGWRMRIALARALFIMPTILLLDEPTNHLDLEACVWLEESLKNFDRILVVVSHSQDFLNGVCTNIIHMQSKQLKYYTGNFDQYCQTRSELEENQMKQYRWEQEQISHMKEYIARFGHGSAKLARQAQSKEKTLAKMERGGLTEKVARDSVLVFRFADVGKLPPPVLQFVEVSFGYTPDYLIYKNIDFGVDLDSRVALLVPMELGRVLF

SEQ ID NO: 5112 - protein, 597 aa, Brassica napus
MVSDASKKKALQKKAAAAAKRGGKAAAAAASKSAATSSNGVDTLSSGVDAIQISDRTCTGILCSHPQSRDIRIESLSVTFHGYDLIVDSMLELNYGRRYGLLGLNGCGKSTLLTSIGLRELPIPDHMDIYHLSHEIEATDMTSLEAVMSCDEERLKLEKEIETLVEQDDGGGERLDTIYERLEAMDAATAEKRAAEILFGLGFDKEMQAKKTKDFSGGWRMRIALARALFIMPTILLLDEPTNHLDLEACVWLEESLKNFERILVVVSHSQDFLNGVCTNIIHMQSKQLKYYTGNFDQYCQTRSELEENQMKQYRWEQEQISHMKEYIARFGHGSAKLARQAQSKEKTLAKMERGGLTEKVARDSVLVFRFADVGKLPPPVLQFVEVSFGYTPDYLIYKNIDFGVDLDSRVALVGPNGAGKSTLLKLMTGELHPTEGMVRRHNHLKIAQYHQHLAEKLDLEVPALIYMMNEFPGNEEEKMRAAIGRFGLTGKAQVMPMKNLSDGQRSRVIFAWLAYKQPNMLLLDEPTNHLDIETIDSLAEALNEWDGGLVLVSHDFRLINQVAHEIWVCEKQCITKWNGDIMDFKKHLKAKAGIED

SEQ ID NO: 5113 - protein, 599 aa, Abies balsamea
MVSDASKKKAAAKKAAAAVKRGSKSATAATSSKAVSTDASQNGNAERLADQMAELQISDRTCTGVLTSHALSRDIHIESLSLTFHGHELIVDSELELNYGRRYGLLGLNGCGKSTLLTSLGCREIPIPDHMDIYHLTREIEATDMTSLEAVINCDEERLKLEKEAEALAAQDDGGGEALDRLYERLEALDAATAEKRAAEILYGLGFDKKMQAKKTSDFSGGWRMRIALARALFMNPTVLLLDEPTNHLDLEACVWLEEMLKNFDRILVVVSHSQDFLNGICTNIIHMQNKTLKLYSGNYDQYVQTRTELEENQMKQYRWEQEQISAMKEYIARFGHGSAKLARQAQSKEKTLAKMERGGLTEKVVRDKVLVFRFTDVGKLPPPVLQFVEVDFGYTPDNLIYKGIDFGVDLDSRIALVGPNGAGKSTLLKLMTGELSPLDGMVKRHNHLRIAQFHQHLADKLELSVSALQYMMNEYPGIDEERMRAAIGKFGLTGKAQIMSMQNLSDGQRSRVIFAWLAWRLPHLLLLDEPTNHLDLETIDSLAEALNEWDGGLVLVSHDFRLINQVAKEIWVCENKTVTRWGGDIMDFKRHLKSKAGL

SEQ ID NO: 5114 - protein, 594 aa, Brassica napus
MVSDASKKKALQKKAAAAAKRGGKAAAAKAAASSSNGADSLSSGVDAIQISDRTCTGILCSHPQSRDIRIESLSVTFHGYDLIVDSMLELNYGRRYGLLGLNGCGKSTLLTAIGLRELPIPDHMDIYHLSHEIEATDMTSLEAVMSCDEERLKLEKEIETLVEQDDGGGERLDTIYERLEAMDASTAEKRAAEILFGLGFDKEMQAKKTKDFSGGWRMRIALARALFIMPTILWLDEPTNHLDLEAGVWLEGSLKNFDRILVVVSHSQDFLNGVCTNIIHMQSKQLKYYTGNFDQYCQTRSELEENQMKQYRWEQEQISHMKEYIARFGHGSAKLARRAQSKEKTLAKMERGGLTEKVARDSVLVFRFADVGKLPPPVLQFVEVSLGYTPDYLIYKNIDLGVDLDSRVALVGPNGAGKSTLLKLMTGELQPTEGMVRRHNHLKIAQYHQHLAEKLDLEVPALIYMMNEFPGNEEEKMRAAIGRFGLTGKAQVMPMKNLSDGQRSRVIFAWLAYKQPNMLLLDEPTNHLDIETIDSLAEALNEWDGGLVLVSHDFRLINQVAHEIWVCEKQCITKWNGDIMDFKKHLKAKAGLED

SEQ ID NO: 5115 - protein, 573 aa, Artemisia annua
TPTGSAKAAAVGMNGSSSSDNLSNGMGNLVISDRTCTGVLCSHPLSRDIRIESLSLTFHGHDLIVDAELELNYGRRYGLLGLNGCGKSTLLTSIGMRELPIPEHMDIFHLTREIEASDMSSLEAVMNCDEERLKLEAEAERLAGQDDGGGEALERIYERLDALDASTAEKRAAEILNGLGFDKQMQAKKTKDFSGGWRMRIALARALFMNPTILLLDEPTNHLDLEACVWLEETLQKFERILVVVSHSQDFLNGVCTNIIHMQSKTLKIYSGNFDQYVQTRSELEENQMKQYKWEQDQIANMKEYIARFGHGSAKLARQAQSKEKTLAKMERGGLTEKVSRDSVLVFRFVDVGKLPPPVLQFSEVKFGYTPDNLIYKCLDFGVDLDSRVALVGPNGAGKILKLMTGELTPLEGMVKRHNHLRIAQYHQHLAEKLDLDMSALLYMMREYPGNEEEKMRASIGRFGLTGKAQVMPMKNLSDGQKSRVIFAWLAFRQPQMLLLDEPTNHLDIETIDSLAEALNEWDGGMVLVSHDFRLINQVAREIWVCENQTITRWNGDIMGFKEHLKAKSGLSS

SEQ ID NO: 5116 - protein, 539 aa, Sorghum bicolor
MGFRGGFRPLVTLVLLCLCASRLCSLSHAKRTPRPTPTPAKKPPPSSPSQQSPPPPASYPPLPVRAVCLGGWLVTEGWILPSLFDGIPNKDLLDGTQVQFKSALRKTYLTADQGGGGAVVANRTQASDWETFKLWRMNETTFNFRTSGNQFVGIGASDGLIVATATTPTLPETFQIVRCPFDKNRVRIKAANGYFVQAIATGEVIADYGEPTRWSDFDASVFLMTKVGEQLQGEYQLCNGYGTDKATPLLRDHWSTYIVEDDFKFFASSGLTAVRIPVGWWIASDPNPPAPYVGGSLQALDNAFKWAEKYKLGVIIDLHAAPGSQNPWEHSSSRDGTQEWGTTDANIAQTVQVIDFLASRYATSSSLFAVELMNEPLAPGATLDSLTKYYRDGYDAVRKHSPTAYVVMSNRLSSGNSTELLQFASGLQGAVIDVHYYTVFNRMFNNFTVQQNIDFIRTNFSGELTTVTTHNGPLTFVGEWVAEWKVPNATKEEYQKYATAQMNVYGQATFGWSYWTAKNANNHWDLEWMIKNGYISLKG

SEQ ID NO: 5117 - protein, 98 aa, Triticum aestivum
  misc_feature (97)..(97): Xaa can be any naturally occurring amino acid
MAESKARVALFLAALAAASLLALAPAGAATTCAPTQLTPCAPAIVGNAAPTAACCARLKAHPATCFCQYKRNPSMQRYVNSPNGKKVFAACKVSLPXC

SEQ ID NO: 5118 - protein, 266 aa, Sorghum bicolor
MDGSAGSFVAVRRLSGSDRAAAFHHSSSAEVVTGSSAWIGRGLSCVCAQRRDSDARLSFDLTPVQEECLQRLQNRIEVQYDSANREHQEALQALWCASFPGTELRGLISEQWKEMGWQGKDPSTDFRGGGFISLENLLYFSRNYPKSFQELLRKQNGDRAIWEYPFAVAGVNITFMLIQMLDLQAVKPRSLFGAVFLKLLSENDRAFDILYCITFKLMDQQWLDMHATYMDFNTVMKSTRRQLERELLIEDIQRIEDMPSYRLLGR

SEQ ID NO: 5119 - protein, 266 aa, Saccharum officinarum
MDGSAGSFVAVRRLSGSDRAAAFHHSSSAEVVTGSTAWIGKGLSCVCAQRRDSDARLSFDLTPVQEECLQRLQNRIEVQYDSANSEHQEALQALWCASFPGTELRGLISEQWKEMGWQGKDPSTDFRGGGFISLENLLYFARNYPKSFQELLRKQNGDRAIWEYPFAVAGVNITFMLIQMLDLQAVKPRSLFGAVFLKLLSENDRAFDILYCITFKLMDQQWLDMHATYMDFNTVMKSTRRQLERELLIEDIQRIEDMPSYRLLGR

SEQ ID NO: 5120 - protein, 266 aa, Panicum virgatum
MDASAGSFVAVRRLSGSDRAAAFHHSSSAEVVTGSSAWIGRGLSCVCAQRRDSDARLSFDLTPTQEECLQRLQNRIEVQYDSANREHQEALRALWCAAFPGTELRGLISEQWKEMGWQGKDPSTDFRGGGFISLENLLYFARNYPKSFQELLRKQNGDRAIWEYPFAVAGVNITFMLIQMLDLQAVKPRSLFGAVFLKLLSENDQAFDILYCITFKLMDQQWLDMHATYMDFNMVMKSTRRQLERELLIEDIQRIEDMPSYRLLAR

SEQ ID NO: 5121 - protein, 266 aa, Setaria italica
MDGSAGSFVAVRRLSGSDRAAAFHHSSSAEVVTGSTAWIGRGLSCVCAQRRDSDARLSFDLTPMQEECLQRLQNRIEVQYDSSNREHQEALHALWCASFPGTELRGLISEQWKEMGWQGKDPSTDFRGGGFISLENLLFFARNYPKSFQELLRKQNGDRAIWEYPFAVAGVNITFMLIQMLDLQAVKPRSLFGAVFLKFLSENDQAFDIIYCITFKLMDQQWLDMHATYMDFNTVMKSTRRQLERELLIEDIQRIEDLPSYRLLAR

SEQ ID NO: 5122 - protein, 269 aa, Triticum aestivum
MDTNAGSFVAVRRLAGSDRAAGAVAFHHSSSAEVVTGSTAWIGRGLSCVCVQSRDSDARLSFDLTPVQEECLLRLQNRIEIQYDSSNIEHQEELKALWCASFPGTELRGLISEQWKEMGWQGKDPSTDFRGGGFISLENLLFFARNYPKSFQELLRKQNGDRAIWEYPFAVAGVNITFMLIQMLDLQAVKPRSLLGAVFLKLLSENDRAFDILYCITFKLMDQQWLDMHATYMDFNTVMKSTRRQLERELLIEDIQRVEDMPSYKLLAR

SEQ ID NO: 5123 - protein, 251 aa, Pennisetum glaucum
GSDRAAAFHHSSSAEVVTGSTAWIGRGLSCVCAQRRDSDARLSFDLTPMQEECLQRLQNRIEVQYDSSNRGHQEALHALWCASFPGTELRGLISEQWKEMGWQGKDPSTDFRGGGFISLENLLYFARNYPKSFQELLRKQNGDRAIWEYPFAVAGVNITFMLIQMLDLQAVKPRSLFGAVFLKLLSENDQAFDIIYCITFKLMDQQWLDMHATYMDFNTVMKSTRRQLERELLIEDIQRIEDLPSYRLLAR

SEQ ID NO: 5124 - protein, 269 aa, Oryza sativa
MDANAGSFVAVRRLAGSERAAGAAAFHHSSSAEVVTGSTAWIGKGLSCVCAQRRDSDARLSFDLTPVQEECLQRLQNRLEVQYDSSNSDHQEALKDLWRASFPGAELRGLISEQWKEMGWQGKDPSTDFRGGGFISLENLVYFSKNFPKSFQELLRKQNGDRAIWEYPFAVAGVNITFMLIQMLDLQSVKPRSFIGAVFLKLLSENDQAFDILYCITFKLMDQQWLDMHATYMDFNTVMKSTRRQLERELLLEDIQRIEDMPSYKLLAR

SEQ ID NO: 5125 - protein, 269 aa, Brachypodium distachyon
MDTNAGSFVAVRRLAGSDRAAGAVAFHHSSSAEVVTGSTAWIGRGLSCVCAQGRDSDARLSFDLTPVQEECLLRLQNRIEVQYDSSNREHQEELKALWCASFPGIELQGLISEQWKEMGWQGKDPSTDFRGGGFISLENLLFFARNYPKSFQELLRKQNGDRAIWEYPFAVAGVNITFMLIQMLDLQAVKPRSLFGAVFLKLLSENDRAFDIIYCVTFKVMDQQWLDMHATYMDFNTVMKATRRQIERELLLEDILRIEDMPSYKLLAR

SEQ ID NO: 5126 - protein, 269 aa, Festuca arundinacea
  misc_feature (200)..(200): Xaa can be any naturally occurring amino acid
MDTNAGSFVAVRRLAGTDRAAGAVAFHHSSSAEVVTGSTAWIGRGLSCVCVQSRDSDARLSFDLTPVQEECLLRLQNRIEVQYDTSNREHQEELKALWYASFSGTELRGLISEQWKEMGWQGKDPSTDFRGGGFISLENLLFFARNYSKSFQELLRKQNGDRAIWEYPFAVAGVNITFMLIQMLDLQAVKPRSLFGAVFXKLLSENDRAFDILYCITFKLMDQQWLDMHATYMDFNTVMKSTRRHLERELLLEDIQRIEDMPSYKLLAR

SEQ ID NO: 5127 - protein, 269 aa, Leymus cinereus x Leymus triticoides
  misc_feature (44)..(44): Xaa can be any naturally occurring amino acid
  misc_feature (88)..(88): Xaa can be any naturally occurring amino acid
  misc_feature (219)..(219): Xaa can be any naturally occurring amino acid
  misc_feature (227)..(227): Xaa can be any naturally occurring amino acid
  misc_feature (260)..(260): Xaa can be any naturally occurring amino acid
MDTNAGSFVAVRRLAGSDRAAGAVAFHHSSSAEVVTGSTAWIGXGLSCVCVQSRDSDARLSFDLTPVQEECLLRLQNRIEIQYDSSNXEHQEELKALWCASFPGTELRGLISEQWKEMGWQGKDPSTDFRGGGFISLENLLFFARNYPKSFQELLRKQNGDRAIWEYPFAVAGVNITFMLIQMLDLQAVKPRSLFGAVFLKLLSENDRAFDILYCITFXLMDQQWLXMHATYMDFNTVMKSTRRQLERELLLEDIQRVEXMPSYKLLAR

SEQ ID NO: 5128 - protein, 267 aa, Pennisetum glaucum
MDHNAGSFLAVRRLSGAGIVHHRHSHSSPAEVVGVSTAWIGKGLSCVCAQRRDSDARLSFDLSPIQEECLQRLQNRIEVQYDNSNLEHQKALKALWRASFPGTELLGLVSDQWKEMGWQGKDPSTDFRGGGYISLENLLYFSRTYPKSFQELLCKKNGDRALWEYPFAVAGVNITFMLIQMLDLQAAKPTSLIGAVFLNLLVENDRAFDVLYCITFKLMDQKWLDMHATYMDFNSVIKSTRRQLERELLLEDIQRIEDMPSFRFLAR

SEQ ID NO: 5129 - protein, 266 aa, Zea mays
MEQNAGSFLAVRRLSGGAIHHHRHHSSPAEVVGVSTAWLGKGLSCVCAQRRESDVRLSFDLSPIQEECLNRLQNRIEVQYDGSNLEHQKALEALWRSSFPGTELLGLVSDQWKEMGWQGKDPSTDFRGGGFISLENLLYFSRNYPKSFQELLRKQNGDRALWEYPFAVAGVNITFMLIQMLDLQAAKPTSLVGAVFLNLLLENDRAFDILYCITFKLMDQKWLEMHASYMDFNTVIKSTRRQLERELLLEDIQRIEDMPSYRFLAC

SEQ ID NO: 5130 - protein, 267 aa, Panicum virgatum
  misc_feature (154)..(154): Xaa can be any naturally occurring amino acid
  misc_feature (169)..(169): Xaa can be any naturally occurring amino acid
MDQNVGSFVAVRRLSGAGAVHHHRHHSSPAEVVGVSTAWIGKGLSCVCAQRRDSDARLSFDLTAIQEECWHRLQNRIEVQYDGSNLEHQKALKALWRASFPGTELLGLVSDQWKEMGWQGKDPSTDFRGGGFISLENLLYFSKNFPKSFQELLXKKNGDRALWEYPFAXAGVNITFMLIQMLDLQAAKPKSLIGAVFLNLLKENDRAFDILYCITFKLMDQKWLDMHASYMDFNSVIKSTRRQLERELLLEDIQRIEDMPSYRFLAR

SEQ ID NO: 5131 - protein, 266 aa, Sorghum bicolor
MEQNAGSFLAVRRLSGGAIHHNRHHSSPAEVVGVSTAWLGKGLSCVCAQRRETDARLSFDLSPIQEECFHRLQNRIEVQYDGSNLEHQKALEALWRASFPGTELLGLVSDQWKEMGWQGKDPSTDFRGGGFISLENLLYFSRNYPKSFQELLCKKNGDRALWEYPFAVAGVNITFMLIQMLDLQAAKPTSLIGAVFLNLLLENDRAFDILYCITFKLMDQKWLEMHASYMDFNTVIKSTRRQLERELLLEDIQRIEDMPSYRFLSC

SEQ ID NO: 5132 - protein, 265 aa, Triticum aestivum
RPRAAWKQNGGSFLAVRRLSGHHHPSPADVVSGSTAWIGRGFSCVCVQRRDSDARISFDLTPIQEECLQRLQNRIEVPYDSQNGEHQEALKALWHASFPGTELLGLVSDQWKEMGWQGKDPSTDFRGGGFISLENLLYFAKNYPKSFEELLCKQNGDRALWEYPFAVAGVNITFMLIQMLDLQAAKPRSLIGAVFLNLLIENDRAFDILYCITFKLMDRKWLEMHATYMDFNTVIKSTRRQLERELLLEDIQQIEDMPSYSFLAR

SEQ ID NO: 5133 - protein, 266 aa, Oryza sativa
MDRNAGSFVAMRRLSGGSSCHDPSPNTYAEVVAGSTAWIGRGFSCVCAQRRDSDQRISFDLSPAQECCLQRLQNRIEVPYDGSNGEHQEALKTLWHVSFPGTELLGLVSDQWKEMGWQGKDPSTDFRGGGFISLENLLYFAKNYTKSFQELLCKQNGDRALWEYPFAVAGVNITFMLIQMLDLQAAKPRSLIGSVFLNLLLENDRAFDILYCITFKLMDHKWLEMHANYMDFNAVIKSTRRQLERELLLEDIQRIEDMPSYRFLDR

SEQ ID NO: 5134 - protein, 327 aa, Sorghum bicolor
MAAIRHRTVEANGISMHVAESGAEGDPAVVFLHGFPELWYSWRHQMAHLAARGYRCVAPDLRGYGGTAAPTDVASYTAFHVVGDVVALLDALGIQKVFVVGHDWGAIIAWYLCLFRPDRVTALVNTSVAFMRHVFIRAGASAVKPTDYFCRNYGPTYYICRFQEPGVAEKEFSPATARYLMKPILCNRFTSSAAGGEKPADTAAPAAPVEEPLPPWLTEEDVGHFVSEFERTGFTGPINYYRNMDRNWELAAPWADAKVQVPTRFIVGDGDLTYHYPGIQDYIHKGGFQADVPGLDSVVVIPGAGHFVQQEKADEVSQHIYDFISKF

SEQ ID NO: 5135 - protein, 334 aa, Panicum virgatum
MDGAAAAAIRHRTVEANGIAMHVAECGGEEETSPRAVVVFLHGFPELWYSWRHQMEHLAARGYRCVAPDLRGYGGTGAPPDVASYSAFHVVGDVVALLDALGLAKVFVVGHDWGAIIAWYLCLFRPDRVTALVNTSVAFMRHIFIRAGAGAAAVKTTDFFNRTYGPTYYICRFQEPGVAEKEFSPANARYIVRQILCNRFTSEAAGGAKPAAAAADEEPLPPWLTEADVDRFASEFERTGFTGGINYYRNMDRNWELAAPWADAKVAVPTRFVVGDGDLTYHYPGIQDYIHKGGFKADVPLLEDVVVIPGAGHFIQQEKADEVSHHIYDFISKF

SEQ ID NO: 5136 - protein, 439 aa, Sorghum bicolor
MGRYELVRSDDAAAGATGTDLECGASASKASTTSPAAPSTTSPAARQPRLVSLDVFRGITVLLMIIVDDAGGFLPSLNHSPWDGVTIADFVMPFFLFIVGVSLTLAYKRVPDKLEATKKAVLRALKLFCLGLVLQGGFFHGVHSLTFGVDLTKIRLMGILQRIAIAYLLAAICEIWLKGDDDVDSGYGLLRRYRYQLFVGLVLSIAYTILLYGIYVPDWEYKISGPGSTEKSFSVKCGVRGDTGPACNAVGMVDRTILGIDHLYRRPVYARTKECSINYPENGPLPPDAPSWCQAPFDPEGLLSSVMAIVTCLIGLQFGHIIIHFEKHRGRITNWLIPSFSMLALAFLMDFSGMRMNKPLYTISYTLATAGAAGLLFAGIYALVDLYGFRKPTIPMEWMGKHALMIYVLVACNILPMFIRGFYWRDPNNSLLKVIGIGA

SEQ ID NO: 5137 - protein, 434 aa, Pennisetum glaucum
MGGYELVRSDDAAGAPGPDLESGAGANSKAAPSPPTAAPRGQPRLVSLDVFRGITVLLMIIVDDAGGFVPALNHSPWDGLTIADFVMPFFLFIVGVALTLAYKRVPDKLEATKKAVLRALKLFCLGLVLQGGFFHGVHSLSFGVDLAKIRLMGILQRIAIAYLLAAICEIWLKGDDDVDSGLDLLRRYRYQLFVGLVLSFTYTVLLYGIYVPDWEYQISGPGSVEKSFSVKCGVRGDTGPACNAVGMVDRTVLGIDHVYRRPVYARTKQCSINYPQNGPLPPDAPSWCQAPFDPEGLLSSVMAIVTCLIGLQFGHIIIHFEKHRGRITNWLIPSFSMLAVAFLMDFVGVRMNKPLYTISYTLATAGSAGLLFAGIYTLVDVYGFRRPTITMEWMGKHALMIYVLVACNILPMFIRGFYWRDPNNSLLKFIGIGA

SEQ ID NO: 5138 - protein, 193 aa, Sorghum bicolor
MAGVQVTPAAVGVAGLRGSGVGSTTGLFAGDWRRKARRPACSVWALRRQQRRSSSRSKGGGLAIVCNLAGQYEDSFDDVQRQLMNYFTYKAVRTVLTQLYELNPPSYRWFYNFVAVNKPTDGKHFLRALSKERQELAERVMITRLHLYGKWIKKYDHANTYEKISDENLTLMRERLMETVIWPTDDTNTEKIG

SEQ ID NO: 5139 - protein, 478 aa, Sorghum bicolor
MPLALAQLQDLRDRISDHLRPWSRSAQFWVRAADIYTSYKVCQLRAGFVKDEDEREAMWEQQHELGAQKMYSLCSELGGLFLKAAQILGKPDLAPMAWVKRLVTLCDQAPATPFVVVRDVVEKQFGKNFDDIFEFFDVEPVGSASIAQVHRARLKLSKADVAVKVQHPGAEHLMMVDIRNMQAMALFLQKYDINFDLFSATKEMEKQICYEFDFVREARAMERIREFLRVTNKKPPVMVPRVIPGMVSREVLVMEFIKGTPIMNLGNEMAKRGIDPGGKIAAMAKQKILSDLTLAYGQMILKDGFFHADPHPGNILICKDTEVALLDYGQVKEMPEDLRLAYANLVVAMADDDFLRAEESFRELGIRTWAITDNKLEELFQLSLRMFDTRLPPGVTVMSPFADDSSLNKIGVESFPEELFSVLRTIQLLRGLTVGMGLTFSCAQHWRPIAEEVLLKAGRQNASKSRNQKRSFLRRLFW

SEQ ID NO: 5140 - protein, 478 aa, Zea mays
MPLALAQLQDLRDRISDRLRPWSRSAQFWVRAADIYTSYKVCQLRAGFVKDEDELETMWERQHELGAEKMYSLCSELGGLFLKAAQILGKPDLAPMAWVKRLVTLCDQAPSTPFDVVRDVVEKQLGKNFDDMFEFFDVEPVGSASIAQVHRARLKLSKTDVAVKVQHPGAEQLMMVDIRNMQAMALFLQKHDLNFDLFSATKEMEKQICYEFDFVREARAMERIREFLRVTNKKPPVMVPRVIPGMVSREVLIMEFIKGTPIMNLGNEMAKRGIDPGGKIAAMAKQKILSDLTLAYGQMILKDGFFHADPHPGNILICKDTEVALLDYGQVKEMPEDLRLAYANLVVAMADDDFSRAEESFRELGIRTWAITDNKLEELFQLSLRMFDTRLPPGVTVMSPFADDSSLNKIGVESFPEELFSVLRTIQLLRGLTVGMGLTFSCAQHWRPIAEEALLKAGRQSASKSRKQKRSFLRRLFW

SEQ ID NO: 5141 - protein, 321 aa, Panicum virgatum
  misc_feature (151)..(151): Xaa can be any naturally occurring amino acid
MPLALAQLQDLRERISDSLRPWSRSAQFWIRAADIYTSYKVCQLRAGFVKDEEEREAMWEQQHELGAQKMYSLCSELGGLFLKAAQILGKPDLAPMAWVKRLVTLCDRAPATPYDVVRDVVEKQFGKNFDDIFEFFDVEPVGSASIAQVHXARLKFSKTDVAVKVQHPGAEHLMMVDIRNMQAMALFLQKYDINFDLFSATKEMEKQICYEFDFVREARAMERIREFLRATNKKPPVMVPRVIPGMVSREVLVMEFIKGTPIMNLGSEMAKRGIDPGGKIAAMAKQKILSDLTLAYGQMILKDGFFHADPHPGNILICGFT

SEQ ID NO: 5142 - protein, 487 aa, Oryza sativa
MPLALAQLQDIGDRITDRLRPWSRSAEFWVRAADIYTSYKVCQLRAGFVKDEEEREAMWEQQHELGAQKMYSLCSELGGLFLKAAQILGKPDLAPMAWVKRLVTLCDNAPATPIDVVRDVVEKQFGKSFDDIFECFDVEPVGSASIAQVHRARLKLSKTDVAVKVQHPGAEKLMMVDIRNMQAFALFLQKYDINFDLYSATKEMEKQICYEFDFVREAKAMERIREFLRVTNKKKPPVIVPRVIPEMVSREVLVMEFIEGTPIMNLGNEMAKRGIDPGGKIATMAKQKILTDLTLAYGQMILKDGFFHADPHPGNILICKNTEVALLDYGQVKAMPEDLRLAYANLVIAMADDDFLRTKESFREIGIETWSIADNELEELFQLSLRMFDTRLPPGVTAMSPFAEDSSLNKVGVQSFPEELFSVLRTIQLLRGLTVGMGLRFSCAQQWKPIAEEALLKSGRLKAARSRRPRRSFVRRLFSSDNENQGT

SEQ ID NO: 5143 - protein, 420 aa, Triticum aestivum
MWEQQHEIGAQKMYSLCSELGGLFLKAAQILGKPDLAPTAWVKRLVTLCDKAPSTPIEVVRDVVEKQFCKSFDEIFDFFEVEPVGSASIAQVHRARLKSSKTDVAVKVQHPGAEQLMMVDIRNMQAFALFLQKYDINFDLFSATKEMEKQICYEFDLVREARAMERIREFLRVSNKKPPVMVPRVIPGMISREVLVMEFIQGTPIMNLSSEMSKRGIDPAGKLAAMAKQKILTDLTLAYGQMILKDGFFHADPHPGNILICNNTEVALLDYGQVKEMPEDLRLAYANLVIAMADDDLLRTKESLSEFGFKTWSIADNELEELFQLSLRMFDTRLPPGVTVLSPFADDSSLNKVGVESFPEELFSVLRTIQLLRGLTVGMGLRFSCAQQWKPIAEEALLKAGRIKDVKSRRPRRSFLRRLF

SEQ ID NO: 5144 - protein, 477 aa, Brachypodium distachyon
MPLPLAQMQELRDRLSDRFRPWSRSAQFWVRAVDIYGSYKVCQLRAGFVKDEDEREAMWEQQHEIGAQKLYSLCSELGGFFLKAAQIVGKPDLAPTAWVKRLVTLCDKAPSTPIEVVREVVEKQFNKSFDEIFDFFDVEPVGSASIAQVHRARLKSSKTDVAVKVQHPGAEKLMMVDIQNMQAFALFLQKHDINFDLFSATKEMEKQICYEFDFVREARAMERIREFLRVTNKKPPVMVPRVIPGMISREVLVMEFVQGTPIMNLGNEMSKRGIDPGGKLGAMAKQKILTDLTLAYGQMILKDGFFHADPHPGNILICNNTEATLLDYGQVKEMPEDLRLAYANLVIAMADDDHIRAQESLREFGFKTWSIADNELEELFELSLRMFDTRLPPGVTVLSPFADDSSLNKVGVESFPEELFSVLRTIQLLRGLTVGMGLRFSCAQQWRPIAEEALLKAGRIKDVKSRRSRRSFLRRLF

SEQ ID NO: 5145 - protein, 477 aa, Triticum aestivum
  misc_feature (214)..(214): Xaa can be any naturally occurring amino acid
  misc_feature (235)..(235): Xaa can be any naturally occurring amino acid
  misc_feature (238)..(238): Xaa can be any naturally occurring amino acid
MPLPLAQVQELRDRLSDRFRPWSRSAQFWVRAVDIYGSYKVCQLRTGFVKDEEEREAMWEQQHEIGAQKMYSLCSELGGLFLKAAQILGKPDLAPTAWVKRLVTLCDKAPSTPIEVVRDVVEKQFCKSFDEIFDFFEVEPVGSASIAQVHRARLKSSKTDVAVKVQHPGAEQLMMVDIRNMQAFALFLQKYDINFDLFSATKEMEKQICYEFDXVREARAMERIREFLRVSNKKXPVXVPRVIPGMISREVLVMEFIQGTPIMNLSSEMSKRGIDPAGKLAAMAKQKILTDLTLAYGQMILKDGFFHADPHPGNILICNNTEVALLDYGQVKEMPEDLRLAYANLVIAMADDDLLRTKESLSEFGFKTWSIADNELEELFQLSLRMFDTRLPPGVTVLSPFADDSSLNKVGVESFPEELFSVLRTIQLLRGLTVGMGLRFSCAQQWKPIAEEALLKAGRIKDVKSRRPRRSFLRRLF

SEQ ID NO: 5146 - protein, 288 aa, Hordeum vulgare
MPLPLPLAQAQELRDRLSDRLRPWSRSAQFWVRAVDIYGSYKVCQLRTGFVKDEEEREAMWEQQHEIGAQKMYSLCSELGGLFLKAAQILGKPDLAPTAWVKRLVTLCDRAPSTPIEVVRGVVEKQFCKSFDEIFDFFEVEPVGSASIAQVHRARLKSSKTDVAVKVQHPGAEQLMMVDIRNMQAFALFLQKYDINFDLFSATKEMEKQICYEFDFVREARAMERIREFLRVSNKKPPVMVPRVIPGMISREVLVMEFIQGTPIMNLSNEMSKRGIDPAGKLAAMAKQ

SEQ ID NO: 5147 - protein, 428 aa, Sorghum bicolor
MGNAAVAIASSVGGTATVVVMIVLIRRCRAVRKKIKKKIVKKVLEELEKKNREMQVSNNVEDVVIEVGPVETFLNQILNEKPMRFSSQQLAACTRNYSSELGSGGYGVVYKGELPNGLPVAVKVLKVSMNKRVQEAFMAEIGTIGRTYHVHLVRLYGFCFDANTKALVYEYLENGSLEKYLYGDVEGSTATRLEWEALHGIAVGTAKGIRYLHEECQQRIVHYDIKPANILLTADYTPKVADFGLARLGERENTHMSLTGGGRGTPGYAAPELWLALPASEKCDVYSFGMVLFEILGRRRNFDPCHGESKEWFPRWVWEKYEQGEIDCVVSCDGVVGEADRQKAEMMCKVALWCVQFQPAARPTMSSVVRMLEGEMAIVPPANPFHYVMDSNIGSTNSGFWSDTYQSSRETIGRDSELSVIRAVVKST

SEQ ID NO: 5148 - protein, 446 aa, Zea mays
MGNAAVAIISSVSATATVVVMIALIRRCRVVRKKIKKKIVKKVLEEIERKNRVGAACDALEDVVIEIGPVEKFLNEILNEKPMRFSSEQLAACTKNYSSELGSGGYGVVYKGELPNGLLVAVKVLKVSMNKKVQEAFMAEIGTIGRTYHVHLVRLYGFCFDADTKALVYEFLEKGSLEKYLYCDEGSTATRLEWATLHGIAVGTAKGIRYLHEECQQRIVHYDIKPANILLTADYTPKVADFGLARLGERENTHMSLTGGGRGTPGYAAPELWMALPASEKCDVYSFGMVLFEILGRRRNYDPCQGESKEWFPRWVWERYAQGEIEDVVACDGIVGDADREKAEMMCKVALWCVQFQPSARPTMSSVVRMLEGEMAIVPPVNPFHYVMESSSASTSSGLWSGTYQSSRDTTARESELSASPAAKSTDAMIEDVERAYASVLAKQSL

SEQ ID NO: 5149 - protein, 439 aa, Panicum virgatum
MGNAAVAIKDARVVVVSALIRRCRVVRKKMKKKIGKKIIKEIERLNRESQACKALEDVVIEIGPVEKFLNDILNEKPMRFSPEQLAACTRNYSSELGSGGFGVVYKGDLPNGLPVAVKVLKVSMNKKVQEAFMAEIGTIGRTYHVHLVRLYGFCFDRDTKALVYEFLEMGSLEKYLYGGDEEGTAPRLEWRTLHSIAVGTAKGIRYLHEECQQRIVHYDIKPANILLTGDFTPKVADFGLARLGERENTHMSLTGGGRGTPGYAAPELWMALPATEKCDVYSFGMVLFEILGRRRNFDPCVGESKEWYPRWVWEKYEQGELECVVSGDGIGEADRDKAEMMCKVALWCVQFQPAARPTMSSVVRMLEGEMAIVPPVNPFHYVMDSSSGSTSSGLWSSGTYQSSRDTTGRNSQMSGSHSALQLDAMIEDVKRTDVPVSMK

SEQ ID NO: 5150 - protein, 414 aa, Zea mays
MGNALAIITTIIVSKRMKKKIIKKVLEEIEKKNRETQASNNAVEDAVIEVGPVETFLNQILNEKPMRFSSEQLAACTRNYSSELGSGGYGTVYKGELPNGLLVAVKVLKVSMNKKVQEAFMAEIGTIGRTYHVHLVRLYGFCFDANTKALVYEYLEKGSLEKYLYYGDVECSTSTGKRLEWGTLHGIAVGTAKGIRYLHEECQQRIVHYDIKPANILLTADDTPKVADFGLARLGEREDTHMSLTGGGRGTPGYAAPELWMALPASEKCDVYSFGMVLFEILGQRRNYDPCRGESREWFPRWVWERYEQGEIEYVVSCDGIGEADMEKAEIMCKVALWCVQFQPAARPTMSSVVRMLEGEMPIVPPVNPFHYVMDSSSGSTSSGLWSDTYQSSRETIGIAIDSELSVSPIAKST

SEQ ID NO: 5151 - protein, 460 aa, Sorghum bicolor
MAETPTYQILVRLLDGRTRCLRFSTPTVSGTVLLDAVASISRVPADALRLVTGRIDVSPSSVLTSAADGQFPYASALLRLRGGKGGFGSLLRGAASKAGQKKTSNFDACRDINGRRLRHVNAERRLEEWKAEAADRQLEKLAENFIKKKAKEAGRSGGPSAAEVDKYLEKYRKDAEICVNAVEESVRASLGKRKTAPKLPSGADAKKLKIWLGKNKVEEDESDSDSDIDSDVDDENSEDHENTDAKSVLVDDGNCSNGSSKNEKLELGSVSGSHSEGESSGEKSQLTTRSGAEGGDFESDGSAEPEVGMVDHLISVNSAAAAASEEVLKSDEVTADEDNTASATSNQSNPGVPQVEEALKADEDKAASATSNQNNPEVPQLEEYADASKSYSEPLDLAKYSSAAELEVLGLEKLKIELQSRGLKCGGTLQERAARLFLLKTTPLDKLPKKLLAKATTGGK

SEQ ID NO: 5152 - protein, 468 aa, Saccharum officinarum
MAETPTYQILVRLLDGRTRCLSFSTPTVSGAVLLDAVASISRVPAAALRLVTGRIDVSPSNVLTSAADGQFPSASALLRLRGGKGGFGSLLRGAASKAGQKKTSNFDACRDINGRRLRHVNAERRLEEWKAEAADRQLEKLAENFIKKKAKEAGRGGGPSAAEVDKYLEKYRKDAEICVNAVEESVRASLGKRKTAPKPPSGADAKKLKIWLGKNKVEEDESDSDSDVDDEDSEDDESADAKSVVVDDGNCSNGSSKNEEEKLDMGSVSGSHSEGESSGEKSQHSNSEENVKCVQSTVELTTRSGAEGGDFESDGSAEPEVGMVDHPFSVNSAVAAASEEVKADEDNTTSATSYQNNTEVPQVEEALKADEDNTASATSNQNNPVVPQVEECADASKSYSEPLDLSKYSSAAELEVFGLEKLKIELQSRGLKCGGTLQERAARLFLLKTTPLDKLPKKLLAKATAGGK

SEQ ID NO: 5153 - protein, 458 aa, Zea mays
MAEAPTYQILVRLLDGRTTCLRFSTPTVSGAVLLEAVASISRVPAAALRIVTGRFDVSPSNVLTSSADGQFPSASALLRLRGGKGGFGSLLRGAASKAGQKKTSNFDACRDINGRRLRHVNAERRLEEWKAEAGDRHLEKLAENFIKKKAKEAGRRGGPSAAEVDKYLEKYRKDAEICVNAVEESVRASLGKRKTAPKPPSGADAKKLKIWLGKNKVEEDESDSDSDSDMDDEDSEDQESADAKSLVVDEGNCSNGSIKNEKLDLGSVSGSHSEGESSGEKSQPTTKSGAEGGDFESDGSAEPELGMVDHPIPVNNAVAAASEEVLKSDEVTADEDNTTSATSNQNNPVVPQVKEALKADEDNSASATSNQNNPEVPKVEEYADASKSYSEPLDLAKYSSAVELEVLGLEKLKIELQSRGLKCGGTLQERATRLFLLKTTPLDKLPKKLLAKAAIGGK

SEQ ID NO: 5154 - protein, 108 aa, Triticum aestivum
LQLVVCTMAQYYSEVDHCAEEMNWPPHAGGEHYAVRRESYEEVDEMARAGRGHHHGGGGGGHLGYSGSRHGDAHLGGHREEHLVHGDEHRHGHGGGRQYDSCTGQYYG

SEQ ID NO: 5155 - protein, 178 aa, Panicum virgatum
MSGSVETQARAFADEVRGGALEAKNWMLDLGHPLLNRVAESFVKAAGIGAVQAVARESYFMAIEGEGGSVSGATGSRKRSFPELNGTNSGSKSAEAMVKNVSKESLQWGLAAGVHSGLTYGLTEVRGTHDWRNSAVAGAITGAAVALTSDRASHEQVVQCAIAGAALSTAANVLSGIF

SEQ ID NO: 5156 - protein, 177 aa, Setaria italica
MSGSMETQARAFADEVRGGLEGKSWMLDLGHPLLNRIAESFVKAAGIGAVQAVARESYFMAIEGEGGSVSGATGSRKRSFPELNGTNSGSKSAEAMVKNVSKESLQWGLAAGVHSGLTYGLTEVRGTHDWRNSAVAGAITGAAVALTSDRASHEQVVQCAIAGAALSTAANVLSGIF

SEQ ID NO: 5157 - protein, 177 aa, Pennisetum glaucum
MSGSMETQARAFADEVRGGLEGKNWMLDLGHPLLNRIAESFVKAAGIGAVQAVARESYFMAIEGEGGSVSGATGSRKRSFPELNGTNNGSKSAEAMVKNVSKESLQWGLAAGVHSGLTYGLTEVRGAHDWRNSAVAGAITGAAVALTSDGASHEQVVQCAIAGAALSTAANVLSGIF

SEQ ID NO: 5158 - protein, 175 aa, Pseudoroegneria spicata
MSSQEARKFVEEVRGLEKNWMLDLGHPLLNRVADSFIKAAGIGAIQAVTRDSYFMAIEGESGGTGAVSDATGSRKRTFPDLNGGTSNSKSAEAMVKSVSKESFQWGLAAGMHSGLTYGLAEVRGTHDWKNSAVAGAVTGAAVALTSDNASHEQIVQCAITGAALSAAANVLSDIV

SEQ ID NO: 5159 - protein, 175 aa, Triticum aestivum
MSSHETRKFVDEVRGLEKNWMLDLGHPLLNRVADSFVKAAGIGAIQAVTRDSYFMAIEGESGGTGAVSGATGSSKRTFPDLNGGTSNSKSAEAMVKSVSKESFQWGLAAGMHSGLTYGLAEVRGTHDWKNSALAGAVTGAAVALTSDNASHEQVVQCAITGAALSAAANVLSDIV

SEQ ID NO: 5160 - protein, 175 aa, Triticum aestivum
  misc_feature (19)..(19): Xaa can be any naturally occurring amino acid
  misc_feature (57)..(57): Xaa can be any naturally occurring amino acid
  misc_feature (69)..(69): Xaa can be any naturally occurring amino acid
  misc_feature (82)..(82): Xaa can be any naturally occurring amino acid
MSSHEARKFVEEVRGLEKXWMLDLGHPLLNRVADSFVKAAGIGAIQAVTRDSYFMAXEGESGGTGAVSXATGSRKRTFPDLXGGTSNSKSAEAMVKSVSKESFQWGLAAGMHSGLTYGLAEVRGTHDWKNSAVAGAVTGAAVALTSDNASHERVVQCAITGAALSAAANVLSDIV

SEQ ID NO: 5161 - protein, 175 aa, Triticum aestivum
MSSHEARKFVDEVRGLEKNWMLDLGHPLLNRVADSFVKAAGIGAIQAVTRDSYFMAIEGESGGTGAVSGATGSSKRTFPDLNGGTSNSKSAEAMVKSVSKESFQWGLAAGMHSGLTYGLAEVRGTHDWKNSALAGAVTGAAVALTSDNASHEQVVQCAITGAALSAAANVLSDIV

SEQ ID NO: 5162 - protein, 512 aa, Saccharum officinarum
MQSTVKLAVLALLLAAAAHHGLLPLPTARCYWLNPEIYDAGGLSRRAFPEGFVFGTAASAYQVEGMAKRGGRGPSIWDAFIEVPGTIPNNATADVTVDEYHRYKEDVNIMKNMGFDAYRFSISWSRIFPNGTGKVNQEGVDYYNRLIDYMLQQGITPYANLYHYDLPLALHEQYLGWLSPKIVEAFADYAEFCFQTFGDRVKNWFTFNEPRCVAALGYDNGLHAPGRCSECAAGGNSTTEPYLAAHHLILSHAAAVRRYRDKYQLYQKGRIGILLDFVWYEPFSDSNADQAAAQRARDFHLGWFLDPIINGRYPYSMQEIVKDRLPLFSDEESRMVKGSIDYVGINHYTSFYMKDPGTWNLTPVSYQDDWHVGFVYERNGVPIGAHANSYWLYIVPWGINRAVNYVKETYENPTMILAENGMDQAGDVSITQGVHDTVRIRYYRDYITELKKAIDGGARVIGYFAWSLLDNFEWRLGYTSRFGLVYVDYKTLKRYPKDSAFWFKHMLSKKRS

SEQ ID NO: 5163 - protein, 512 aa, Sorghum bicolor
MQSTVKLAVLALLLAAAAHHGLLPLPTALCYWLNPEIYDAGGLSRRAFPEGFVFGTAASAYQVEGMAKHGGRGPSIWDAFIEVPGTIPNNATADVTVDEYHRYKEDVNIMKNMGFDAYRFSISWSRIFPNGTGKVNQEGVDYYNRLIDYMLQQGITPYANLYHYDLPLALHEQYLGWLSPKIVEAFADYAEFCFQTFGDRVKNWFTFNEPRCVAALGYDNGLHAPGRCSECAAGGNSTTEPYLAAHHLILSHAAAVRRYRDKYQLYQKGRIGILLDFVWYEPFSDSNADQAAAQRARDFHLGWFLDPIINGRYPYSMQEIVKDRLPLFSDEESRMVKGSIDYVGINHYTSFYMKDPGTWNLTPVSYQDDWHVGFVYERNSIPIGAHANSYWLYIVPWGINKAVNYVKETYENPTMILAENGMDQPGDISITQGVHDTIRIRYYRDYITELKKAIDDGARVIGYFAWSLLDNFEWRLGYTSRFGLVYVDYKTLKRYPKDSAFWFKHMLSKKRS

SEQ ID NO: 5164 - protein, 512 aa, Zea mays
MQSSVKLAVLALLLAAAAHHGLLPLPTARCYWLNPEIYDAGGLSRRAFPDGFVFGTAASAYQVEGMAKHGGRGPSIWDAFIEVPGTIPNNATADVTVDEYHRYKEDVNIMKNMGFDAYRFSISWSRIFPDGTGKVNQEGVDYYNRLIDYMLQQGIAPYANLYHYDLPLALHEQYLGWLSPKIVEAFADYAEFCFHAFGDRVKNWFTFNEPRCVAALGYDNGLHAPGRCSGCPAGGNSTTEPYLVAHHLILSHAAAVRRYRDKYQLHQKGKIGILLDFVWYEPFSDSNADQAAAQRARDFHLGWFLDPIVHGRYPYSMQEIAKDRLPLFSDEEARMVKGSIDYVGINHYTSFYMKDPGTWNLTPVSYQDDWHVGFVYERNGVPIGAHANSYWLYIVPWGINKAVSYVKETYKNPTMILAENGMDQPGDVSITQGVHDTVRIRYYRDYITELKKAIDDGARVIGYFAWSLLDNFEWRLGYTSRFGLVYVDYKTLKRYPKDSAFWFKHMLSKKRS

SEQ ID NO: 5165 - protein, 500 aa, Brachypodium distachyon
MKSTALVLLTLAAHVLLAQCHRPEIHDTGGLSRGAFPEGFVFGTAASAYQVEGMAKRGGRGPSIWDAFIEIPGMISGNGTADVAVDEYHRYKEDVDIMKSMGFDAYRFSISWSRIFPNGAGKVNQEGVDYYNRLIDYMLQQGITPYANLYHYDLPLALHQQYLGWLSPKIVEAFADYADFCFKVFGDRVKNWFTFNEPRCVAALGYDNGYHAPGRCSQCTAGGNSMTEPYLVAHHLILSHAAAVKRYREKYQHHQKGKIGILLDFVWYEPLSKSKADQAAAQRARDFHLGWFLDPIVHGQYPESMLKIVEGRLPTFSHEESRMVKGSMDYVGINHYTSYYMKDPGAWNLTPVSYQDDWHVGFVYERNGVPIGARANSYWLYIVPWGINKAVTYVKERYGNPTMFLSENGMDQPGNVSITEGVHDTVRVRYYREYITELKKVIDDGARVIGYFAWSLLDNFEWRLGYTSRFGIVYVDYKTLKRYPKDSAFWFKNMLSKKRS

SEQ ID NO: 5166 - protein, 476 aa, Setaria italica
IYNTGGLSRRAFPAGFVFGTAASAYQVEGMAKQGGRGPSIWDAFIKVPGTIPDNATADVAVDEYHRYKEDVNIMKNMGFDAYRFSISWSRIFPNGTGEVNQEGVDYYNRLIDYMIQQGITPYANLYHYDLPLALHEQYLGWLSPKIVEAFADYAEFCFQMFGDRVKNWFTFNEPRCVAALGYDNGLHAPGRCSGCAAGGNSTTEPYLVAHHLILSHAAAVKRYRDKYQLYQKGRIGILLDFVWYEPFSDSNADRAAAQRARDFHLGWFLDPIVNGRYPYSMQEIVEDRLPLFSDEESRMVKGSIDYVGINHYTSFYMKDPGTWNLMPISYQYDWHASFVYERNGVPIGAHANSYWLYIVPWGINKAVNYVKETYENPIMILAENGMDQPGNISISQGVHDTIRIRYYRDYITELKKAIDDGARVIGYFAWSLLDNFEWRLGYTSRFGLVYVDYKTLKRYPKDSAFWFKHMLSKKRS

SEQ ID NO: 5167 - protein, 160 aa, Triticum aestivum
MEHQGQHGHVTSRVDEYGNPVGTGAGHGQMGTAGMGTHGTAGTGGGQFQPMREEHKTGGVLQRSGSSSSSSSEDDGMGGRRKKGIKEKIKEKLPGGNKGEQQHAMGGTGTGTGTGGAYGQQGHGTGMTTGTTGAHGTTTTDTGEKKGIMDKIKEKLPGQH

SEQ ID NO: 5168 - protein, 379 aa, Zea mays
MPLAAEPDDAHEERENQQLLITTKGGPGLEGLVVGSYCHDVLIRGGRIVGETLGGAAAFVSNVLDAASPQGAALNETSPFVVVAKVGHDFIYARAPASARHPPLLCSSPTTSFHAQFSETAASAHAPDRELRRVRACDPIYPADLPDRRFAYGLAVGVAGEVLPETLEQMIRLCRTVLVDAQALIRAFDGDGAVGHVALGDTPYARLLPRVAFVKASSEEAPYVGVETTRRQCCVIVTEGRDGCRLYWDGGEAHVAPFPAVQVDPTGAGDSFLAGFAAGLLWGLSATDAALLGNFFGAAAVSQVGVPTFHPKMLQAVKEILEEKTRKRSSPCMNGASFTLEKSNMHNELHAALQEAAVLMSEQQQADPANGSGGDICSA

SEQ ID NO: 5169 - protein, 380 aa, Setaria italica
MPLAAEPDDAREEMENHQQLPTTAKGAPALEGLVVGSYCHDVLIRGGRVVGETLGGAAAFVSNVLDAASPREEEEQGEAPFVVVSKVGHDFAYASAPGPARRPPLLCASPTTSFHAQFSDAASSAHAPDRELRRVRACDPIYPADLPDRRFAYGLAVGVAGEVLPETLERMIRLCRAVLVDAQALIRAFDGDGAVGHVALEDTPYARLLPRVAFLKASSEEAPYVGLETARRRCCVIVTDGRDGCRLYWDGGEARVVPFPAVQVDPTGAGDSFLAGFAAGLLWGLSATDAALLGNFFGAAAVSQVGVPTFHPKMLQAVKEILEEKTTKRSSPCINGTTFTLERSNVHDELHAALQEAARLMSEQQQADPANGNGGDICST

SEQ ID NO: 5170 - protein, 726 aa, Zea mays
MEGWLYLIRSNRFGMQYSRKRYFVLEDAALRCFKSTPSSKREDPVRSAIIDSCIRVTDNGRESVHRSDFYIFTLYNSSNHYDQLKLGARSSEEAARWIRCLMESALKSPRKDEHIVACSHRRWQAFRLSRRNSRMHSIDWTLFSSAHNDPMASDVIAPSPWTIFGCTNGLRLFTEANDGGSHGKYWDDHPAIMAVGVVDANSEAVFQTLMSLGQSRSEWDFCLREGKVIEHLDGHTDIIQKKLRSDWLPWGMRKRDLLLRRYWRREDDGTYVILYHSVFHYKCRPEKGYIRACLKSGGYVISPVNQGRQSVVKHMLAIDWKFWKSYLFTSSAKYITIRMLGRVAALREFFRAKNGNCSCMEFSSGELTRDTGLPQGENQRINLEMQQENENGRLEGPTEGSLGGSNRHLSSTGSFVQLNDAADEFFDVPDESEYDQREVMFPSDESLHAADQRHAKLSTAAVFVKRLHDLAVQKRGYIDLQGAADADNGPCCYGYTLPKDSSYTVPSTWAMTDPTTFLIRGETYLHDRIKIKANSTLMQMVGADWIKSDKREDDLAGRPGGLVQKCAAQGGTRFFFIVNIQVPGSTTYSLALYYMMDTPLEKVPLLERFVNGDDAFRNSRFKLIPYISKGSWIVKQSVGKKACLVGQALEINYFRGRNYLELGVDIGSSTVARGVVSLVLGYLNNLVIEMAFLVQGNTNEELPEFLLGTCRLNYLDASKAVSIDEC

SEQ ID NO: 5171 - protein, 726 aa, Pennisetum glaucum
MEGWLYLIRSNRFGLQYSRKRYFVLEDAALRCFKSAPSSKREDPVRSAIIDSCIRVTDNGRESVHRSDFYIFTLYNASNHYDQLKLGARSSEEAARWIRCLMESALKSPRKDEHIVACSHRRWQAFRLSRRNSRMHSIDWTLFSSAHNDPMASDVIAPSPWTIFGCKNGLRLFTEANDGGSHGKYWDDHPAIMAVGVVDANSEDVFQTLMSLSQSRSEWDFCLREGKVVEHLDGHTDIIHKKLRGDWLPWGMRKRDLLLRRYWRREDDGTYVILYHSVFHYKCRPERGYIRACLKSGGYVISPINQGRQSVVKHMLAIDWKFWKSYLFTSSAKYITVRMLGRIAALREFFRSKNGNCACMEFSSGELTRDMRLPQGENGRINLEMHQENESRRLEGPTEGSLGGSDRHLSSTGSFVQLNDAADEFFDVPDESEYDQREIVFPSDESTHAVDQRHAKLSTAAVFVKRLHDLAVQKRGYIDLQGAADADNGPCCYGYTLPKDSSYTVPSTWAMTDPTTFLIRGETYLHDRLKIKANSTLMQMVGADWIKSDKREDDLAGRPGGLVQKCAAQGGTKFFFIVNIQVPGSTTYSLALYYMMDTPLEKVPLLERFVNGDDAFRNSRFKLIPYISKGSWIVKQSVGKKACLVGQALEINYFRGRNYLELGVDIGSSTVARGVVSLVLGYLNNLVIEMAFLVQGNTSEELPEFLLGTCRLNYLDASKAVSIDEC

SEQ ID NO: 5172 - protein, 412 aa, Panicum virgatum
MLAIDWKFWKSYLFTSSAKYITIRMLGRIAALREFFRARNGNCACLEFSSGELTRDMGLPQGENERINLEMHQENENRRLEGPTEGSLGGSNRHLSSAGSFVQLNDAADEFFDVPDESEYDQREIMFPSDESTHAVDQRHAKLSTAAVFVKRLHDLAVQKRGYVDLQGAADADNGPCCYGYTLPKDSSCTVPSTWAMTDPTTFLIRGETYLHDRLKIKANSTLMQMVGADWIKSDKREDDLAGRHGGLVQKCAAQGGTKFFFIVNIQVPGSTTYSLALYYMMDTPLEKVPLLERFVNGDDAFRNSRFKLIPYISKGSWIVKQSVGKKACLVGQALEINYFRGSNYLELGVDIGSSTVARGVVSLVLGYLNNLVIEMAFLVQGNTYEELPEFLLGTCRLNYLDASKAVSIDEC

SEQ ID NO: 5173 - protein, 773 aa, Oryza sativa
MMGGVAAEVVVEDAAAAAAAVPAAAVAGTGAGGGEEGRMRMEGWLYLIRSNRLGLQYSRKRYFVLEDAALRCFKAPPPPSSSSSSSKREDPVRSAIIDSCIRVTDNGRESVHRSVFYIFTLYNASNHYDQLKLGARSSEEAARWIRCLMESALKSPRKDEHIVACSHRRWQAFRLSRRSNRMHSIDWTVFSSVHNDPMASDVIAPSPWTIFGCKNGLRLFTEAKDGGSEGKYWDDHPAIMAVGVVDANSEAVFQTVMSLGQSRSEWDFCLQEGRVVEHIDGHTDIIHKKLRDGWLPWGMRKRDLLLRRYWRREDDGTYVILYHSVFHYRCRSERGYVRACLKSGGYVISPVNQGKQSVVKHMLAIDWKFWKSYLFTASAKHITIRMLGRVAALREFFRAKNGNCACIEFSSGELTRDMRLQQGENERIKIEMLSASENNRLEDPTEGSLGGSNRHLSSAGSFIQLNDAADEFFDVPDDSEYDQREAMWPSDESTHSVDQRHAKLSTAAVFVKKLHDLAVQKRGYVDLQGAADFDNGPFCYGYTLPKDSNCTMPSTWAMTDPTTFLIRGESYLQDRLKIKANNTLMQMVGADWIKSDKREDDLSGRPGGLVQKCAAQGGNKFFFIVNIQVPGSSTYSLALYYMMDTPLEKVPLLERFVNGDDAFRNSRFKLIPYISKGSWIVKQSVGKKACLVGQALEINYFRGSNYLELGVDIGSSTVARGVVSLVLGYLNNLVIEMAFLVQGNTQEELPEFLLGTCRLNYLDASKAVSIDEC

SEQ ID NO: 5174 - protein, 475 aa, Saccharum officinarum
MRKRDLLLRRYWRREDDGTYVILYHSVFHYKCRPERGYIRACLKSGGYVISPVNQGRQSVVKHMLAIDWKFWKSYLFTSSAKYITIRMLGRVAALREFFRAKNGNCACMEFSSGELTRDMGLPQGENQRINLEIQQENENRRLEGPTEGSVGGSNRQLSSTGSFIQLNDAADEFFDVPDESEYDQREVMFPSDESTHASDQRHAKLSTAAVFVKRLHDLAVQKRGYVDLQGAADADNGPCCYGYTLPKDSSYTVPSTWAMTDPTTFLIRGETYLHDRLKIKANSTLMQMVGADWIKSDKREDDLAGRPGGLVQKCAAQGGTKFFFVVNIQVPGSTTYSLALYYMMDTPLEKVPLLERFVNGDNAFRNSRFKLIPYISKGSWIVKQSVGKKACLVGQALEINYFRGNNYLELGVDIGSSTVARGVVSLVLGYLNNLVIEMAFLVQGNTYEELPEFLLGTCRLNYLDASKAVSIDEC

SEQ ID NO: 5175 - protein, 731 aa, Triticum aestivum
MEGWLYLIRSNRLGLQTSRKRYFVLEDSALRCFKAAPAPSSSSSKREDPVRSAVIDSCIRVTDNGRESVHRSVFYIFTLYNASNHYDQLKLGARSSEEAARWIRCLMESALKSPRKDEHVVACSHRRWQAFRLSRRSNRMHSIDWTILSSSHNDPMASDVIAPSAWTIFGCTNGLRLFTEAKDGGSRGKYWDDHPAIMAVGVVDANSEDIFQTLMSLGQSRSEWDFCLREGRVVEHLDGHSDIIHKKLRGDWLPWGMRKRDLLLRRYWRREDDGTYVILYHSVFHNRCSPEKGYIRACLKSGGYVISPVSQGRQSVVKHMLAIDWKFWKSYLLTSSAKYITIRMLGRVAALRELFRAKNGNCACMEFSSGELMRDMGLPQGGNERTKIEMQSANECERLEGPVEGPQGGSNRHLSSTGSLVQLNDATDEFFDVPDESEYDQREAMWSSDESTHAADQRHAKLSSAAVFVRKLHDLAVQKRGYVDLQGAADADNGPCYYGHTLPKDSSCTMPSSWSMTDPTTFLIRGESYLLDRQKIKAENTLMQMVGADWIKSDKREDDLAGRPGGLVQKYAAQGGSKFFFIVNIQVPGSTTYSLALYYMMDTPLEKVPLLERFVNGDDTFRNSRFKLIPYISKGSWIVKQSVGKKACLVGQALEINYFRGSNYLELGVDIGSSTVARGVVSLVLGYLNNLVIEMAFLVQGNTQEELPEFLLGTCRLNYLDASKAVSLDEC

SEQ ID NO: 5176 - protein, 738 aa, Brachypodium distachyon
MEGWLYLIRSNRLGLQTSRKRYFVLEDAALQCFKAAPAPSSDSDSSKREDPVRSAMIDSCTRVTDNGRESVHRSVFYIFTLYNASNHYDQLKLGARSSEEAARWIRCLMESALKSPRKDEHIVACSHRRWQAFRWYPRPFNGLISYYIIADWTRLSSAHNDPMTSDVIAPSPWTIFGCTNGLRLFTEAKDGDSHEKYWHDHPAIMAVGVVDANSEDIFQTLMSLGQSRSEWDFCLREGRVIEHLDGHSDIIHKKLRGDWLPWGMRKRDLLLRRYWRREDDGTYVILYHSVFHNKCRPEQGYIRACLKSGGYVISPVSQGRQSVVKHMLAIDWKFWKSYLFTSSAKYITIRMLGRVAALREFFRAKNGNCACLEFSSGELMRDMGLPQGENEQIKIEMHSANESRRLEGSTEGSQGGSNRHLSSAGSFVQLNDATDEFFDVPDESEYDQREAMWSSDESTHAVDQRHAKLSSAAVFVRRLHDLAVQKRGYIDLQGATDADNGPCCYGHTLPKDSSCTMPSSWAMTDPTTFLIRGESYLLDRQKIKANNTLMQMVGADWIKSDKREDDLAGRPGGLVQKYAAEGGNKFFFIVNIQVPGSTTYSLALYYAMDTPLEKVPLLERFVNGDDTFRNSRFKLIPYISKGSWIVKQSVGKKACLVGQALEINYFRGTNYLELGVDIGSSTVARGVVSLVLGYLSNLVIEMAFLVQGNTQEELPEFLLGTCRLNYLDASKAVSLDEC

SEQ ID NO: 5177 - protein, 691 aa, Saccharum officinarum
MGKSSKKSSVVAAPAAVSVPDGKSVKKGKRNAEDEIEKAVSAKKQKTASEKAVPVKKQPPPKKVESSSSDSEEDSSDSEVEVPVKKQPPPKKVESSSSDSEEDSSDSEVEVKVQPKKVIQPKKGTQPAKQESSDDSSSESSSDDEPSKKPVASSNKPAASSSDSDDSSDSDDSSSDEEPAKKPTVLSKKPVTAVSNGSKQVKHDSSSSDSSSDEDEKSAANLKKPPVASVQKKTQESDSSDSDSDDDESEDDIPAKAAVVAKKKEVSSDSSDSDSDSESEDEDNNAKIVQPAKAAAPKKEESSGSSDSDSESDSDSDEPEKPTVPAKRPLATNKKNEESSDESDGSSDESSDESDEEPPQKKSKNSAPSGAAKAATKVSKKESSSDEDDGSSDESSDDEEESEPTKTPKKKETSVDTTQKLARNEPKTPAKSQSQATGSKTIFVGNLAYSIEREQVKEFFEEAGEVVDVRLSTFDDGSFKGYGHVEFATVEAAQKALEFIGHDLMGRPLRIDIAVERGAYTPSSGKDNGSFRKSAQRSGNTVFIKGFDTSGGEDQIRSALQQHFGSCGEITRISIPKDYDTGASKGMAYMDFKDPDSLNKAYELNGTDLGGYSLYVDEAKPRPDNNRDGGFSGGRGGRGGRSDRGRSGGRGRGFGGRGGRGDRGRGGRGTPFRPTAGTPSTGKKTTFGDDD

SEQ ID NO: 5178 - protein, 580 aa, Saccharum officinarum
MASGGEGAGSGESPPAASVEAAAGEATLHIRCANGSKFTVQTDLGATVGAFKEVVAGSCDVPAPQQRLIYKGRILKDEQTLESYGVETDHTIHLVRGVAPPAASSAPAAASPLASSTPSSGPAGGLGGLFPGLGDPGSGRPSGIFGSGFPELEQVEQHLSQNPNLMREIMNMPAMQNLMNNPDLIRNMIMSNPQMREIMDRNPDLAHVLNDPSVLRQTLEAARNPEIMREMMRNTDRAMSNIESSPEGFNMLRRMYETVQEPLLNATTMDGEGNTASNPFSALLGNQGSNQPGQAQPATNAPTTGSESTTGTPAPNTNPLPNPWSTNAGSAQGATRSSASGNARTGASGGVGGTGATGGLGGLGSPDLSSLLGGLAGNPRTGAAGGLGGLGSPDLGSMLGGSPDVSLFNQMLQNPAMMQMMQSIMSDPQTMNQLLNFNPNTRNLMESNTQMREMLQNPEFLRQLTSPETLQQLLSFQQSLLGQLGQLQPSQGGNNAGSATGTRGNPSLDTLMSMLSGLGSGGGLGVPNTSNVPPEELYATQLTQLQEMGFIDTAENIQALVATAGNVHAAVERLLGNLGQ

SEQ ID NO: 5179 - protein, 578 aa, Zea mays
MASGGEGAGSGESPPAASVEAAAGEATLHIRCANGSKFTVQTDLGATVGGFKEVVAGSCDVPAPQQRLIYKGRILKDEQTLESYGVETDHTIHLVRGVAPPAASSAPAAASSLASSTLSSVPAGGLGDLFPGVGAPGSGRSSGIFGPGFPELEQVEQHLSQNPNLMREIMNMPAMQNLMNNPDLIRNMIMSNPQMREIMDRNPDLAHVLNDPSVLRQTLEAARNPEIMREMMRNTDRAMSNIESSPEGFNMLRRMYETVQEPFLNATTMSGEGNTASNPFAALLGNQGSNQPGQGQPATYTPTIGSESTTGTPAPNTNPLPNPWSTNAGSAQGATRSSGNTRTGASGHVGGTGATGGLGGLGSPDLSSLLGGLAGSPRTGASGGLGGLGSPDLGNMLGGSPDVSLFSQMLQNPAMMQMMQSIMSDPQTMNQLLSFNPNARNLMESNPQMREIFQNPEFLRQLTSPETLQQLLLFQQSLLGQLGQHQPNQGRNNSGSATGTPGNPSLDTLMSMLSGLGSGGGIGVPNTSNVPPEELYATQLTQLQEMGFIDTAENIQALLATAGNVHAAVERLLGNLGQ

SEQ ID NO: 5180 - protein, 576 aa, Zea mays
MASGGEGAGSGESPPAASVEAAAVEATLHIRCANGSKFTVQTDLGATVGAFKEVLSGSCGVPAPQQRLIYKGRILKDEQTLDSYGVETDHTIHLVRGVATPAASSAPAAANPLASFTPSSGPAGGLGGLFPGVDAPGNDRPSGIFRPGFPELEQVEQHLSQNPNLMREIMNMPAMQNLMNNPDLIRNMIMNNPQMREIMDRNPDLAHVLNDPSVLRQTLEAARNPEIMREMMRNTDRAMSNIESSPEGFNMLRRMYETVQEPFLNATTMGGEGSTASNPFSALLGNQGSSQPGQGQPATNAPTTGSESTTGTPAPNTNPLPNPWSTNAGSAQGATRTPSGNARTGGVGGTGATGGLGGLGSPELSSLLGGLAGSPRTGSAGGLGGSGSPDLGSMLGGSPDVSPFSQMLQNPAMIQMMQNIMSDPQTMNQLLNLNPNARNLMESNTHMREMFQNPEFLRQLTSPETLQQLLSFQQTLLGQLGQHQPSQGGNNAGSATGTRGNPSLDTLMSMLSGLGSGGGLGVPNTSSVPPEELYATQLTQLQEMGFIDTAENIQALVATAGNVHAAVERLLGNLGQ

SEQ ID NO: 5181 - protein, 570 aa, Panicum virgatum
MASGGEGAGSGESPPAAAGEAPAAAGATLHIRCANGSKFTVQADLAATVGAFKEVVAGSCDVPAPQQRLIYKGRILKDEQTLESYGVETDHTIHLVRGVASPAASGAPAAASPLASSTPSSGPAGGLGGLFPGVGAPRSGRPSGLFGAGFPELEQVEQHLSQNPNLMREIMNMPAMQNLMNNPDLIRNMIMSNPQLREIMDRNPDLAHVLNDPSVLRQTLEAARNPEIMREMMRNTDRAMSNIESSPEGFNMLRRMYETVQEPFLNATTMGGEGNTASNPFAALLGNQGSNQPGQPATNAPIPGSESTTGTPAPNTNPLPNPWSTNAGGAQGAARSGPTSNARTGATGGLGGLGSPDLSSLLGGLAGSQRSGAAGGLGGLGSADLGSMLGGSPDASFLNQMLQNPAMMQMMQSIMSDPQTMNQLLNFNPNARNLMESNTQLREMFQNPEFLRQLTSPETLQQLLSFQQSLLGQLGQQPPSQDGNNLGSATGMQGNPSLDTLMSMLSGLGSGGGLGVPNNSNVPPEELYATQLTQLREMGFIDNAENIQALVATAGNVHAAVERLLGNLGQ

SEQ ID NO: 5182 - protein, 570 aa, Panicum virgatum
MASGGDGAGSGESPPAAAGEAPAAAGATLHIRCANGSKFTVQADLAATVGAFKEVVAGSCDVPAPQQRLIYKGRILKDEQTLESYGVETDHTIHLVRGVAAPAASGAPAAASPLASSTPSSGPAGGLGGLFPGVGAPRSGRPSGLFGAGFPELEQVEQHLSQNPNLMREMMNMPAMQNLMNNPDLIRNMIMSNPQLREIMDRNPDLAHVLNDPSVLRQTLEAARNPEIMREIMRNTDRAMSNIESSPEGFNMLRRMYETVQEPFLNATTMGGEGNTASNPFAALLGNQGSNQPGQPATNAPIPGSESTTGTPAPNTNPLPNPWSTNAGGAQGAARSGPTSNARTGATGSLGGLGSPDLSSLLGGLAGSQRSGAAGGLGGLGSADLGSMLGGSADASFLNQMLQNPAMMQMMQSIMSDPQTMNQLLNFNPNARNLMESNTQLREMFQNPEFLRQLTSPGTLQQLLSFQQTLLGQLGQQQPSQDGNNLGSATGTQGNPSLDTLMSMLSGLGSGGGLGVPNNSNVPPEELYATQLTQLREMGFIDNAENIQALVATAGNVHAAVERLLGNLGQ

SEQ ID NO: 5183 - protein, 572 aa, Pennisetum glaucum
MASGGEGAGSGESPPAGAEEAASVGATLNIRCANGSKFTVRADLAATVGAFKEVVAGSCDVPAPQQRLIYKGRILKDEQTLESYGVETDHTIHLVRGVAPSAASGAPAAAAAASPLASSTPSSGPAGGLGGLFPGVGAPRGGRPSGVFGPGFPELEQVEQHLSQNPNLMREIMNMPAMQNLMNNPDLIRNMIMSNPQLREIMDRNPDLAHVLNDPSVLRQTLEAARNPEIMREMMRNTDRAMSNIEASPEGFNMLRRMYETVQEPFLNATTMGGEGNTASNPFAALLGNQGSNQPGQPATNAPTPGSESTTGTPAPNTNPLPNPWSSNAGTTQGAARSVPAGNARTGATGGLGGLGSPDLTSLLSGLAAHPRSGAAGGLGGLGSPDLGSMLGGAPDASFLNQMLQNPAMMQMMQSLMSDPQTLNQLLNFNPNARNLMESNTQLREMFQNPEFLRQLTSPETLQQLVSFQQTLLGQLGPNQSSQDGNNSGGATGTRANPSIDTLMSMLSGLGSGGSLGVPNNSNVPPEELYATQLTQLREMGFIDNAENIQALVATAGNVHAAVERLLGNLGQ

SEQ ID NO: 5184 - protein, 575 aa, Oryza sativa
MGGGGGEAGGGDGGESSPAAAAAAAVAGAAALHIRCANGSKFTVRADLDATVGAFKEVVAGSCDVPAAQQRLIYKGRILKDEQTLESYGVETDHTIHMVRGAGPPAGSAAPAAASPQASAAPSSGPTDGLGSLFPGLGGTGTAGTRPSGLFGSGFPELDQMQQQLSQNPNLMREIMNMPMMQNLMNNPDLIRNMIMNNPQMRDIIDRNPDLAHVLNDPSVLRQTLEAARNPEIMREMMRNTDRAMSNIESSPEGFNMLRRMYETVQEPFLNATTMGGEGNTAPNPFSALLGNQGSNQPRDPATNAPNTGSESTTGTPAPNTNPLPNPWSSNAGGAQGATRAGSTGNARTGATGGLGGLGSADLSSLFGGLAGNTGTGATGGLGGLGSADLGSLLGGSPDSSSLSQILQNPVMMQMMQNIMSDPQSMNQLLNFNPNTRNLMESNTQLREMFQNPEFIRQLTSPETMQQLLSFQQTLLSQLGQNQPRQDGSQGGNATGMRGNVSLDTLMGMLSGLGAGGGIGVPNTSNVPPEELYATQLTQLREMGFIDTAENIQALVATAGNVNAAVERLLGNLGQ

SEQ ID NO: 5185 - protein, 572 aa, Leymus cinereus x Leymus triticoides
  misc_feature (179)..(180): Xaa can be any naturally occurring amino acid
MGGAGHGEGVGSGDGGESPPSGARATLNIRCANGAKFTLQADLGETVGAFKEVVAGSCDVPAPQQRLIYKGRILKDEQTLESYGVETDHTIHLVRGVAQPAASGAPAAASPQASTTPTSGPAGGLGGLFPGLGATGAASGRPAGLFGAGLPELDQMQQQLSQNPNLMREIMNMPMMQNXXNNPDLIRNMIMNNPQMRDIIDRNPDLAHVLNDPSVLRQTLEAARNPEIMREMMRNTDRAMSNIEASPEGFNMLRRMYETVQEPFLNATTIGGGGEGTPASNPFAALLGNQGPNQPGNPATNAPTTGPESTTGTPVPNTNPLPNPWSTNAGGAQGTTRPGPAASTRTGATGGLGGLGSADLSSLLGGLGGNARTGAAGGLGGLGSADLGSMLGGPPDAALLSQMLQNPAMMQMMQNIMSDPQSMNQLLNMNPNTRNLMESNTQLRDMFQNPEFLRQMASPEALQQLLSFQQTLSSQLGQNQPSQDGNLGGNGAGTRGNVGLDTLMGMLSGLGAGGGLGVPNTSNVPPEELYATQLGQLQEMGFFDTAENIRALMATSGNVHAAVERLLGNFGQ

SEQ ID NO: 5186 - protein, 396 aa, Zea mays
MSWWWTGAIGAVKKRQDEQAAAAEPSYQSVALVVGSTGIVGTSLLDILPLADTPAGPWKVYAVSRRPLPPWSPAPSPAVTHLHLDLADSAAVAEALQPLTDITHVFFVAWTNRPTEAENREANSAMLRNVLSVVVPNCPALVHVCLQTGRKHYVGPFEAIGKVAAPDPPFTEDMPRLDCPNFYYDMEDILFHEVSRRDGAVSWSVHRPTTVFGYSPRSAMNLVGSLCVYAAICRKEGTTLRWPGSRVTWEGFSDASDADLIAEHEIWAAVDPFAKNEAFNCSNGDLFKWKQLWPILADHFGLEWAGYEGEENRFKLEEAMAGKEAVWAEIVRENDLIATELDEITNWWFVDAMFAVETQLLDSMNKSKEHGFLGFRNTVSSFNTWIEKLKVFKIVP

SEQ ID NO: 5187 - protein, 396 aa, Setaria italica
MSWWWTGAIGAVKKRQDEQAAAAEPTYQSVALVVGSTGIVGTSLLDILPLADTPGGPWKVYALSRRPLPPWSPPPSPAVTHLHLDLADAAAVADALKPLTDITHVFYVAWTARPTEAENREANAAMLRNVLSVVVPNCPALVHVCLQTGRKHYVGPFEALGGVSFPDPPFTEDMPRLDCPNFYYDMEDILFDEVNRREGAVSWSVHRPTTVFGYSPRSAMNVVGSLCVYAAICRKEGATFRWPGSRIAWEGFSDASDADLIAEHEIWAAVDPFAKNEAFNCSNGDLYKWKYLWPILADHFGVEWAGYEGEENRFKLEEAMAGKEALWAEIVRENELISTELDEITNWWFVDAVFGVEFEHLDSMNKSKEHGFLGFRNTVNSFNTWIEKLKVFKIVP

SEQ ID NO: 5188 - protein, 396 aa, Pennisetum glaucum
MSWWWTGAIGAVKKRQDEQAAAAEPTYQSVALVVGSTGIVGTSLLDILPLADTPGGPWKVYALSRRPLPPWSPPPSPAVTHIHLDLADAPAVEEALKPLTDITHVFYVAWTARPTEAENREANAAMLRNVLSVVVPNCPALVHVCLQTGRKHYVGPFEALGRVSFPDPPFTEDMPRLDCPNFYYDMEDLLFDEISRREGAVSWSVHRPTTVFGYSPRSAMNVVGSLCVYAAICRKEGATFRWPGSRIAWEGFSDASDADLIAEHEIWAAVDPFAKNEAFNCSNGDLYKWKNLWPILADHFGVDWAGYEGEEHRFKLVEAMAGKEALWAEIVSENELISTELDEITNWWFVDAMLGVEFEHLDSMNKSKEHGFLGFRNTVNSFNTWIEKLKVFKIVP

SEQ ID NO: 5189 - protein, 396 aa, Brachypodium distachyon
MSWWWAGAIGAVKKRQDESAAAAEPSFQSVALVVGSTGIVGTSLLDILPLQDTPGGPWKVYALSRRPLPPWSPPPSPAVTHLHLDLADSAAVADALTPLTDITHVFYVAWSNHPTEAQNREANSAMLRNVLSVVVPNCPALVHVCLQTGRKHYIGPFEAIGKIPAPDPPYTEDMPRLDYPNFYYDQEDVLFDEVSRRGGAVSWSVHRPTTIFGFSPRSAMNVVGSLCVYAAICRKEGATMRWPGSKVAWEGFSDSSDADLIAEHEIWAAVDPFAKNEAFNCSNGDLYKWKQLWPMLADHFEVEWAGYDGEENRFMLTQAMAGKEAVWAEILQENELIRTELEEITNWWFVDALFNVETQHLDSMNKSKEHGFLGFRNTTNSFNTWIEKMKVFKIVP

SEQ ID NO: 5190 - protein, 363 aa, Saccharum officinarum
RRIHRHRRHLAPRHPPARRHPRRAVEGLRRLAPPAPAVVPGALPRRHPPPPRPRRRRRRRRGPPTPHRHHPRLLRRLDQPPHRGGEPGGQRRHAPQRALRRRPQLPRARPRLPPDRPQALRRALRAIGKVQTPDPPFTEDMPRLDCPNFYYDMEDILFHEVSRRDGAVSWSVHRPTTVFGYSPRSAMNLVGSLCVYAAICRKEGATLRWPGSRVTWEGFSDASDADLIAEHEIWAAVDPFAKNEAFNCSNGDLFKWKQLWPILADHFGVEWAGYEGEENRFRLEEAMAGKEAVWAEIVRENDLIATELDEITNWWFVDAMFGVETQLLDSMNKSKEHGFLGFRNTVTSFNTWIEKMKVFKIVP

SEQ ID NO: 5191 - protein, 396 aa, Avena sativa
MSWWWAGAIGAVKKRQDEHAAAAEPSFQSIALVVGSTGIVGTSLLDILPLQDTPGGPWKVYALSRRPLPPWSPPPSPAVTHLHLDLADSAAVAEALEPLKDITHVFYAAWSSHLTEDENREANSAMLRNVLSVVVPNCPALVHVCLQTGRKHYVGPFEVLGKIPSPDPPYTEDMPRLDYPNFYYDQEDVLFDEVSRREGAVSWSVHRPTLVFGFSPRSAMNVVGSLCVYAAICRKEGALLRWPGSKVVWEGFSDASDADLIAEHEIWAAVDPFAKNEAFNCSNGDLYKWKLLWPMLADHFGVEWAGYEGEETRFKLAEDMAEKEAVWAEIIQENELIATKLEEITNWWFVDTALNLEIEHLDSMNKSKEHGFLGFRNTVNSFNTWIEKMKVFKIVP

SEQ ID NO: 5192 - protein, 396 aa, Oryza sativa
MSWWWAGAIGAVKKRQEENAAATEPSFQSVALVVGSTGIVGTSLLDILPLQDTPGGPWKVYAVSRRPLPPWSPPASPAVTHLHLDLADSAAVAEVLTPLTDITHVFYVAWSAHPTEAQNREVNSAMLRNILSVVVPNCPALVHVCLQTGRKHYIGPFEVIGKIAAPDPPFTEDMLRLDCPNFYYDLEDVLFNEVSRRDGAVSWSVHRPTVVFGFSPRSAMNVVGSLCVYAAICRKEGAVLRWPGSRVAWEGFSDASDADLIAEHEIWAAVEPFAKNEAFNCSNGDLYKWKLLWPMLADQFGVEWSGYEGEESSFKLADAMSGKEAVWAEIVKENDLMDTELEEITNWWFVDAVFGVRSEHLDSMNKSKEHGFLGFRNTVNSFNTWIEKMKVFKIVP

SEQ ID NO: 5193 - protein, 398 aa, Triticum aestivum
RDELVVGGRGGRGQKRQDERAAAAEPTFQSVALILGSTGIVGTSLLDILPRDDTPGGPWKVYAVSRRAPPGWSTPPPSPAVTHLQLDLADAAAVRDALTPLTDVTHVFYAAWSSHETEDRNREVNAGMLRNVLSVVVPNCPALAHVCLQTGRKHYVGPFEAIGKIPAPDPPYTEDMPRLDHPNFYYDLEDVLFDHVSGRDGAVTWSVHRPTVIFGFSPRSAMNVVGSLCVYAAICRKEGATLRWPGCKVAWEGFTDASDADLVAEHEIWAAVDPFAKNEAFNCSNGDVFKWKQLWPMLAERFGVEWAGYEGEDSRFALADAMTGKEAVWTEILQENELVTTELEEITSWGFVDAMFNIDIEHLDNMNKSKEHGFLGFRNTVNSFNAWIDKMKASKVVP

SEQ ID NO: 5194 - protein, 397 aa, Triticum aestivum
MSWWWAGAVGAVKKRQDERAAAAEPTFQSVALILGSTGIVGTSLLDILPRDDTPGGPWKVYAVSRRAPPGWSTPPPSPAVTHLQLDLADAAAVRDALTPLTDVTHVFYAAWSSHETEDRNREVNAGMLRNVLSVVVPNCPALAHVCLQTGRKHYVGPFEVIGKIPAPDPPYTEDMPRLDHPNFYYDLEDVLFDHVSGRDGAVTWSVHRPTVIFGFSPRSAMNVVGSLCVYAAICRKEGATLRWPGCKVAWEGFTDASDADLVAEHEIWAAVDPFAKNEAFNCSNGDVFKWKQLWPMLAERFGVEWAGYEGEDSRFALADAMTGKEAVWTEILQENELVTTELEEITSWGFVDAMFNIDIEHLDNMNKSKEHGFLGFRNTVNSFNAWIDKMKASKVVP

SEQ ID NO: 5195 - protein, 397 aa, Triticum aestivum
MSWWWAGAVGAVKKRQDERAAAAEPTFQSVALILGSTGIVGTSLLDILPRDDTPGGPWKVYAVSRRAPPGWSTPPPSPAVTHLQLDLADPAAVRDALTPLTDVTHVFYAAWSSHETEDRNREVNAGMLRNVLSVVVPGCPALAHVCLQTGRKHYVGPFDVIGKIPAPDPPYTEDMPRLDHPNFYYDLEDVLFDHVSGRDGAVTWSVHRPTVIFGFSPRSAMNVVGSLCVYAAICRKEGATLRWPGCKVAWEGFTDASDADLVAEHEIWAAVDPFAKNEAFNCSNGDVFKWKQLWPLLADRFGVEWAGYEGEDSRFALADAMAGKEAVWTEIIQENELVTTELEEITSWWFVDAMLSIDIEHLDNMNKSKEHGFLGFRNTINSFNAWIDKMKASKVVP

SEQ ID NO: 5196 - protein, 288 aa, Zea mays
MASRDFLRVFGAGEGAGPPGDAGAGQPDDDELSLGLSLGGRFGTDAKRPRLARSSSIASVCSVSSLHADPSPAAPLPLLRTTSLPTETEEERWRRREMQSRRRLEARRKRVERRNSMGSVSVAPADAVSGRRSNASQGSNSASTTEQGIGGSMFNQSADAKSPSTSDNRNQNDMLPPTKAAEKPLNGTATEQQPRLRTLGSLTTRTGSTSDIRKLMMEDMPMVSSKVEGPNARRIDGFLYRYKKGEDVRIVCVCHGSFLTPAEFVKHAGGGDVPNPLRHIVVNPAPFS

SEQ ID NO: 5197 - protein, 291 aa, Zea mays
MASRDFLRVFGAGAGHQDDAAAAAGRTDDVELSLGLSLGGRFGTTDAKRPRLARSSSIASVCSVSSLHADADAAPLPLLRTTSLPTETEEERWRRRETQSRRRLEARQKRVERRNSMASLAPAVVGGTGRRSNASQGSNSASTTEQGIGGSASNQSTDARSPSSTSDNNTNQNNMLPPTTKAAEKPLNGTATEQPQPRLRTLGSLTTRTSSTGDIRKLMMEDMPMVSSKVEGPNARRIDGFLYRYKKGEDVRIVCVCHGSFLTPAEFVKHAGGGDVSNPLRHIVVNPAPFS

SEQ ID NO: 5198 - protein, 228 aa, Zea mays
MAWEEEAVEEEDYGEEMSASESEEDVVVGQMPTVMVPKHINKRSLKNKALSVTLDKKALRDFVTGFHKRKKKRRKEAQKILQEKERKKKIQDRKRRKEEKEIALYGRVLTSDKNDGAGLENEDIGDDGEDMENDKPLSEIKTYEDDGTRTVVTTSEITPEEDDIVPKTVGPVATSLTSKNPSSFAKKNSSLGVKRKPPKRTFKSKARAKRGDKKRGAAKGKRKGKGMK

SEQ ID NO: 5199 - protein, 225 aa, Setaria italica
MAWEEEAVEEEEYGEEMAASESEAEDVVVGQMPTVMVPKHIKKRSLKNKALSVTLDKKALRDFVTGFHKRKKKRRKEAQKVLQEKERKKRIEARKRRKQEKEIALYGRVLSSDDVELENEDIGDDGEEMENDEPLSEIKTYEDDGTRITVTTSEITCEDDDIGPRNVGPVSSYTNKNSSSMAKKNSSLGVKKKPQKRTFKNKSKAKKGDKKRGAVKGKRKGRGRK

SEQ ID NO: 5200 - protein, 226 aa, Setaria italica
MAWEEEAVEEEEYGEEMAASESEAEDVVVGQMPTVMVPKHIKKRSLKNKALSVTLDKKALRDFVTGFHKRKKKRRKEAQKVLQEKERKKRIEGRKRRKQEKEIALYGRVLSSADAELENEDIGDGGEEMENDESLSEIKTYEDDATRIIVTTSEITCEDDDIGPRTVGPVSAGYTNKNPSSVAKKNSSLGVKKKPQKRTFRNKSKAKKGDKKRGAVKGKRKGKGRK

SEQ ID NO: 5201 - protein, 225 aa, Panicum virgatum
MAWEDEAVEEEEYGEEMAASESEAEDVVVGQMPTVMVPKHINKRSLKNKALSVTLDKKALKDFVTGFHKRKKKRRKEAQKVLQEKERKKRIEERKRRKQEKEIALYGRVLSSDDAGLENEDIGDDGEEINDESLSEIKTYEDDATRITVTTSEITPEDDDIGPRTMGPVSTSYTSKNPSSVAKKNSSLGVKKKPQKRMFKNKSKAKKGDKKRGTVKGKRKGKGRK

SEQ ID NO: 5202 - protein, 206 aa, Saccharum officinarum
MVWEEEAVEEEEYGNEMAASESEEDVVVGQMPTVMVPKHINKRALKNKALSVTLDKKALRDFVTGFHKRKKKRRKEAQKILQEKERKKKIQDRKRRKEEKEIALYGRVLSSDNNDGAGLENEDIGDDGEDMENDEPLSEIKTYEDDGTRIIVTTSEITPEDDDIGPKTVGPVATSYINKNPSSFAKKNNSLGVKKKPQKRTFKNKK

SEQ ID NO: 5203 - protein, 213 aa, Panicum virgatum
MVRRWQLRESEAEDVVVGQMPTVMVPKHINKRSLKNKALSVTLDKKALKDFVTGFHKRKKKRRKEAQKVLQEKERKKRIEERKRRKQEKEIALYGRVLSSDEAGLENEDIGDDGEEINDESLSEIKTYEDDATRTTMTTSEITPEDDDIGPRIIGPVSTSYTSKNPSSVAKKNSSLGVKKKPQKRMFKNKSKVKKSDKKRGTVKGKRKGKGRK

SEQ ID NO: 5204 - protein, 309 aa, Zea mays
MEEESVAASRYYCHMCSLIIRPELGIEEVKCPHCHTGFVEEMAGDRRGSDDAAIRGRPPGGEASSNASDAALEREVSLWAPVLMDFIAASSGRHGLDGHGGDLAALARRQYRNIALLQLLNALQEGDTDAGRERVVLMSPADARAMLMGQERGDGAAALGPGGLTLGDLFLGPGLDLLLEYLAETDPNRQGTPPARKEAVAALPTVRVREDFTCPVCLDEVAGGGDAREMPCKHRFHDQCILPWLEMHSSCPVCRHQLPTEEPAEAIGSDRGAGVESSGNARGGGRRHWFSWPFGGLFSQRSSGNSSSS

SEQ ID NO: 5205 - protein, 317 aa, Setaria italica
MDEESGAASRYFCHMCSLIIRPELGIEEVKCPHCHTGFVEEMAGDRRAGGDADTRGRAVSVNASDAALEREVSLWAPVLMDYLAASSGRHGLDAGGGGGDLAAFARRQYRNIALLQLLNALQEGDAADAGRERVVLVSPSDARAMLMGQERGAGAGGAALGPGGLTLGDLFLGPGLDLLLEYLAETDPSRQGTPPARRRPWRRCRWSGRARPSPAPCAWTRSRPAARRGRCRASTGSMTRASCHGWRCTAPAPCAGTSCPRRSLLSRPAAAGALLTRPAATRTAATTGEAAAGGIGSRGPLAGCSRNDRTGAPPPRR

SEQ ID NO: 5206 - protein, 329 aa, Panicum virgatum
  misc_feature (159)..(159): Xaa can be any naturally occurring amino acid
MDEAYGAAASRYFCHMCSLIIRPVLGIEEVKCPHCHSGFVEEMAVDSLGGAGGAAIPGRAAGEPSVDAPEAALEREVSLWAPVLMDFLAASSGRQGQDHGRGHGLDAAAGGGGGDLAAFARRQYRNIALLQLLNALHEADAADAGRERVVLVSPADARXMLLGQERGDGAAALGRGGLTLGDLFLGPGLDLLLEYLAETDPSRQGTPPARKEAVAALPTVRVREAFTCPVCLDEVAAGGEAREMPCKHRFHDPCIVPWLEMHSSCPVCRHQLPAEEPADPAGSGRRAGDEAGGNARGGDGGSGGRRHWFSWPFGGLFSQRSNGSSSSSS

SEQ ID NO: 5207 - protein, 479 aa, Zea mays
MPARTWLADLRSRLRVGPRKNDGLGILAFEAAANMSRLVSLHRTVSDVEVRRLRADVLRAEGVARLTSTDQSLLLRFACGELLADLDRAAGSVACLGARCCAGDAPLLRDFDRVYAEAKRGRLAQLDATVGFSRGATRRFKEMERHVVVAAKLYAEMDALSELEASERRMERWKQHSGPIPAQTTGTGKGSAADPGEKLMSKLREQRQKVRRVMEGSLWNVAASKAARLMAKSVLAVLARISLAFAAFVPGLPPWTVGRAWALGHSSGSGPLHRSATPAALQHSAPIFGQRDSASLLSASSIKPSVSTVGGSSMELRYANVILAAKTLLAALRPPAGDNEEAHEGMIDLSKRDALYKMLPVGIRKAMNAKLREIWKKAQPVDEVSAAASKDAVECLLRWLSPMAHDTVRWNDEQSMERAQRFSMQPRALMVQTLHFADRKKTDAAIVDVLIGLTCVCWYDDEQRRLESLDRDDDDEYQL

SEQ ID NO: 5208 - protein, 406 aa, Saccharum officinarum
MAEICCEVAAAGSDRKGKCVGADAGSRAARRRRMEIRRLRVVAEEASAKRPRLEADVEDAVRGPAPRYGVTSVCGRRRDMEDAVTARLGFINGHHFFGVFDGHGCSHVATSCGQRMHQIVAEEATAAAGSSVSDDAARWRDVMEKSYSRMDAEAVGSRETAGPAPTCRCEMQLPKCDHVGSTAVVAVVGPRHLVVANCGDSRAVLCSGGAAIPLSDDHKPDRPDELERIHAAGGRVIYWDGARVFGMLAMSRAIGDSYLKPFVISDPEVRVVERKDGEDEFLILASDGLWDVVSNEVACKVVRTCLRNRAPHPHGGERSSATSNLSPRHSNGSSSREEEEAGPSDGAGSESDDGESSEDRACAEAAILLTKLALARQSADNVSVVVVNLGGARDRDRRIQGTTVPD

SEQ ID NO: 5209 - protein, 396 aa, Zea mays
MAEICCEAAAAAAGSDQKGECAGSRAARRRRMEIRRLRVVAEEASAKRRRLEADEEDAVGGRAPRYGVTSVCGRRRDMEDAVTARPEFINGHHFFGVFDGHGCSHVATSCGERMHQIVAEEATAAAGSSVSDETARWRGVMEKSYARMDAEAVVSRETAGPAPTCRCEMQLPKCDHVGSTAVVAVVGPRHLVVANCGDSRAVLSSGGATIPLSADHKPDRPDELERIHAAGGRVIFWDGARVFGMLAMSRAIGDSYLKPFVISDPEVLVVERKDGEDEFLILASDGLWDVVSNEVACKVVRTCLRNRAPRGGRERSSPTSNLSPRQSSASGGSSSSGDEEAGGPSGDGAGSESDGESAEDRACAEAAILLTKLALARQSADNVSVVVINLRRRPRS

SEQ ID NO: 5210 - protein, 397 aa, Setaria italica
MEEICCEVAAGSSSSDRKGEGVGDAGSRAARRRRMEIRRLRVVAEEQAAKRRRLEGDDGEEEEDAVRDPAPRYGVTSVCGRRRDMEDAVTARPGFIHGHHFFGVFDGHGCSHVATSCGVRMHEIVAEEAAAAAAGSSASDEAARWRDVMEKSYARMDAEAVGSRDTTGPAPTCRCEMQMPKCDHVGSTAVVAVVGPRHLVVANCGDSRAVLCSGGAAIPLSADHKPDRPDELERIHAAGGRVIFWDGARVFGMLAMSRAIGDSYLKPFVISDPEVRVVERKDGEDEFLILASDGLWDVVSNEVACKVVRACLRNGAVRRGERSSPTSNLSPRQSSGSSSGDEEAGPSDGAASDSDGEGGEDKACAEAAILLTKLALARQTADNVSVVVVNLRRRRRS

SEQ ID NO: 5211 - protein, 331 aa, Sorghum bicolor
MSWAAIENDPGVFTELLQQMQLKGLQVDELYSLDLDALSDLQPIYGLIVLYKWRPPEKDERPVIKDAIPNLFFANQIINNACATQAILSVLLNSPGITLSDELKKLKEFAKDLPPELKGLAIVNCASIRMLNNSFARSEVSEEQKPHSKDDDVYHFISYVPVDGVLYELDGLKEGPISLGKCPGGIGDAGWLRLVQPVIKEHIDMFSQNEIRFSVMAILKNRKEMFTVELKDLQRKRESLLQQMGDPSAIRHVPSVEQSLAEVAAQIESVTEKIIMEEEKSKKWKTENLRRKHNYVPFLFNFLKILEEKQQLKPLIEKAKAKQKSHGPSAR

SEQ ID NO: 5212 - protein, 327 aa, Zea mays
MSWAAIENDPGVFTELLQQMQLKGLQVDELYSLDLDALNDLQPIYGLILLYKWRPPEKDEGPVIKDAIPNLFFANQIINKACATQAIVSVLLNSPGITLSDELKKLKEFAKDLPPELKGLAIVNCASIRMLNNSFARSEASEEQKPPSGDDDVYHFINYVPVDGVLYELDGLKEGPISLGKCPGGVGDAGWWLRLAQPVIKEHIDLFSQNEIRFSVMAILKNRKEMFTVEIKELQRKREGLLQQMGDPNASRHVEQSLAEVAAQIESVTEKIIMEEEKVKKWKAENLRRKHNYVPFLFNFLKILEEKQQLKPLIEKAKAKQKSHGPS

SEQ ID NO: 5213 - protein, 331 aa, Zea mays
MSWAAIENDPGVFTELLQQMQLKGLQVDEIYSLDLDALNDLQPIYGLIVLYKWRPPEKDERPVIKDAIPNLFFANQIINNACATQAILSVLLNSPGITLSDELKKLKEFAKDLPPELKGLAIVNCESIRMINNSLARSEVSEEQKRPSNGDDVYHFISYVPVDGVLYELDGLKEGPICLEKCPGGVGDAGWLRLAQPVIKGHIDLFSQNDVRCSVMAILKNRKEMCTVELKELKRKRESLLQQTGYPSAIRHVPSVEQSLAEVSAQIEAVTEKMIMEEEKVKTWKTENLRRKHNYVPFLFNFLKILEEKQQLNPLIEKAKAKQKSHCPSPR

SEQ ID NO: 5214 - protein, 320 aa, Setaria italica
FTELLQQMQLKGLQVDELYSLDLDALNDLQPIYGLIVLYKWRPPEKDERPVIKDTVPNLFFANQIINNACATQAILSVLLNSPGITLSDELKRLKEFAKDLPPELKGLAIVNCSSIRILNNSFARSEVPEEQKPSSKDDDVYHFISYVPVDGVLYELDGLKEGPISLGKCPGGVGEAGWLRVAQPVIQEHIDRFTQNEIRFSVMAILKNRKEMYTAELKDLQRKRENLLQQMGDPSARHVPSVEQSLAEVAAQIEAVTEKIIMEEEKVKKWKTENMRRKHNYVPFLFNFLKILEEKQQLKPLIEKAKAKHKSHSHSTNPR

SEQ ID NO: 5215 - protein, 332 aa, Pennisetum glaucum
MSWAAIENDPGVLTELLQQMQLKGLQVDELYSLDLDALNDLQPIYGLIVLYKWRPPEKDERPVMKDTVPNLFFANQIINNACATQAILSVLLNSSGITLSDELKRLKEFAKDLPPELKGLAIVNCSSIRMLNNSFARSEVSEEQKPSSKDDNVYHFISYVPVDGILYELDGLKEGPINLGKCPGGVGEAGWLKLAQPVIQEHIDRFSDNEIRFSVMAILKNRKEAYTAELKELQRKRESLLQQMGNGSARHMASVGQSLAEVASQIEAVTEKIIMEEEKLKKWKTDNIRRKHNYVPFLFNFLKILEEKKQLTPLIEKANANQKSHSRSSNPR

SEQ ID NO: 5216 - protein, 329 aa, Avena sativa
MSWAAIENDPGVFTELLQQMQLKGLQVDELYSLDLDALNDLQPIYGLIILYKWRPPEKDERPVIKDSVPNLFFANQIINSACATQAIVSVLLNSSGITLSDDLRKLKEFAKDLPPELKGLAIVNCESIRMTSNSFARSEEPEELKSSSKDDDVYHFISYVPVDGVLYELDGLKEGPISLGKCPGGIGEMGWLKMVQPVIQEHIDKFSQNEIRFSVMAITKNRRDMYIVELKELQRKRENLLSQMGDPSANRQRPSVERSLAEVAAQIEAVTEKIIMEEEKSKKWKTENIRRKHNYVPFLFNFLKILEEKQQLKPLIEKAKRGSHSRNSK

SEQ ID NO: 5217 - protein, 329 aa, Oryza sativa
MSWAAIENDPGIFTELLQQMQLKGLQVDELYSLDLDALNDLQPVYGLIVLYKWQPPEKDERPIKDPIPNLFFAKQIINNACATQAIVSVLLNSPGITLSEELKKLKEFAKDLPPDLKGLAIVNSESIRLASNSFARPEVPEEQKSSVKDDDVYHFISYVPVDGVLYELDGLKEGPISLGKCPGGVGDIGWLRMVQPVIQERIDRFSQNEIRFSVMAILKNRREKFTLELKELQRKRENLLAQMGDPSANRHAPSVEHSLAEVAAHIEAVTEKIIMEEEKWKKWKTENIRRKHNYVPFLFNFLKILEERQQLKPLIEKAKQKSHSSANPR

SEQ ID NO: 5218 - protein, 327 aa, Brachypodium distachyon
MSWAAVENDPGVFTELLQQMQLKGLQVDELYSLDLDALKDIQPVYGLIILYKWRPPEKDERPVIKDAVPNLFFANQIINSACATQALVSVLLNSSGITLSDDLRKLKEFAKDLPPELKGLAIVNCESIRVTSNSFARSEDSEEQKASSKDDDVYHFISYVPVDGVLYELDGLKDGPISLGKTPGGAGDIGWLRMVQPVIQERIDQFSQNEIRFSVMAITKNRKEMYIVELKELQRKRENLLSQMGDPSVNRQRQSVERSLAEVAAQIEAVTEKIIMEEEKSKKWKTENIRRKHNYVPFLFNFLKILEEKKQLKPLIEKAKQKSPNPK

SEQ ID NO: 5219 - protein, 313 aa, Setaria italica
MQLKGLQVDELYSLDLDALNDLQPIYGLIVLYKWRPPEKDERPVMKDTIPNLFFANQIINNACATQAILSVLLNSPGITLSDELKRLKEFAKDLPPELKGLAIVNCTSIRMLNNSFARSEVSEEQKPSSKDDDVYHFISYVPVDGVLYELDGLKEGPISLGKCSGGVGEAGWLRVAQPVIQEHIDRFSQNEVRFSLMAILKNRKEVYTAELKDLQRQRESLLQQMSDTSTRHMSSVGQSLAEVAAQIEAVTEKIIMEEEKLKKWKMENMRRKHNYVPFLFNFLKILEEKQQLMPLIEKAKAKQKSHSHSSNPR

SEQ ID NO: 5220 - protein, 328 aa, Hordeum vulgare
MSWAPIENDPGVFTELLQQLQLKGLQVDELYSLDLDALNDLQPIYGLILLYKWRPPEKDERPVIKDAVPNVFFANQIINSACATQAIVSVLLNSSGITLSEDLKKLKEFAKDMPPELKGLAIVNCESIRITSNSFARSDDYSEEQKSKDDDVYHFISYVPVDGVLYELDGLKEGPISLGKCPGGIGEMGWLKMVQPVIQERIDKFSQNEIRFSVMAITKNRKEIFIMELKELQRKRENLLSQMGDPSANRQRPSVERSLAEVAAQIEAVTEKIIMEEEKAKKWKTENIRRKHNYVPFLFNFLKILEEKQQLKPLIEKAKQNSHGRNPK

SEQ ID NO: 5221 - protein, 328 aa, Triticum aestivum
MSWAPIENDPGVFTELLQQLQLKGLQVDELYSLDLDALNDLQPIYGLIVLYKWRPPEKDERPVIKDAVPNLFFANQIINSACATQAIISVLLNSSGITLSEDLKKLKEFAKDMPPELKGLAIVNCESIRMTSNSFAKSDDYSEEQKSKDDDVYHFISYVPVDGVLYELDGLKEGPISLGKCPGGIGEMGWLKMVQPVIQERVDKFSQNEIRFSVMAITKNRKEIFIMELKELQRKRENLLSQMGDPSANRQRPSIERSLAEVAAQIEAVTEKIIMEEEKAKKWKTENIRRKHNYVPFLFNFLKILEEKQQLKPLVEKAKQNSHSRNPK

SEQ ID NO: 5222 - protein, 328 aa, Triticum aestivum
MSWAPIENDPGVFTELLQQLQLKGLQVDELYSLDLDALNDLQPIYGLIVLYKWRPPEKDERPVIKDAVPNLFFANQIINSACATQAIVSVLLNSSGITLSEDLKKLKEFAKDMPPELKGLAIVNCESIRMTSNSFAKSDDYSEEQKSKDDDVYHFISYVPVDGVLYELDGLKEGPISLGKCPGGIGEMGWLKMVQPVIQERVDKFSQNEIRFSVMAITKNRKEIFIMELKELQRKRENLLSQMGDPSANRQRPSIERSLAEVAAQIEAVTEKIIMEEEKAKKWKTENIRRKHNYVPFLFNFLKILEEKQQLKPLVEKAKQNSHSRNPK

SEQ ID NO: 5223 - protein, 84 aa, Triticum aestivum
MALLMMLVLAAETASAASCNAGQLTVCASAMLSGAAPSAACCSNLKAQQGCLCQFAKNPAYARYVNSPNARKTVASCGVALPRC

SEQ ID NO: 5224 - protein, 94 aa, Saccharum officinarum
MARSAFVPMEEKEQGAAGRGAGAGVNKEQQKVLLVHSQVRRIKKEDEEARERLLKLRLLETRPAAAGGGVAWRAPRSLSPLRRAGSAIPVPVGE

SEQ ID NO: 5225 - protein, 96 aa, Saccharum officinarum
MARSAFAPMEEKEQGPGRGAGAGVNKKQVEQQEVLLVHSQVRRIKKEDEEARERLLKLRLLETRPAAAAGWVAWRAPRSLSPLRRAGSAIPVPVGE

SEQ ID NO: 5226 - protein, 458 aa, Oryza sativa
MAAQSWRSFMCCGGGAAVHDDDDSAPRRRRIARRGDSPRSSSRMSFTSLSSSGTLSPEDLSLTLSGSNLYAFTYAELRAATGSFSRANYLGCGGFGPVYKGAVDDGLRPGLAAQDVAVKYLDLDCGTQGHKEWLAEVFFLGQLRHKNLVKLIGYCYEAEHRMLVYEYMSGESLEKHLFKTVNGSLPWMTRMKIALGAAKGLAFLHDADPPVIYRDFKASNILLDLDYNTKLSDFGLAKDGPQGDATHVTTRVMGTHGYAAPEYIMTGHLTAKSDVYSFGVVLLELLSGRKSVDRSRRPREQSLVDWARPYLKWADKLYKVMDPALECQYSCQGAEVAALVAYKCLSENPKSRPTMREVVKALEPVLGMDDFFPVGPFVFTVIVEDEKVVNMKVDMKVEVEEKKNTHQNHQDRHRQKYPDSAIHAGIVLHDRDGVIGGGYTGALRRHRRTASYNKERGA

SEQ ID NO: 5227 - protein, 875 aa, Zea mays
MGGGRKRGRTQRRHFKQGRENVWKHNPQRPPAGEGGEAREDNPSWQPFATENPAFEEYYKEQQIVSEEEWDSFMSMLRKPLPATFRINASCQFFQDICSQLENDFRKSLETEVTDDHEEDAIRPLPWYPGNLAWHLNFSRMQLRRNQALESFHEFLKRENEVGNITRQEAVSMVPPLFLNVQPDHHILDMCAAPGSKTFQLLEMIHQSTKPGLLPNALVVANDVDVQRCNLLIHQTKRMCTANLIVTNHEAQNFPGCNLAKFCSKMCMDEAKVQRLEFDRVLCDVPCSGDGTVRKAPDMWRKWNAGMGNGLHHLQVEIAMRGMSLLKVGGRMVYSTCSMNPVENEGVVAEILRRCGDSVELLDVSNELPELARRPGLSTWKVRDRGSWFGVHEDVPRYRKHVISASMFPSGKGSKDSGTGSSSVEVNTDVADADMKDSTDMGEGEQETTVTIDDSNNGDNLKTEEGTKVDCESGEVTTSSSYKKLNSTSIRTEHSDYPLHRCMRIVPHDQNSGAFFIAVLHKLSPLNENQVVDGVRIDQNISKDKTEKLEKDLVSHKASSEENTVHQQVIDNANVLDGEQNRDRDNKSSEDKSSEDSKVNVNEAAKGQAGTRDRRRQQNQGRWRGVDPVIFFKDEVTVKSIVSFYGITDSFPLEGHLVTRNPDTSHVKRIYYVSKSVQDVLELNIKIGERLKITSLGLKIFERQSSKEGSPCTFRLSSEGLPLLLPYITKQILYASAIDFQHLLQYRTIKFPDFVDAKFGEEASALLPGCCVVVLREGHQDIGSIATDPSAIAIVCWKGKTNLCVMVSPLDGKELLERISLRHGLKIPKGDKEKPSQEIAGSDELLDCATEVDDQESLPESKASDIEISDAKEAE

SEQ ID NO: 5228 - protein, 269 aa, Zea mays
MQAPPAPSSVDLPLAVAPPPVKAPTPRPPPPASLQPESPGVFFSAAAAAAPLGTAHRRIAIAVDLSDESAYAVRWAVANYLRPGDAVILLHVRPTSVLYGADWGAVDVSLPNPSATAASEDGDGDCETAAAARRMEDDYDAFTATKADDFASPLKDAGIPYKIHIVRDHDMKERLCLEVERLSLSAVIMGSKGFGAARRTSKGRLGSVSDYCVHHCVCPVVVVRFPDDGSAEGGEAAGLSAAVGAEDVLHPVPEEEGEYHDAAEEHKDA

SEQ ID NO: 5229 - protein, 265 aa, Pennisetum glaucum
MQAPATPSTDDLPLSAPPPPVKAPTPRPPPPASLQPDSPGVFFSAAAAALPSGSSHRRIAIAVDLSDESAYAVRWAVANYLRPGDAVVLLHVRPTSVLYGADWGAVDVSLPNPSAGDDDDDDSEAAARRMEDDYDAFTASKADDLARPLKEAGIPYKIHIVRDHDMKERLCLEVERLGLSAVIMGSKGFGAARRNIKGRLGSVSDYCVHHCVCPVVVVRFPDDGPAEDGEAGGLSSAVGAEDVLHPVPEEDAEYHDATEEQHKDT

SEQ ID NO: 5230 - protein, 226 aa, Zea mays
MHAPAPPSSVDLPLSAPPPPVKAPSPRPPPPASLQPESPGVFFSATAPLGTSHRRIAIAVDLSDESAFAVRWAVANYLRSGDAVILLHVRPTSVLYGADWGAVDVSLPIPSAYSEDGFGGGDADSEAAAARRMEDDYDAFTASKADDIARPLKEAGIPYKIHIVRDHDMKERLCLEVERLSLSAVIMGSKGFGSTRRTSKGRLGSVSDYCVHHCICPVVVVRFPDE

SEQ ID NO: 5231 - protein, 268 aa, Oryza sativa
MQNPPSHPVDLPLAAAPPPVKAPTPRPPTPASLQPESPGVFFTAAAAAAPVGSSHRRIAIAVDLSDESAYAVRWAVANYLRPGDAVILLHVRPTSVLYGADWGSVDLSLPAANPNPSGDPPSAEDDAEAAARKMEDDFDAFTASKADDLAKPLKDAGIPYKIHIVKDHDMKERLCLEVERLGLSAVIMGSKGFGASRRTSKGRLGSVSDYCVHHCVCPVVVVRFPDDGVAEGGEAGGASELAVGEEVLHPVPEEDAEYHDATEEHKDT

SEQ ID NO: 5232 - protein, 203 aa, Zea mays
MDDCGGGGGKRPFQLARSLTYHHHPGHRPAAASRWRRQHQQHQLADEPRAPRPQAVVLYTTSLRGVRRTFADCAAVRAILRGFRVAVDERDVSMDAALRREVQALLAARGRAFALPQLLIGGRLVGGADEVRQLNETGQLRRLLDGAAGQDPAFVCDACGGVRFVPCAGCGGGRKVFVEEEGRVVRCVECNENGLVRCLNCCS

SEQ ID NO: 5233 - protein, 206 aa, Cenchrus ciliaris
  misc_feature (74)..(75): Xaa can be any naturally occurring amino acid
MEDCSGVAAGVGGGKKPFQLARSLTFHHHQGHRPAAASAAKWRRTQLADEPRAHRPQALVLYTTSLRGVRRTFXXCSAVRAILRGFRVAVDERDVSMDAAFRRELQALLSVRGRAFSLPQLLIGGRLVGGADEVRQLHETGQLRRLLEGAAGQDPAYVCDACGGVRFVPCTGCGGSRKVFVEEEDRVVRCGECNENGLVRCANCCS

SEQ ID NO: 5234 - protein, 215 aa, Setaria italica
MEDCSGVAAGVGGGSCGKKPFQLARSLTYHHHQGHRPAGASAAKWRRSQLADEPRAQRPQAVVLYTTSLRGVRRTFTDCSAVRAILRGFRVAVDERDVSMDAAFRRDLQALLAVRGRAFSLPQLLIGGRLVGGADEVRQLHETGQLRRLLEGAAGQDPAYVCDACGGVRFVPCIGCGGSRKVFVEEEDRVVRCGECNENGLVRCANDHQQRRDLS

SEQ ID NO: 5235 - protein, 88 aa, Saccharum officinarum
MEGKSKLPEVTIVPAARPLAGDGTVDAAKAAAAGKEPISPGTPSSVDAGRRGKERRAVDAVPLPGWKLDALCQESCPSPTMRARFPYF

SEQ ID NO: 5236 - protein, 85 aa, Saccharum officinarum
MEGKSRLPEVSIEPAARPLAVDGTVDAAKASKEPISPGTPSSVDAGRRSKERRAVDAVPLPGWKLDALCQESCPSPTMRARFPYF

SEQ ID NO: 5237 - protein, 104 aa, Triticum aestivum
RGLGLTSSDFKGDSKMEGKSRLPEVTIVPAARPLAGDGTIDAAKAAAAPGKEPISPGTPSSADAGRRGKERRAVEAVPLPGWKLDALCQESCPSPTMRARFPYF

SEQ ID NO: 5238 - protein, 88 aa, Setaria italica
MEGKSRVPEVTIVPAPRPAAGAGSVDAAKAAGKEPISPGTPSSADAGRGRSGKERRAEEGVSLPGWKLDALCQESCPSPAMRARFLYF

SEQ ID NO: 5239 - protein, 704 aa, Zea mays
MRERDACWEYCDKLDGNKVRCRFCHKVLNGGISRLKFHLSQIPSKGVNPCTKVKEDVVDRVKAVISAKEEYKEFQLLKRQRVADLSSAAAPAKWAPEAPPSLSTSPGRVASPAAVITRAAEQSRLLAPEASAPVPRPSAAAANNKPRAAAASEWETERCIAEFFFENKLDYSIADSVSYQQMLEALGGPGFRGPPADVLRDKWLQRLKSEILQKTKEIEKDWATTGCTILADSWTDNKLKALINFSVASPMGTFFLKTVDASSHFKTHRGLYDLFDEVIQEVGPENVVQIIADRNINYGSTDKLVAQNYGGAIFWSPCASFCVNAMLDDFSKIDWVNQCICQAQTVTRFIYNSRWVLDLARKCVAGQELVCSGITKSVSDFLTLKSLLRHRPKLKQMFHSAEFSSSSYASRSIPCVEILDDDELWRAVEEIAAVSEPLLRVMRDVSGGRQAIGYIYESMTKVTDSIRTYYIMDEGKCKSFLDIVEQRWQTELHSPLHSAAAFLSPGIQYNPEVKFFRTIKEEFYQVLDKVLTTPDQRHDITAQLHAFRKAQGLFGSNIAKEARNNTPPGMWWEQYGDSAPSLQRAAVRITSQVCSTLTFQRDWGVILQNHYEKRNKLDKEALADQAYVHYNLTLHSEPKARRRPDADPIALDAVDMTSAWVEDSDGPILTQWLDRFPSALDGGDLNTRQFGGSIFGTNDNLFGL

SEQ ID NO: 5240 - protein, 168 aa, Panicum virgatum
MGSQAIEAHRAGAEVYSGAALCAEKSTELLAEVHLPLGLLPLADMEEVGYNRSTGFVWLRQKKALTHTFKQIGRQVSYAAEVTAFVEDRRMKRMTGVKTKELLIWVTLSDMFVEKDDPSKITFKTPTGLGRTFPVAAFAKEGDDGKTKPKEAPTAANGKEPAAAVTSK

SEQ ID NO: 5241 - protein, 168 aa, Panicum virgatum
MGSQAIEAHRAGAEVYSGAALCADKSTELLAEVHLPLGLLPLADMEEVGYNRSTGFVWLRQKKALTHTFKQIGRQVSYAAEVTAFVENRRMKRMTGVKTKELLIWVTLSDMFVEKDDPSKITFKTPTGLGRTFPVAAFAKEGDDGKAKPKEAAPAANGKEPAAAVSGK

SEQ ID NO: 5242 - protein, 218 aa, Zea mays
MARRASLLLAAALLVAVAAAAVPPTCERIECPAYEVVDSANGFEIRRYTDAMWITTAPIEDISFVAATRTGFLQLFDYIQGKNAYNQTIEMTAPVLTRVSPSDGPFCASAFAVSFYVPAKNQADPPPAEGLRVDRWAGARYAAVRRFGGFVADADVGEQAARLEASLQGTRWAAAVNDARRADPASPYTVAQYNSPFEFTGRVNEIWMLFDADDDASM

SEQ ID NO: 5243 - protein, 60 aa, Saccharum officinarum
MTKRVMGKKEVNTAAAAAAEEKRAWVPDPVTGYYRPAGSAAKEVDAAELRAKLLPEAAAN

SEQ ID NO: 5244 - protein, 102 aa, Zea mays
MERVASSYCVSLLAQSRRAYTVAAAMAKKGAAARRVDEKKAAAALTKRVMGKKEVNTAAAAAAEEKAWVPDPVTGYYRPAGSAKEVDAAELRAKLLTEAAAN

SEQ ID NO: 5245 - protein, 94 aa, Setaria italica
MERVASGCVSLLAQRRAYSVAAAMAKGAGRRADEKAAAAKRVMGKKEVNTAAAVAEEKTAWVPDPATGYYRPAGGAKEVDAAELRAKLLTQAAN

SEQ ID NO: 5246 - protein, 92 aa, Panicum virgatum
MERVASSCVGHLAQRRAYSVAAAMAKGAGRRADDEKKAAAKRVMGKKEVNTAAAEKTAWVPDPVTGYYRPAGGAKEVDAAELRAKLLTQAAN

SEQ ID NO: 5247 - protein, 245 aa, Zea mays
MASASAPEVVVVFDFDRTIIDWDSDDWVITKLGAADAFQRLRPTMRWNPLMDRMMAELHARGKTPEDIRDCLRSAPLDTHVVSAVKTAAALGCDLKVVSDANTFFIETVLAHHGVLGCFSEIVTNPASVDADGRLRISPFHDPASAPHGCSLCPDNMCKCRARYWGGSRQQAVTRSGAGASSTSVTGREITARPSSWGKGTTSWQGRTTPCGISSATTSSFSRLRFIRGTAARNWKRRCLSWPAK

SEQ ID NO: 5248 - protein, 536 aa, Saccharum officinarum
MATPAPAPSLRFLLLLLPLLAIAGALSHPAHEFCAVGGDAASCGGGGDGTRILIKGGTVVNAHRAEEADVYIEDGVVVAVRPNIPVGADNVRVIDATGKYVMPGGIDPHTHLEMEFMGTVTIDDFFSGHAAALAGGTTMHIDFVIPVNGNLTAGLESYKHKAAKASMDYGFHMAITKWNDEVAREMEVMVKEHGINSFKFFMAYKGSLMVTDDLLLQGLQKCKSLGALAMVHAENGDAVAEGQQRMIDLGITGPEGHALSRPPILEGEATARAIRLAKFINTPLYVVHVMSIDAMDEIAKAKREGQRVIGEPVVSGLVLDDSWLWDPDFTIASKYVMSPPIREAGHGKALQAALSSGILQLVGTDHCTFNSTQKAFGSDDFRKIPNGVNGLEERMHIIWDSMVVTGKISVTDYVRVTSTECAKIFNIFPRKGAILEGSDADIIILNPERSFVMGAHTHHSRSNTNVYEGRKGKGMVEITISRGQVVWEDGVLNIAPGSGRYVMMPPFGYVFDGIEKSDAAYRASLRAPVQRGKAGA

SEQ ID NO: 5249 - protein, 538 aa, Zea mays
MATQALAPSLRLLLLLPLLAAAAAAAALSHPAHEFCAVGGDASGCGGGGDGTRILIKGGTVVNAHLAEEADVYIEDGVVVAVRPDIPVDVDNVRVIDATGKYVMPGGIDPHTHLEMEFMGTVTIDDFFSGHAAALAGGTTMHIDFVIPVDGNLTAGLESYKHKAAKAAMDYGFHMAITKWNDEVAREMEVMVKEHGINSFKFFMAYKGSLMVTDDLLLQGLRKCKSLGALAMVHAENGDAVAEGQQRMIDLGITGPEGHALSRPPILEGEATARAIRLAKFINTPLYVVHVMSIDAMDEIAKAKREGQRVIGEPVVSGLVLDDSWLWDPDFTIASKYVMSPPIREAGHGKALQAALSSGILQLVGTDHCTFNSTQKAFGSDDFRKIPNGVNGLEERMHILWDSMVETGKISVTDYVRVTSTECAKTFNIFPRKGAILEGSDADIIILNPERSFVMGALTHHSRSNTNVYEGRKGKGMVEITISRGRVVWEDGVLNIAPGSGRYVMMPPFGYVFDGIEKSDATYRASLRAPVQRGKAAA

SEQ ID NO: 5250 - protein, 242 aa, Panicum virgatum
MEEIAKAKREGQRVIGEPVVSGLVLDDSWLWNPDFTIVSKYVMSPPIREAGHGKALQAALSSGILQLVGTDHCTFNSTQKAFGSDDFRKIPNGVNGLEERMHIIWDSMVETGKISVTDYVRVTSTECAKIFNIYPRKGAILEGSDADIIILNPERSFVMGAHTHHSRSNTNVYEGRKGKGMVEVTISRGRVVWEDGVLNIAPGSGRYVRMLPFGYVFDGIEKSDAAYRASLRAPVQRGKASA

SEQ ID NO: 5251 - protein, 530 aa, Pennisetum glaucum
MATPTPSQLLLLLLPLLAVAASHPAHEFCAAGGDAGCGGGGDGARILIKGGTVVNAHRAEEADVYIEDGVVVAVRPNIPVGNDHVRVIDATGKYVMPGGIDPHTHLAMEFMGTVTIDDFFSGHAAALAGGTTMHIDFVIPVNGNLTAGLESYKQKAANAAMDYGFHMAITKWNDEVAREMEVMVKEHGINSFKFFMAYKGSLMVTDDLLLQGLRKCKSLGALAMVHAENGDAVAEGQQRMIDLGITGPEGHALSRPPILEGEATARAIRLAKFINTPLYVVHVMSVDAMEEIAKAKREGQRVIGEPVVSGLVLDDSWLWDPDFTVASKYVMSPPIREAGHGKALQAALSSGILQLVGTDHCTFNSTQKAFGSDDFRKIPNGVNGLEERMHIIWDSMVETGKISVTDYVGVTSTECAKIFNIYPQKGAILEGSDADIIILNPERSFVMGAHTHHSRSNTNVYEGRKGKGMVEVTISRGRVVWEDGVLNITPGSGRYIRMAPFGYVFDGIEKSDAAYRASLRAPVQRGKAAA

SEQ ID NO: 5252 - protein, 532 aa, Brachypodium distachyon
MATPCRLLLILLGIVAVAVAAPHPAHEFCAAAAGGGGAGSCGGDGTRILIKGGTVVNAHRAEVADVYVEDGVVVAVRPNIPVGEDNVKVIDATGKYVMPGGIDPHTHLEMEFMGTVTIDDFFSGHAAALAGGTTMHIDFVIPVNGNLTAGLESYKHKAEKSAMDYGFHMAITKWNDEVSKEMEVMVKEHGINSFKFFMAYKGSLMVTDDLLLQGLQKCKSLGALAMVHAENGDAVAEGQQRMIDLGITGPEGHALSRPPVLEGEATSRAIRLAKFINTPLYVVHVMSIDAMEEIAKAKREGQRVIGEPVVSGLVLDDSWLWDPDFATASKYVMSPPIREAGHNKALQAALSSGILQLVGTDHCTFNSTQKAFGSDDFRKIPNGVNGIEERMHIIWDSMVETGKITVTDYVRVTSTECAKIFNIYPQKGAIMEGSDADIIILNPKGSFVMGAHTHHSRSNTNVYEGRKGKGMVEVTISRGRVVWEDGTLNVAAGSGRYIRTPPFGYLFDGIEKSDAAYRASLRAPVQRSKAAA

SEQ ID NO: 5253 - protein, 536 aa, Triticum aestivum
MATPCRIRRLLVLLAAVAVAASHPAHEFCAAAGGGGGGAGGCGGGGDGTRILIKGGTVVNAHRAEEADVYIEDGVVVAVRPNIPVGDDNVRVIDATGKYVMPGGIDPHTHLEMEFMGTVTIDDFYSGHAAALAGGTTMHIDFVIPVNGNLTAGLESYKHKAEKAAMDYGFHMAITKWNDEVSREMEVMVKEHGINSFKFFMAYKGSLMVTDDLLLQGLQKCKSLGALAMVHAENGDAVAEGQQRMIDLGITGPEGHALSRPPVLEGEATSRAIRLAKFVNTPLYVVHVMSTDAMEEIAKAKREGQRVIGEPVVSGLVLDDSWLWDPDFATASKYVMSPPIREAGHNKALQAALSSGILQLVGTDHCTFNSTQKAFGSDDFRKIPNGVNGIEERMHIIWDSMVETGKITVTDYVRVTSTECAKIFNIYPRKGAILEGSDADIIILNPKRSFAMGTRTHHSRSDTNVYEGRKGKGMVEVTISRGRVVWEDGNLNAVPGAGRYVRTPPFGYLFDGLDKSDAVYRASLRAPVRRGEAAAA

SEQ ID NO: 5254 - protein, 526 aa, Hordeum vulgare
MATPCRIRVLFVLLAAAVAGAASHPAHEFCAAAGGGDGTRILIKGGTVVNAHRAEEADVYIEDGLVVAVRPNIPVGDDNVKVIDATGRYVMPGGIDPHTHLEMEFMGTVTIDDFYSGHAAALAGGTTMHIDFVIPVNGNLTAGLESYKHKAEKSAMDYGFHMAITKWNDEVSREMEVMVKEHGINSFKFFMAYKGSLMVTDDLLLQGLQKCKSLGALAMVHAENGDAVAEGQQRMIGLGITGPEGHALSRPPVLEGEATSRAIRLAKFVNTPLYVVHVMSIDAMEEIAKAKREGQRVIGEPVVSGLVLDDSWLWDPDFATASKYVMSPPIREAGHNKALQAALSSGILQLVGTDHCTFNSTQKAFGSDDFRKIPNGVNGIEERMHIIWDSMVETGKITVTDYVRVTSTECAKIFNIYPRKGAILEGSDADIIILNPKRSFAMGARTHHSRSDTSVYEGRKGKGMVEVTISRGRVVWEDGNLNAVPGAGRYVRTPPFGYLFDGIDKSDAVYRASLRAPVRRGEAAAA

SEQ ID NO: 5255 - protein, 538 aa, Triticum aestivum
  misc_feature (7)..(7): Xaa can be any naturally occurring amino acid
  misc_feature (9)..(9): Xaa can be any naturally occurring amino acid
  misc_feature (58)..(58): Xaa can be any naturally occurring amino acid
  misc_feature (91)..(91): Xaa can be any naturally occurring amino acid
MATPCRXRXLLVLLAAVAVAASHPAHEFCAAAGGGGGGAGGCGGGGDGTRILIKGGTXVNAHRAEEADVYIEDGVVVAVRPNIPVGDDNVXVIDATGKYVMPGGIDPHTHLEMEFMGTVTIDDFYSGHAAALAGGTTMHIDFVIPVNGNLTAGLESYKHKAEKAAMDYGFHMAITKWNDEVSREMEVMVKEHGINSFKFFMAYKGSLMVTDDLLLQGLQKCKSLGALAMVHAENGDAVAEGQQRMIDLGITGPEGHALSRPPVLEGEATSRAIRLAKFVNTPLYVVHVMSTDAMEEIAKAKREGQRVIGEPVVSGLVLDDSWLWDPDFATASKYVMSPPIREAGHNKALQAALSSGILQLVGTDHCTFNSTQKAFGSDDFRKIPNGVNGIEERMHIIWDSMVETGKITVTDYVRVTSTECAKIFNIYPRKGAILEGSDADIIVLNPKRSFAMGTRTHHTRSDTNVYEGRKGKGMVEVTISRGRVVWEDGNLNAVPGAGRYVRTPPFGYLFDGLDKSDAVYRASLRAPVQRGEAAAAAA

SEQ ID NO: 5256 - protein, 511 aa, Oryza sativa
MAMPCRLHGDILLLLLGAVAVAVAHPAANEFCAAVGGGSGGCGVGGGGGGDGRRILIRGGTVVNAHRVEEADVYVEDGVIVAVRPNIPVGDDHVKVIDATGKYVMPALAGGTTMHIDFVIPVNGNLTAGLESYKQKAEKSAMDYGFHMAITKWNDDVSREMETMVKEHGINSFKFFMAYKGSLMVTDDLLLQGLQKCKSLGALAMVHAENGDAVAEGQQRMIDLGITGPEGHALSRPPVLEGEATARAIRLAKFVNTPLYVVHVMSIDAMDEIAKAKREGQRVIGEPVVSGLVLDDSWLWDPDFMIASKYVMSPPIREAGHNKALQVALSSGILQLVGTDHCTFNSTQKAFGSDDFRKIPNGVNGIEERMHIIWDSMVETGRISVSDYVRVTSTECAKIFNIYPRKGAILEGSDADIIILNPERSFVMGAHTHHSRSNTNVYEGRKGKGMVEVTISRGRVVWEDGILNVVPGSGRYVRTPPYSYLFDGIEKSDAAYRASLRAPVKRGKAAA

SEQ ID NO: 5257 - protein, 408 aa, Zea mays
MAEICCEEAKSTPATAVAAASVSATAAAAAAVAVASSALERRRRRLEMRRFRVASDPEELVAEDVRAAKRQRLARTLSGSCPDAGSDSDRPALPRYGVTSVCGRRREMEDTVSIRPDFLPGTSKHNFFGVFDGHGCSHVATMCQDNMHEVVADEHTKAASGEETAWKGVMERSFSRLDEQAASWATSRSRDEPACRCEQQMPLRCDHVGSTAVVAVVSPSHVVVANAGDSRAVLSRGGVPVPLSVDHKPDRPDELARIEAAGGRVIYWDGARVLGVLAMSRAIGDRYLKPFVSSEPEVTVTERTDDDECLILASDGLWDVVTNEMACEVVRACFRSNGPPAPAARPNGVALPAAGAGAEDGSAVVKGVGKEDSDKACSDAAMLLAKLALARRSADNVSVVVVDLRRGI

SEQ ID NO: 5258 - protein, 413 aa, Zea mays
MAEICCEEAKSTPATAVAAASVSATAAAAAAVAVASSALERRRRRLEMRRFRVAGDPEAPVAEDVRAAKRQRLARTLSSTCPDAGSGSGSDSDRPALPERLPRYGVTSVCGRRREMEDTVSVRPDFVPGTSKQHFFGVFDGHGCSHVATMCQNMMHEVVADEHRKADCSGEETAWKAVMERSFARLDEQAASWATSRSRDEPSCRCEQQKPLRCDHVGSTAVVAVVSPTHVVVANAGDSRAVLSRAGVPVPLSVDHKPDRPDELARIKAAGGRVIYWDGARVLGVLAMSRAIGDGYLKPFVSSEPEVTVTERTDDDECLILASDGLWDVVTNEMACEVVRACFHSNGPPAPAARANGAALRAAENGSAAAKGVSVEDSDKACSDAAMLLAKLALARRSADNVSVVVVDLRRGI

SEQ ID NO: 5259 - protein, 401 aa, Setaria italica
MAEICCEEAKSTPATAVAAAAAAAAAAVASSALERRRRRLEMRRFQAPVADDVRAGKRQRLARTASGSCPEVVSEFERPELPERLPRHGVTSVCGRRREMEDAVSIRPDFLPGATKHHFFGVFDGHGCSHVATLCQDRMHEVVADEHNNAGSGEETAWKGVMERSFARLDEQAASWASSRSGDEPACRCEQQMPSRCDHVGSTAVVAVVNPTHVVVANAGDSRAVLSRAGAPVPLSVDHKPDRPDELARIEAAGGRVIYWDGARVLGVLAMSRAIGDGYLKPFVSSEPEVTVTERTDDDEFLILASDGLWDVVDNVMACGVVRACFRSNGPPAAPAARANGVAPPAGDADAENGSAVVKGVSKVDSDKACSDAAMLLAKLALARRSADNVSVVVVDLRRGI

SEQ ID NO: 5260 - protein, 397 aa, Panicum virgatum
MAEICCEEAKSTPATAVAVASSALERRRRRLEMRRFRIATDLDAPAEEDVRAGKRLRLARTASGSSADAVPDCKRPALPERLPRYGVSSVCGRRREMEDAVSIRPDFLPGASKHHFFGVFDGHGCSHVAALCQDRMHEVVADEHHNAGSGEVAAWKGVMERSFARLDEQATSWASSRSGDEPACRCEQQMPSRCDHVGSTAVVAVVSPTHVVVGNAGDSRAVLSRAGAPVELSVDHKPDRPDELARIEAAGGRVIYWDGARVLGVLAMSRAIGDGYLKPFVSSEPEVTVTERTGEDECLILASDGLWDVVTNEMACEVVRACFRSNGPPAPAARPDGAAPPAADADAENGSAVVKGVSKADSDKACSDAAMLLAKLALARRSADNVSVVVVDLRRGI

SEQ ID NO: 5261 - protein, 564 aa, Saccharum officinarum
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRANAVNLDFSEILSDEEIETQLKEAAVISMGTEVSDLDLSNIRELCDQVLALSEYRTQLYDYLKSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLENRELGKSAGSTKGKPKIEVYEKDRKKGAGALTTPAKTYNPAADLVLTEETPKKSELASKKRKHHEVETEPSAEPAEEAIQEDGKKKKKKKSKESEEAPAVEGDGEKKKKKKSKEAEEEPAVAAASEGEKKKKKKKSDADGEDVAMQTEESGKKDKKKKKKKHADDE

SEQ ID NO: 5262 - protein, 562 aa, Zea mays
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRVNAVNLDFSEILSDEELETQLKEAAVISMGTEVSDLDLSNIRELCDQVLALSEYRAQLYDYLRSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKKGTGALTTPAKTYNPAADLVLTEETPKKSELASKKRKHNEVETEPLAEPAEEAIQEDGDQEDRKKKKKKNKESKEAPAGEGDGEKKKKKKSKEVEEEPVVAAASEVKKKKKKSDADGEDVAMQTEESGKKEKKKKKKAC

SEQ ID NO: 5263 - protein, 564 aa, Zea mays
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRTNAVNLDFSEILSDEELETQLKEAAVISMGTEVSDLDLSNIRELCDQVLALSEYRAQLYDYLKSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKQGAGALTTPAKTYNPAADLVLTEETPKKSELASKKRKHHEVQTEPSAELAEGAVQEDRKKKKKNKESEEAPAAEGDGEKKKKKKSKDVGEEPAVAAAAATEGEKKKKKKKSDADGEGVTTQTEESGKKDKKKKKKRHADDE

SEQ ID NO: 5264 - protein, 568 aa, Setaria italica
MLVLFETPAGFALFKVLDEGKLDKVEDLWKEFTTSDSARRVVELKAFNKFENTSDALSAATLIIDGKPSKGLRKFLQKHCEGETLAVADSKLGNAIKEKLKIDCLHNSAVMELMRGLRNQLTELITGLGAQELGPMSLGLSHSLSRYKLKFSPEKVDTMIIQAIGLLDDLDKELNTYAMRVREWYGWHFPELTKIVTDNIQYAKVVKMMGDRANAVNLDFSEILSDEEVEAQIKEAAVISMGTEVSDLDLLNIRELCDQVLALSEYRAQLFDYLKSRMNTIAPNLTALVGELVGARLIAHGGSLVNLAKQPGSTIQILGAEKALFRALKTKHATPKYGLIYHASLIGKASQKHKGKISRSLAAKTALAIRCDALGDGEDNSIGTESRLKLETRLQVLENKEFGKSAGSTKGKPKIEVYEKDRKKGAGALITPAKTYNPATDVVLGQSTEETPKKSELASKKRKHHEAEAAQTTEPAAEAIQEDGDQERKKKKKKDKETEATPVAAADGEKKKKKKSKESEEPAVAAAEGEKKKKKKKSDVDGEDVVLQTAESGKKDKKKKKKKHADDE

SEQ ID NO: 5265 - protein, 303 aa, Zea mays
MLQSQLTLLVLLETPAGFALFKVLDEGKLDKVEDLWKEFTTSDSARKVVELKAFNKFENTSDALSAATLIIDSKPSKGLHKFLQKHCQGETLAVADSKLGNAIKEKLKIDCLHNSVVMELMRGLRNQLTELITGFGAQDLGPMSLGLSHSLSRYKLKFSPEKACLISVDTMIIQAIGLLDDLDKDLNTFAMRVREWYGWHFPELTKIVSDNIQYAKVVKMMGNRANAVNLDFSEILSDEELETQLKEAAVISMGTEVSELDLLNIRELCDQVLALSEYRAQLYDYLRSRMNTIAPNLQHWWVN

SEQ ID NO: 5266 - protein, 560 aa, Brachypodium distachyon
MLVLFETPAGFALFKVLDQGKLDKVEDLWKEFTTSDSARKVVELKAFNKFENTSDALSAATLIIDSKPTKGLRKFLQKHCEGETLAVADSKLGNAIKEKLKIDCVHNSAVMELMRGLRNQLTELISGLGTQDLGPMSLGLSHSLSRYKLKFSPEKVDTMIIQAIGLLDDLDKELNTYAMRVREWYGWHFPELTKIVTDNIEYAKVVKLMGNRTNAVNLDFSEILTDDEVEAQLKEAAVISMGTEVNDLDLSNIRELCDQVLSLSEYRAQLYDYLRSRMNTIAPNLTALVGELVGARLISHGGSLLNLAKQPGSTIQILGAEKALFRALKTKHATPKYGLIYHASLIGQAAPKHKGKISRSLASKAALAIRYDALGDGEDNSIGLESRLKLETRLRVLEGKELGRSAGSTKGKPKIEVYEKDRKGAGALITPAKTYNPSADLVLAKSAEEPAKKPETASKKRKHDEAETAPSTEPAGEAIQEDGDQEVRKKKKKKSKDSEESAATNTNGEKKKKSKGGKEEPAGSEKKKKKNSDVQDSKIVAMETESGKKDKKKKKKHTDE

SEQ ID NO: 5267 - protein, 543 aa, Hordeum vulgare
MLVLFETPAGFALFKVLNESKLDKVEDLWKEFTTSNSARKVVELKAFNKFENTSDALSAATLIIDSKPTKGLRKFLQKHCDGETLAVADSKLGNAIKEKLKIDCVHNSAVMELMRGLRNQLSELISGLGTQDLGPMSLGLSHSLSRYKLKFSPEKVDTMIIQAIGLLDDLDKELNTYAMRVREWYGWHFPELTKIVTDNIQYAKVVKLMGNRTNAVNLDFSEILTDDEVEAQLKEAAVISMGTEVNDLDLSNIRELCDQVLALSEYRSQLYDYLKSRMNTIAPNLTALVGELVGARLISHGGSLVNLAKQPGSTIQILGAEKALFRALKTKHATPKYGLIYHASLIGQAAPKHKGKISRSLASKAALAIRYDALGDGEHNSLGVESRLKLETWLRVLEGKELGRSAGSTKGKPKIEVYEKDRKNGPGLIAPAKTYNPSADLVLAQSMEETPKKPDAASKKRKHDDAVTAPSTELAEEAIQEDGDQEGKKKKKKKSKDVEESPAVDTKSDKKKKRKSKGTEEEVAPVETESGKNDKKKKKRQAD

SEQ ID NO: 5268 - protein, 172 aa, Saccharum officinarum
MCVEGLDDAAGRLGFGDQEIDRRAGAAMERVCENTVSVEFKQTKLNTFVPFIRSGEWSDIGSRDYMEDAHVCISDLAKNFGYNSVDDEVISFYGVFDGHNGKDAAHYVRDNLPRVIVEDADCALELEKVIKRSFVQTDSKFAEKSLITRDFLLNNSTYSNDFWKVPSGGQCR

SEQ ID NO: 5269 - protein, 354 aa, Zea mays
MCVEGLDDAAGRLGFGDQDTDRRAGDAMERVCENTVAVDFKQTKLNNFVPFIRSGEWSDIGGRDYMEDAHVCISDLAKNFGYDSVEDEVISFYGVFDGHNGKDAAHYVRDNLPRVIVEDADFPLELEKVVKRSFVQTDSKFAEKFSHHRGLSSGTTALTAMIFGRSLLVANAGDCRAVLSRRGTAIEMSKDHRPCCMNERKRVESLGGYVDDGYLNGQLAVTRALGDWHLDGMKEVGEPGGPLSAEPELKMVTLTKDDEFLIIGSDGIWDFFSSQNAVDFARRRLQDHNDLRLCCREMVDEAVRRGASDNLTAVMVSFHPDAPPPSRANKRTGRVTRSISAEGLHSLRVLLEGQ

SEQ ID NO: 5270 - protein, 355 aa, Pennisetum glaucum
MCVEEGLEDDAGRLGFGDRDVDNRHADSAMDRVCENTVSVDFKQTKLNNFVPYIRSGEWSDIGGRDYMEDAHVCISDLAKNFGYKAVDDEVISFYGVFDGHGGKDAAHYVRDNLPRVIVEDADFPLELEKVVKRSFVETDSKFAETFSQHKGLSSGTTALTAMIFGRSLLVANAGDCRAVLSRRGTAIEMSKDHRPCCINERKRVESLGGYVDDGYLNGQLAVTRALGDWHLDGMKEMGEPGGPLSAEPELKMITLTKDDEFLIIGSDGIWDFFSNQNAVDFARRKLQDHNDLRLCCREIVDEAIRRGARDNLTAVMVSFHQEAPPQTRVNRTGRVARSISAEGLHNLRVLLSGQ

SEQ ID NO: 5271 - protein, 345 aa, Panicum virgatum
MCVEGLEDAGRLDQDIDKHAGFAMERVCENTVSVDFKQNFVPFILSGEWSDIGGRDYMEDAHVCISDLAKNFGYKAADDEVISFYGVFDGHGGKDAAHYVRDNLPRIIVEDADFPLELEKVVKRSFVQTDSKFAETFSHHKGLSSGTTALTAMIFGRSLLVANAGDCRAVLSRRGTAIEMSKDHRPCCINERKRVESLGGYVDDGYLNGQLAVTRALGDWHLDGMKEMGEPGGPLSAEPELKMITLTKDDEFLIIGSDGIWDFFSNQNAVDFARRKLQDHNDLRLCCREIVDEAIRRGASDNLTAVMVSFHQEAPPQTRVSRTGRVARSISAEGLHNLRVLLEGQ

SEQ ID NO: 5272 - protein, 346 aa, Panicum virgatum
MCVEGLEDAGRLDQDIDKHAGFAMERVCENTVSVDFKQNFVPFIRSGEWSDIGGRDYMEDAHVCISDMAKNFGYKAADDEVISFYGVFDGHGGKDAAHYVRDNLPRIIVEDADFPLELEKVVKRSFVETDSKFAETFSHHKGLSSGTTALTAMIFGRSLLVANAGDCRAVLSRRGTAIEMSKDHRPCCINERKRVESLGGYVDDGYLNGQLAVTRALGDWHLDGMKEMGEPGGPLSAEPELKMITLTKDDEFLIIGSDGIWDFFSNQNAVDFARRKLQQDHNDLRLCCREIVDEAIRRGASDNLTAVMVSFHQEAPPQTRVNRTGRVARSISAEGLHNLRVLLEGQ

SEQ ID NO: 5273 - protein, 354 aa, Oryza sativa
MCVEELEGAERLDFGGVAELETTPADFEMEKVCENTVSLDFKQARSSSFVPVIRSGDWSDIGGRDYMEDAHVCISDLANNFGHNSVDDEIISFYGVFDGHGGKDAAHYVRDNLPRVIVEDADFPLELEKVVRRSFVQTDSQFAERCSHQNALSSGTTALTAMIFGRSLLVANAGDCRAVLSRRGTAIEMSKDHRTCCLNERKRIESLGGYVDDGYLNGQLAVTRALGDWHLEGLKEVGEPGGPLSAEPELKMITLTKEDEFLIIGSDGIWDFFSNQNAVDFTRKRLQEHNDLRLCCKQIVEEAIRRGASDNLTAVMVSFHQEAPPQLRVNRTGRVERSISAEGLHSLRVLLEGQ

SEQ ID NO: 5274 - protein, 272 aa, Zea mays
MCVEGLDDAAGTLAFGDHENDRRDGAAMERVCENNFVPFIRSGEWSDIGGRDYMEDAHVCISDLAKNFGSNSVDDEVISFYGVFDGHNGKDAAHYVRDNLPRVIVEDADFPLELEKVVKRSFVQTDSKFAEKFSHHKGLCSGTTALTAMIFGRSLLVANAGDCRAVLSRRGTAIEMSKDHRPCCMNERKRVESLGGYVDDGYLNGQLAVTRALGDWHLEVMKGTGRAGGGGAGGGPLSAEPELKMVTLSKDDEFLIIGSDGVWDSFSSQNAV

SEQ ID NO: 5275 - protein, 352 aa, Triticum aestivum
MCVEGFEDAQIERPADFAMERVCENTVSIDFKQTKMVAGIGESWHNFVPAIRSGDWSDIGGRDYMEDAHVCIPNLAKNFGYNMVDDEVISFYGVFDGHGGKDAAQYVRDNLPRVIVEDAAFPLELEKAVRRSFVQTDSQFAEKCSVQDGLSSGTTALTAMIFGRSLLVANAGDCRAVLSRRGAAIEMSKDHRACCLNERKRVESLGGYVDDGYLNGQLAVTRALGDWHLDGLKEMGEPGGPLSAEPELKMITLTKDDEFLIIGSDGIWDYFSNQNSVDFARRRLQDHNDLRRCCKEIVEEAIRRGATDNLTAVMVSFHQEAPPQIRVNRTGRVERSISAEGLHSLRVLLEGQ

SEQ ID NO: 5276 - protein, 352 aa, Triticum aestivum
MCVEGFEDAQIERPADFAMERVCENTVSIDFKQAKMVAGIEESWHNFVPAIRSGDWSDIGGRDYMEDAHVCIPNLAKNFGYNMVDDEVISFYGVFDGHGGKDAAQYVRDNLPRVIVEDAAFPLELEKAVRRSFVQTDSQFAEKCSVQDGLSSGTTALTAMIFGRSLLVANAGDCRAVLSRRGAAIEMSKDHRACCLNERKRVESLGGYVDDGYLNGQLAVTRALGDWHLDGLKEMGEPGGPLSAEPELKMITLTKDDEFLIIGSDGIWDYFSNQNSVDFARRRLQDHNDLRRCCKEIVEEAIRRGATDNLTAVMVSFHQEAPPQIRVNRTGRVERSISAEGLHSLRVLLEGQ

SEQ ID NO: 5277 - protein, 352 aa, Triticum aestivum
MCVEGFEDAQIERPADFAMERVCENTVSIDFKQAKMVAGIEESWHNFVPAIRSGDWSDIGGRDYMEDAHVCIPNLAKNFGYNMVDDEVISFYGVFDGHGGKDAAQYVRDNLPRVIVEDAAFPLELEKAVRRSFVQTDSQFAEKCSLQDGLSSGTTALTAMIFGRSLLVANAGDCRAVLSRRGAAIEMSKDHRTCCLNERKRVESLGGYVDDGYLNGQLAVTRALGDWHLDGLKEIGEPGGPLSAEPELKMITLTKDDEFLIIGSDGIWDYFSNQNSVDFARRRLQEHNDLRRCCKEIVEEAIRRGATDNLTAVMVSFHQEAPPQIRVNRAGRVERSISAEGLHSLRVLLEGQ

SEQ ID NO: 5278 - protein, 352 aa, Pseudoroegneria spicata
  misc_feature (91)..(91): Xaa can be any naturally occurring amino acid
  misc_feature (224)..(224): Xaa can be any naturally occurring amino acid
  misc_feature (280)..(280): Xaa can be any naturally occurring amino acid
MCVEGFEDAQIERPADFAMERVCENTVSIDFKQAKMVAGIGESWHNFVPAIRSGDWSDIGGRDYMEDTHVCIPNLAKNFGYNTVDDEVISXYGVFDGHGGKDAAQYVRDNLPRVIVEDAAFPLELEKAVRRSFVQTDSQFAEKCSLQDGLSSGTTALTAMIFGRTLLVANAGDCRAVLSRRGAAIEMSKDHRTCCLNERKRVESLGGYVDDGYLNGQLAVTRAXGDWHLDGLKEMGEPGGPLSAEPELKMITLTKDDEFLIIGSDGIWDFFSNQNSVDFXRRRLQEHNDLRRCCKEIVEEAIRRGASDNLTAVMVSFHQEAPPQIRVNRTGRVERSISAEGLHSLRVLLEGQ

SEQ ID NO: 5279 - protein, 352 aa, Hordeum vulgare
MCVEGFEDAQIERPADFVMERVCENTVSIDFKQTTMVTVIGESWHNFVPTIRSGDWSDIGGRDYMEDAHVCIPNLAKNFGFNMVDDEVISFYGVFDGHGGKDAAQYVRDNLPRVIVEDAAFPLELEKAVRRSFVQTDSQFAEKCSLHDGLSSGTTALTAMIFGRSLLVANAGDCRAVLSRRGAAIEMSKDHRACCLNERKRVESLGGYVDDGYLNGQLAVTRALGDWHLDGLKEMGEPGGPLSAEPELKMITLTKDDEFLIIGSDGIWDFFSNQNSVDFARRRLQEHNDLRRCCKEIVEEAIRRGATDNLTAVMVAFHQEAPPQIRVSRMGRVERSISAEGLHSLRVLLEGQ

SEQ ID NO: 5280 - protein, 360 aa, Brachypodium distachyon
MCVEGFEDAERLDFGAAEIERPADFLMERVCENMVSLDFKQTKMVSGTGESWHNFVPAIRSGEWSDIGGRDYMEDAHVCISNLVKNFGCNKADDEIISFYGVFDGHGGKDAAHYVRDNLPRIIVEDADFPLELEKVVRRSFVQTDSQFAEKCSRHDALSSGTTALTAMIFGRSLLVANAGDCRAVLSRRGAAIEMSKDHRTCCLNERKRVESLGGYVDDGYLNGQLAVTRALGDWHLDGLKEMGEPGGPLSAEPELKMITLTKEDEFLLIGSDGIWDYFSNQNSVDFARRRLQEHNDLRLCCKEIIEEAIRRGATDNLTAVMVSFHQEAPPQIRVNRTGRVERTISAEGLHSLRVLLEGK

SEQ ID NO: 5281 - protein, 352 aa, Triticum aestivum
MCVEGFEDAQIERPADFAMERVCENTVSIDFKQAKMVTAMGESWHNFVPAIRSGDWSDIGGRDYMEDAHVCIPNLAKNFGYNMVDDEVISFYGVFDGHGGKDAAQYVRDNLPRVIVEDAAFPLELEKAVRRSFMQTDSQFAEKCSLQDGLSSGTTALTAMIFGRTLLVANAGDCRAVLSRRGATIEMSKDHRTCCLNERKRVESLGGYVDDGYLNGQLAVTRALGDWHLDGLKEMGKPGGPLSAEPELKMITLTKDDEFLIIGSDGIWDYFSNQNSVDFARRRLQEHNDLRRCCKEIVEEAIRRGATDNLTAVMVSFHQEAPPQIRVNRAGRVERSISAEGLHSLRVLLEGQ

SEQ ID NO: 5282 - protein, 176 aa, Saccharum officinarum
MRPLPQTVHLLPVAFVLALIGCLVGGASATVVTTCRAAADSDARVDYGFCVAELGMHRESPDADTWGLAKVAALTGVNNADNAVYDIKALLAMRPGGADGPTRAALEKCGKLYDSVGFAFAEADDEINNRRYAAGKGKVAEAVSLARQCDDALAKAAAVPSPLAQHNSYNVRIANI

SEQ ID NO: 5283 - protein, 181 aa, Zea mays
MAPLPQAVHLLLAFALALGCLAGGATATVVTTCRAAADSDARVDYAFCVAELGMHRESPDADTWGLAKVAALTGVNNADNAVYDIKALLANKRPDGPTRAALEKCGRLYGSVGFAFAEADDEINNRRYAAGKAKVAEAVSLARQCDDALAVAAAVPSPLAQHSSYNVRIADICIAITNLIK

SEQ ID NO: 5284 - protein, 238 aa, Zea mays
MASSCQNVEIPGKPTETGTALLETATGTIQGFAPLSQIHQHLCAFHFYADDMGRQVEAHHFCAHLNEDVRQCLIFDGPGAGARLIGVEYIVSETVFLTLPDAEKPLWHTHEFEVKGGVLFMPGVPGVVERRDLEKVCKTYGKTIHFWQVDRGDALPLGLPQIMMVLTREGQLRQDLADCVEKKFGVSFQKERENRAYMSGPEHGIHPLANATGKGLRTEIREVDLPASTTAGAGRVFT

SEQ ID NO: 5285 - protein, 238 aa, Panicum virgatum
MASSCHEVEVPGKPTETGTALLETATGTIQGFAPLGQIHQHLCAFHFYADDMGRQVEAHHFCAHLNEDVRQCLIFDGPGAGACLIGVEYFVSEPVFLTLPDEEKPLWHSHEFEVKGGVLFMPGVPGAVERRDLEKVCRTYGKTVHFWQVDRGDPLPLGLPQIMMALTREGQLRQDLADCVEKKFGVSFQKERENRAYMSGPEHGIHPLANAAGKGLRTEIREVDIPAATTAGAARVFT

SEQ ID NO: 5286 - protein, 210 aa, Setaria italica
MAESCHDVEVPGKPTEVGTALLETATGTIQGFAPVNQIHQHLCAFHFYADDMSRQVEAHHFCAHLNEDVRQCLVFDGPGAGARLIGVEYIVSEPVFLTLPDTEKPLWHTHEFEVKGGVLFMPGVPGVVERRDLEKVCRTYGKTVHFWQVDRGDALPLGLPQIMMALTREGQLRQDLGGEEVRRVVPEGEGEPGVHERAGARNPPAGERRR

SEQ ID NO: 5287 - protein, 236 aa, Triticum aestivum
MAASCHDVDVPGKPTETGTALLETATGAIQGFAPINQIHQHLCAFHFYGDDMTRQVEAHHFCAHLNEDVRQCLIFDGPEAGARLIGLEYIVTEELFLTLPDEEKPLWHTHEFEVKGGVLFMPGVPGVVERRDLEQVAKTYGKTVHFWQVDRGDALPLGLPQIMMALTREGQLRQDLADCVEKKFSVSFQKERENRAYMSGPAHGIHPLANAAGKGLKTEIREVDLPAANTGARIFT

SEQ ID NO: 5288 - protein, 236 aa, Triticum aestivum
MAASCHDVDVPGKPTETGTALLETATGAIQGFAPINQIHQHLCAFHFYGDDMTRQVEAHHFCAHLNEDVRQCLIFDGPEAGARLIGLEYIVTEELFLTLPDEEKPLWHTHEFEVKGGVLFMPGVPGVVERRDLEQVARTYGKTVHFWQVDRGDALPLGLPQIMMALTREGQLRQDLADCVEKKFSVSFQKERENRAYMSGPAHGIHPLANAAGKGLKTEIREVDLPAANTGARIFT

SEQ ID NO: 5289 - protein, 236 aa, Triticum aestivum
MAASCHDVDVPGKPTETGTALLEAATGAIQGFAPINQIHQHLCAFHFYGDDMTRQVEAHHFCAHLNEDVRQCLVFDGPDAGARLIGVEYIVTEELFLTLPDEEKPLWHTHEFEVKGGMLFMPGVPGVVERRDLEQVAKTYGKTVHFWQVDRGDALPLGLPQIMMALTREGQLRQDLADCVEKKFSVSFQKERENRAYMSGPAHGIHPLANAAGKGLKTEIREVDLPAANTGARIFT

SEQ ID NO: 5290 - protein, 236 aa, Brachypodium distachyon
MAASCHDVDVPGKPTETGTALLETATGAIQGFAPINQIHQHLCAFHFYGDDMTRQVEAHHFCAHLNEDMRQCLIFDGPDAGARLIGLEYIVSEELFLTLPDEEKPLWHTHEFEVKSGVLFMPGVPGVVERRDLEKVAKTYGKTIHFWQVDRGDALPLGVPQIMMALTRDGQLRQDLADCVEKKYGVSFQKERENRAYMSGPAHGIHPLANAAGKGLKTDIREVDLPTAIAGARIFT

SEQ ID NO: 5291 - protein, 236 aa, Pseudoroegneria spicata
MAASCHDVDVPGKPTETGTALLETATGAIQGFAPINQIHQHLCAFHFYGDDMTRQVEAHHFCAHLNEDVRQCLIFDGPDAGARLIGLEYIVTEELFLTLPDEEKPLWHTHEFEVRGGVLFMPGVPGVVERRDLEVVARTYGKTVHFWQVDRGDALPLGLPQIMMALTREGQLRQDLADCVEKKYGVSFQKERENRAYMSGPAHGIHPLANAAGKGLKTEIREVDLPAANTGARIFT

SEQ ID NO: 5292 - protein, 236 aa, Triticum aestivum
MAASCHDVDVPGKPTETGTALLETATGAIQGFAPINQIHQHLCAFHFYGDDMTRQVEAHHFCAHLNEDVRQCLIFDGPEAGARLIGLEYIVTGELFLTLPDEEKPLWHTHEFEVKGGVLFMPGVPGVVERRDLEVVARTYGKTVHFWQVDRGDALPLGLPQIMMALTREGQLRQDLADCVEKKFSVSFHKERENRAYMSGPAHGIHPLANAAGKGLKTEIREVDLPAANTGARIFT

SEQ ID NO: 5293 - protein, 236 aa, Hordeum vulgare
MAASCHDVDVPGKATETGTALLETATGAIQGFGPINQIHQHLCAFHFYGDDMTRQVEAHHFCAHLNEDVRQCLIFDGPDAGARLIGLEYIVTEELFLTLPDEEKPLWHTHEFEVRGGVLFMPGVPGVVERRDLEKVARTYGKTVHFWQVDRGDALPLGVPQIMMALTREGQLRQDLADCVERKFGVSFEKERENRAYMSGPAHGIHPLANAAGKGLRTEIREVDLPAANTGARIFT

SEQ ID NO: 5294 - protein, 238 aa, Oryza sativa
MAASCHEVEVPGKPTETGTALLEAATGSIQGFGPVNQIHQHLCAFHFYADDMTRQVEAHHFCAHLNEDMRQCLIFDGPDAGARLIGVEYIVAEPLFLTLPDDEKPLWHTHEFEVKGGVLFMPGVPGVVERRDLERVCKTYGKTIHFWQVDRGDALPLGLPQIMMALTRDGQLRQELAKCVEEKFSVSFDKERENRAYMSGPDHGIHPLANAAGKGLKTDLREVDLPAMTTAHAGRVFT

SEQ ID NO: 5295 - protein, 237 aa, Avena sativa
MAAPCHDVDPVPGNPTETGTSLLETATGAIQGFAPISQIHQHLCAFHFYGDDMTRQVEAHHFCAHLSEDMRQCLIFDGPEAGARLIGLEYIVTEELFLTLPDDEKPLWHSHEFEVKGGVLFMPGVPGVVERRDLEKVAKTYGKTIHFWQVDRGDALPLGLPQIMMALTRDGQLRQDLAECVEKKFGVSFQKEKENRAYMSGAAHGIHPLANAAGKGLKTGIREVDLKDAGTRHRVFT

SEQ ID NO: 5296 - protein, 223 aa, Hordeum vulgare
MAASCHDVDVPGKATETGTALLETATGAIQGFGPINQIHQHLCAFHFYGDDMTRQVEAHHFCAHLNEDVRQCLIFDGPDAGARLIGLEYIVTEELFLTLPDEEKPLWHTHEFEVRGGVLFMPGVPGVVERRDLEKVARTYGKTVHFWQVDRGDALPLGVPQIMMALTREGQLRQDLADCVERKFGVSFEKERENRAYMNGPAPGIHPLANAAGQGLEDGDPKS

SEQ ID NO: 5297 - protein, 295 aa, Saccharum officinarum
MEDERNTQQHQGCEAQENAGADQVEVKDRGLLDSLLGRKKHEDQEKKQEEELATGMEKVTVAEPEKHEHKKEEHEAAGEKKESLLAKLHRTSSSSSSSSDEEEEVIDENGEIVKRKKKKGLKEKIKEKLPGHHKDHEADHHTAVPAPAAAPAPVVETHAHHQEEEHKPHFAAPAPPPHVETHVHQHDHGVVVQKVEDDVKTETPPAPEEEKKGLLDKIKEKLPGGHKKPEDASAAAAPAVVHAPAPAPHTEDVSSPDGKEKKGLLGKIMDKIPGYHKSSGEDDHKDAAGEHKTSS

SEQ ID NO: 5298 - protein, 282 aa, Panicum virgatum
MEDERNTQHHQVGEAQEKAADQVEVKDRGLLDTLLGRKKPEEHQEEELVTGMEKVTVAEPQKHGEHKEEHETGEKKESLLAKLHRTSSSSSSSSDEEEEVIDENGEIVKRKKKKGLKEKIKEKLPGHKDHAEGDHHTAVPAPAPAPVGTHAYKEDEHKPYVPAPAPPPAVETHVHHHDHAVVVQKVEDDSPPAPEEEKKGLLDKIKEKLPGGHKKPEDAAAAAAPAVHAPAPAPHAEDVSSPDGKEKKGLLGKIMDKIPGYNKGSGEEDHKAAAGEHKTSSF

SEQ ID NO: 5299 - protein, 290 aa, Setaria italica
MEDERNTQLHHQGGEAQEKAADQVEVKDRGILDTLLGRKKPEDQEKKQEEELVTGMEKVTVAEPEKHEHKKEEHEAGEKKESLLAKLHRTSSSSSSSSDEEEEVIDENGEIVKRKKKKGLKEKIKEKLPGHKDHAEGEHHTAVPAPAPAPVETHAYKEDDHKPYVPAPAPPPVETHVHHHDHAVVVQKIEDDAKTDAPPAPEEEKKGLLDKIKEKLPGGHKKPEDAAGAPAVHAPAPTPHTEDVSSPDGKEKKGLLGKIMDKIPGYNKGSGEEDHKAAGAAAGEHKTTSS

SEQ ID NO: 5300 - protein, 177 aa, Pennisetum glaucum
MTEMFDAAVTSLLHLPEVLDRLAAADGDRRSGGQHGAHHHHHGHARVHGLGGGSGGAPVDIMETPGEYTFVLDVPGLSKSDIQVTLEEEDRVLVMKGGSNGGKRKREEEEEEEREGCRYIRLERRASPRSFVRKFRLPEDADAGGVAARCENGVLTVTVKKQPPPEKKTKSVQVTIA

SEQ ID NO: 5301 - protein, 326 aa, Saccharum officinarum
MWNPKPLLLVISLCILALSSSLCTAARGGGKPLVTAVTKDASTSLYTAPLKDGHPLLLDLSSPVISLTTCSSKNGTVTTLSANATDGQNPLFPVSFSAVASCTPQAKVPAGAVGVAGLAPSSQSFPAQVARTQKVANKITLCLPSDGKSTTGNSVGVAIFGGGPLVFPDRGDFTTMLAGTAPLRGFNGSPGYYVSATGIAVEQSRVGTSGGPLVVALSSTTPYTSLRPDVYGPFVRAFDAAATGPNFPWMSRVTAVAPFERCYDSTKLPPTRLGYAVPQIDVMLKGGQNYSVLGGNSMVQVNGNTGCLGSSGGGAEAPRAASGVST

SEQ ID NO: 5302 - protein, 360 aa, Setaria italica
MWNPKPLLLVISLCISALSPCTAATGGKPLVTAVTKDAATSLYTAPLKDGRPLVLDLSGPVISLTTCSSKNGTVTTLSSNATNGANPLFPVSFSAVASCAPGQPNLPAGAVGVAGLAPSTQSFLAQVARTQKVANKLALCLPSDGKITTGNSVGVAIYGGGPLIFPDRGDFTTMLAGTAPLVGFNGSPGYFISATGIAVEQSLAGNPGTLVVGLSTTAPYTALRPDVYDPFMKAFDQAATGSNFPWMTRVASVAPFERCYDSTKLPPTRLGYAVPQIEFVLKSGSNYSVVGGNSMVQVNVNTACLGFVKASGQAPAAIIGGFQMENRLLVLDAEKKTLGFTTFLNGVGLSCSNFNFTLAA

SEQ ID NO: 5303 - protein, 359 aa, Panicum virgatum
MWSSKPFLLAISLCISALSTCTAAGGGKPLVSAVTKDASTSLYTAPLKDGRPLVLDLSGPVISLTTCSSKNGTVTTLSANATDGANPLFPVSFRAAASCGTPPKLPAGAIGVAGLGPSSQSFLAQVARTQKVANKLALCLPSDGKTTSGNSVGVAIFGGGPLIFPDRGDFTTMLAGTAPLRGFNGSPGYYVTATGIAVEQTRIGVSGPLVVGLSSTAPYTALRPDVYAALVRAFDQAATGPNFPWMSRVAAVAPFERCYDSTKLPPTRLGYAVPQIDLNLEGGSTYFLTGGNSMVQVSANTACLGFVRAAGQAPAAVLGGFQMENRLLVLDVEKKQLGFTTFLNAVGLSCSNFNFTLAA

SEQ ID NO: 5304 - protein, 359 aa, Panicum virgatum
MWSPKPFLLLVSLCISALSTCTAAGGGKPLVSAVTKDASTSLYTAPLKDGRPLVLDLSGPVITLTTCSSKNGTVTTLSANATDGANPLFPVSFHAAASCGAPPKLPAGAVGVAGLGPSSQSFLAQVARTQKVANKLALCLPSDGKTTSGNSVGVAIFGGGPLIFPDRGDFTTMLAGTAPLRGFSGSPGYYVTATGIAVEQTRIGVTGPLVVGLSSTAPYTALRPDVYAALVRAFDQAATGPNFPWMSRVAAVAPFERCYDSTKLPPTRSGYAVPQIDLVLEGGSTYFVTGGNSMVQVSANTACLGFVRAAGQAPAAVLGGFQMENRLLVLDVEKKQLGFTTFLNGVGLSCSNFNFTLAA

SEQ ID NO: 5305 - protein, 363 aa, Zea mays
MARAPLLLALLCACAAAAGSANAAGRKMVGVYELKAGDFSVGVTNWGATITSVVLPDSKGDFADVVLGYDTIGGYVSGKSYFGALVGRVANRIANARFVLDGKAYHLFKNDGNNTLHGGHRGFSQVVWTVKEFVGGGDSPYITLYYHSFDGEQGFPGDLDVYVTYQLAAPYVLRVHMNATAVNKATPVNLAQHTYWNLGGQGSGDVLRNTVQLFASRYTPVGGGLIPTGAVAPVAGTPYDFLAPAAVGSRIRQVSGGKAGVYGYDTNYAVDGEPGALRKVAVVRDGASGRALELWANQPGVQFYTGNFLQDVKGKGGKVYQQYGALCLETQGFPDAVNHPNFPSQIVRPGQVYKHDMVFKFSF

SEQ ID NO: 5306 - protein, 368 aa, Setaria italica
MARAPAPLLLLALLAALAAAAGANAAGRKMVGVYELRKGDFSVKVTNWGATLTSVVLPDCKGNLADVVLGYDTIADYVNGSNYFGALVGRVANRVANARFVLDGKVYHLVPNDGKNALHGGKRGFSKVIWTVKDYVGGGDSPYITLYYHSFDGEEGFPGDLDVYVTYRLLGRYELSLHMNATALDKATPVNLANHAYWNLAGQGRGDILGHTVQLFASRYTPVDGALIPTGAVVPVAGTPYDLRAPTPVGAHVRAIYGGKAGIYGYDTNYAVDGGAGAAALRKVAVVRDGGGSGRAMELWANQPGVQFYTGNFLKDVKGKGGKVYGQYGALCLETQGFPDAVNHPNFPSQIVRPGQVYRHDMVFKFSF

SEQ ID NO: 5307 - protein, 791 aa, Zea mays
PKPNPRLRLRCTAVPHLNPSPPAPPNPAMSSSPPRRPQRRAASSRPASYDESLLDAELQAYLGDAASRRVRRLRRLSAEERQRETETEALIALSLGFPIDELLPEERPLLPAHIADAPNDYIVVRNHILASWRADPGAPLPLARVLETVSATYDRLVAAAHGYLAREGHINFGVSAAFPAAPPPDAASQGAASVLVVGAGLAGLAAARQLVRFGLRVLVLEGRARPGGRVYTARLGEDKAAVELGGSVITGIHANPLGVLARQLALPLHKVRDRCPLYYPDGRTVETRLDRSIDLVFNTLLDHATRLRESLNEAAERISLGEAIDKLRRLYHVARSDDERMLLDWHFANLEFSNAGCLWELSLAHWDQDDPYEMGGDHCFLAGGNSRLIHALCDGVPVLYEKNVTRIEHGVDGVSVTVEEGQIFQADMVLCTVPLGVLKSGSIVFDPELPEEKLGAIKRLGFGLLNKVAMVFPSVFWDEDIDTFGCLNKESSKRGEFFLFYSYHTVSGGAVLVALVAGEAALEFEKVDPVVALHRVLGILKGIYGPKGVTVPDPVQSVCTRWGSDPFCSGSYSHIRVGSSGADYDILSESVNDRLFFAGEATNRAYPATMHGALLSGLREASKIYRASDSLVNYDQKKNSLPKSLKPPDGALLDLFLEPDLAFGRFSFVFSSLTPDDPAAPGLLRVSLDKRFLLQPNYNSELKGDQKDHSHSHASGAFHLYAAVSREQADRLRRSSEDDRTRLGVLCKDRTVKLMGYDSTCDVGSDLISSILGARKARKLLQHPKNSKIPR

SEQ ID NO: 5308 - protein, 199 aa, Saccharum officinarum
MATLTMQPIGPTPAPAAQEDQRKGENPPTADGTDLSDIESGWVILKNSDIVSADLAAAAVSGGQRLGSSTIPSWARWVVGGVVYTVVPFYNRVRHLEDETVGFVENAVEVVEHIAEVTEKLAANVAKQLPEDGSLQKAVEEVEHIAEVVDDDAEKFEAVAEKIDKVSDEIDAAVEPVIEELEKELDQSTTSDDGVNTKN

SEQ ID NO: 5309 - protein, 199 aa, Zea mays
MATLTMQPIGPTPAPAAQQDPSKGENPPTVDGTDLGDIDSGWVILKNSDVVSADLAAAAVCGGQRLGSSTIPSWARWVLGGVVYTLVPFYNRVRHLEDETVGFVENAVEVVEHLAEVTEKLAANVAKQLPEDGSLQKAVEEVEHIAEVVDDDAEKVEAVTEKIDKVSDEIDAAVEPVIAELEKELDQSTTSDDGVDTKN

SEQ ID NO: 5310 - protein, 198 aa, Setaria italica
MATLTMQPIGPSPAPAAQEDQRKGENPAADAADLSDIDSGWVVLKNSDIVSADLAAAAISGGQRLGSSAIPSWARWVLGGVVYTVVPFYNRVRQLEEETVGFVENTVEVVEHVAEVTEKLAANVAKQLPKDGSLQKAVEEVEHIAEVVDTDAEKVEAVTEKIDKVSDEIDAAVEPVIKELEKELDQGTTSDNGVNAQK

SEQ ID NO: 5311 - protein, 198 aa, Panicum virgatum
MATLTMQPIGPSPAPAAQEDQRKAENPAVDAADLSDIDSGWVVLKNSDIVSADLAAAAVSGGQRLGSSTIPSWVRWVIGGVVYTVVPFYNRVRQLEEETVEFVENSVEVVEHVAEATEKLAANVAKQLPEDGSLQKAVEEVEHIAEVVDADAEKVEAVAEKIDKVSDEIDAAVEPVIEELENELDQGATSDSGVNAQK

SEQ ID NO: 5312 - protein, 198 aa, Panicum virgatum
MATLTMQPIGASPAPAAQEDQRKAENPAVDAADLSDIDSGWVVLKNSDIVSADLAAAAVSGGQRLGSSTIPSWVRWVVGGVVYTVVPFYNRVRQLEEETVEFVENSVEVVEHLAEATEKLAANVAKQLPEDGSLQTAVEEIEHIAEVVDADAEKVEAVTEKIDKVSDEIDAAVEPVIEELENELDQGATSDNGVNAQN

SEQ ID NO: 5313 - protein, 394 aa, Sorghum bicolor
MMMMGEGAYAPPWQQSPAASMDADEAASPYALLAALQHYLPSNEVSAAAAPYDEDDEEAALAAGVDAYACDEFRMYEFKVRRCSRGRSHDWTDCPYAHPGEKARRRDPRRYHYSGAACPDFRKGGCKRGDACEYAHGVFECWLHPSRYRTQPCKDGTGCRRRVCFFAHTPDQLRVLPQQQQSSPRGASAASPLAESYDGSPLRRQAFESYLTKSGMIMSSSPTSTLVSPPRSPPSESSPPMSPDALRRGSWPGVGSPVNEVLASLRQLRLGAGGGSPRSAPSSGSSFGGGYPFGSPKSPAAGLYSLPSTPTCRPSPVTVTTASGATIMTVDRLNLGLIGDEEEPVMERVESGRALREKVFERLSKEATVPNDTAASANVEGAAPDVGWVSDLIN

SEQ ID NO: 5314 - protein, 402 aa, Saccharum officinarum
MMMMGEGAHAPPWQQSPAAAISGGSMDADEAASPYALLSALQHYLPSNEVAAAAYDEDDEEAAALAAVDAYACDEFRMYEFKVRRCLRGRSHDWTDCPYAHPGEKARRRDPRRYHYSGAACPDFRKGGCKRGDACELAHGVFECWLHPSRYRTQPCKDGTGCRRRVCFFAHTPDQLRVLPPPQQPSASPRGAAAAASPLAESYDGSPLRRQAFESYLTKSGMIMSSSPTSTLVSPPRSPPSESSPPMSPDALRRGSWPGVGGSPVNEVLASLRQLRLGGGGGSPRSAPSGGGSFLAGCGYPFGSPKSPAGLYSLPSTPTRPSPVTVTTASGATIMTVERLNLGLIGDEEPVMERVESGRALREKVFERLSKDATVPNDTAAASANVEGAAAPDVDWVSDLIN

SEQ ID NO: 5315 - protein, 393 aa, Zea mays
MMMMGERAHAPPWQRSPAASGVTDADDASPYALLAALQHYLPSNEVAAYDEDDEEAALAAATAAVDAYACDEFRMYEFKVRRCSRGRNHDWTACPYAHPGEKARRRDPRRYHYSGAACPDFRKGGCKRGDACEFAHGVFECWLHPSRYRTQPCKDGTGCRRRVCFFAHTPDQLRVPPPRQSSPRGAAAAASPLAESYDGSPLRRQAFESYLTKSGIVSSPPPTSTLVSPPRSPPSESPPMSPDAAAALRRGSWPGVGSPVNEVLASMRQLRLGGGSPRSAPSGGSFLGGGYPFGSPKSPAGLYSLPSTPTRPSPVTVTTASGATVLTVERLNLGLIGDEEPVMERVESGRALREKVFERLSKEAAVPSDTAASANVEGAAPAPDVGWVSDLIN

SEQ ID NO: 5316 - protein, 392 aa, Panicum virgatum
MMMMGEGAHAPPWQQQPPASAGMDGDDASPYSLLAALRHYLPSNEAAVAAYDEDDEEASLAAVDAYACDEFRMYEFKVRRCSRGRSHDWTDCPYAHPGEKARRRDPRRYHYSGTACPDFRKGGCKSGDACEFAHGVFECWLHPARYRTQPCKDGTACRRRVCFFAHTPDQLRVLPPQQSSSSPRGAAPSPLAESYDGSPLRRQAFESYLTKTGIMSSSPTSTLVSPPRSPPSESPPMSPDAAGALRRGSWPGVGSPVNEVLASLRQLRLGGGGSPRSAPSGGSFLAGYPFGSPKSPAALYSLPSPPTRPSPVTLTTPSGATVMTVERLNLGLIGDEEPVMERVESGRALREKVFERLSKEATVPNDTAAAANAEGAAPAAAPDVGWVSDLIN

SEQ ID NO: 5317 - protein, 398 aa, Panicum virgatum
MMMMGEGAHAPPWQQQQQPAASAGMVDGDDASPYSLLVALRHFLPSNEAAAAAYDEDDEEALAAVDAYACDEFRMYEFKVRRCSRGRSHDWTDCPYAHPGEKARRRDPRRYHYSGTACPDFRKGGCKRGDACEFAHGVFECWLHPSRYRTQPCKDGTACRRRVCFFAHTPDQLRVLPPQQSSASPRGAGAAPSPLAESYDGSPLRRQAFESYLTKTGIMSSSPTSTLVSPPRSPPSESPPMSPDAAAGALRRGSWPGVGSPVNEVLASLRQLRLGGGGSPRSAPSGGSFLAGYPFGSPKSPAALYSLPSTPTRPAPVTVTTPSGATVMTVERLNLGLIIGDEEPVMERVESGRALREMVFERLSKEATVPNDAAASANAEGAAPAAAPDVGWVSDLIN

SEQ ID NO: 5318 - protein, 476 aa, Zea mays
MARFILSLMELGVSATVHMLFGLYVFSTAVAADISQAAAASGCLLLRRPPPAAAGSTGGALVDVAAAGESDELRGAAPVILDASPPPIVLVHGIFGFGKGRLGGLSYFAGAEKKDDRVLVPDLGSLTSIHDRARELFYYLKGGQVDYGEEHSKACGHNRFGRIYHTGHYPVWDEHNPVHFVGHSAGAQVVRVLHQMLADKAFPGHDTSEDWVVSLTSLSGALNGTTRTYYDGMLVVDGRSMKSICLLQLCRLGVIVYDWLDIPWLKNYYNFGFDHYEMSWRKVGFSGLINLLLGHTGPFASGDWILPDLTIQGSMKLNSTLRTFPNTFYFSYATKKTRKIFGITVPSSVLGVHPILFLRVLQMCMWRHPQNAPLPYKGYRDEDWEDNDGALNTISMTHPRIPIEHPHHFVVDDSDCHPLQPGIWYYKIIEADHILFIVNRERAGVQFDLLYDGIFQRCRKHAFRKSPPTVPNETSR

SEQ ID NO: 5319 - protein, 475 aa, Setaria italica
MARFILSLMELGVSAAVHLIFGFYVFSTAVAADISQAAAASGCLLLRRPPPSAGAGEGALVDVAAAGERDERRGAGPVVLDGSPPPIVLVHGIFGFGKGRLGGLSYFAGAEKKDDRVLVPDLGSLTSIHDRACELFYYLKGGQVDYGEDHSKACGHTRFGRIYHTGHYPVWDDQNPVHFVGHSAGAQVVRVLHQMLADKAFPGHDTSEDWILSLTSLSGALNGTTRTYYDGMLVEDGRFMRSICLLQLCRLGVIVYDWLDIPWLKNYYNFGFDHYEMSRRKVGFSGLIDLLLGRTGPFASGDWILPDLTIQGSIKLNSSLRTFPNTFYFSYATKKTRKLFGITVPSSVLGVHPMLFLRVLQMCMWRHPQNAPLPYKGYRDEDWEDNDGALNTISMTYPRIPIEHPHRFVVDDSDCHPLQPGIWYYKIIEADHILFIVNRERAGVQFDLLYDGIFQRCRKHAFRKSLPTVPNETSQ

SEQ ID NO: 5320 - protein, 471 aa, Oryza sativa
MARFILSLLELGVSATVHLLFGLYVFSTAVAADISQAAAASGCLLLRRPAAPGLVNVAAAGEEEERRGAAPVVLDGSPPPIVLVHGIFGFGKGRLGGLSYFAGAEKKDDRVLVPDLGSLTSIHDRARELFYYLKGGQVDYGEEHSKVFGHTRFGRTYDTGHYPVWDEQNPVHFVGHSAGVQVVRVLHQMLADKAFPGHDTSEDWVLSLTSLSGALNGTTRTYYDGMLAEDGRSMKSICLLQLCRIGVIVYDWLDIPWLKNYYNFGFDHFEMSWRKVGLSGLIDLLLGHTGPFASGDWILPDLTIQGSLTLNSTLRTFPNTFYFSYATKRTRKLFGITVPSSVLGIHPMLFLRVLQMCMWRHPQNAPLPYKGYRDEDWEDNDGALNTISMTHPRIPTEHPNRLVVDDSDCHPLQPGIWYYKIIEADHILFIVNRERAGVQFDLLYDGIFQRCRKHAFRRSPPTVPNESSQSQ

SEQ ID NO: 5321 - protein, 472 aa, Avena sativa
MARFILSLVELGVSATVHLLFGFYVFSTAVAADISQAAAASGFPFLRRPATPGAAGLLDVAAAGEEEERRGDAPLVLDGSPPPIVLVHGIFGFGKGRLGGLSYFAGAEKKDDRVLVPDLGSLTSIHDRARELFYYLKGGQVDYGPEHSQVYGHTRFGRIYDTGHYPVWDEQNPVHFVGHSAGAQVVRVLHQMLADKAFPGHDTSEDWVLSLTSLSGALNGTTRTYFDGMLAEDGRSMRSICLLQLCRIGVIVYDWLDIPWLKNYYNFGFDHFEMSWRKVGFSGLVDLLLGNTGPFSSGDWILPDLTIQGSLRLNSTLRTFPNTFYFSYATKKTRKLFGITVPSSVLGVHPMLFLRVLQMCMWRYPQSAPLPYKGYRDEDWEDNDGALNTISMTHPRIPVEHPNRFVLDDSDCHPLQPGIWYYKIIEGDHILFIVNRERAGVQFDLLYDGIFQRCRKHAFRKSPPTMPNETSQ

SEQ ID NO: 5322 - protein, 470 aa, Brachypodium distachyon
MARFILGLVELGVSAAVHLLFGFYVFSSAVAADISQAASASGCLLLRRPPAAGALVDVAAKGEEEERRAAAPVVLDGSPPPIVLVHGIFGFGKGRLGGLSYFAGAEKKDDRVLVPDLGSLTSIHDRARELFYYLKGGLVDYGPEHSQVYGHTRFGRIYDTGHYPVWDEQNPLHFVGHSAGVQVVRVLHQMLADKAFPGHDTSEDWVLSLTSLSGALNGTTRTYYDGMLAEDGRSMKSICLLQLCRLGVIVYDWLDIPWLKNYYNFGFDHFEMSWRKVGFSGLVDLLLGHTGPFASGDWILPDLTIQGSLKINSTLRTFPNTFYFSYATKRTRKLFGITVPSSVLGVHPMLFLRVLQMCMWRHPQNAPLPYKGYRDEDWEDNDGALNTISMTHPRFPTEHPNRFVLDESDCHPLQPGIWYYKIIEGDHILFIINRERAGVQFDLLYDGIFQRCRKHAFRKNPPTVPNETSQ

SEQ ID NO: 5323 - protein, 469 aa, Triticum aestivum
MARFILGLVELGVSAAVHLLFGFYVFSTAVAADISQAAAASGCPLLRRPPPAAGLVDVAAAAAEEEDERRGVVLDGSPPPIVLVHGIFGFGKGRLGGMSYFAGAEKKDDRVLVPDLGSLTSIHDRARELFYYLKGGQVDYGVEHSQVYGHTRFGRIYETGHYPVWDEQNPVHFVGHSAGAQVVRVLHQMLAEKAFPGHDTSEDWVLSLTSLSGALNGTTRTYYDGMLAEDGRSMKSICLLQLCRLGVIVYDWLDIPWLKNYYNFGFDHFEMSWRKVGFSGLVDLLLGNTGPFSSGDWILPDLTIQGSLKINSTLKTFPNTFYFSYATKRTRKLFGITVPSSVLGVHPMLFLRVLQMCMWRHPQNAPLPYKGYRDEDWEDNDGALNTISMTHPRIPIEHPNRFVVDDSDCNPLQPGIWYHKIIEGDHILFIVNRERAGVQFDLLYDGIFERCRKHAFRKSPPTMPNEASQ

SEQ ID NO: 5324 - protein, 435 aa, Panicum virgatum
ASGSFLLRRPPPPPAAEGALVDVAAAGERDERTGAAPVVLDGSPPPIVLVHGIFGFGKGRLGGLSYFAGAEKKDDRVLVPDLGSLTSIHDRARELFYYLKGGQVDYGEDHSKACDHTQFGRIYPTGHYPVWDEQNPVHFVGHSAGAQVVRVLHQMLADKAFPGHDTSEDWILSLTSLSGALNGTTRTYYDGMLVEDGKSMRSICLLQLCRLGVIVYDWLDIPWLKNYYNFGFDHYEMSRRKVGFSGLIDLLLGHTGPFASGDWILPDLTIQGSIKLNSRLRTFPNTFYFSYATKKTRKLFGITVPSSVLGVHPMLFLRVLQMCMWRHPQNAPLPYKGYRDEDWEDNDGALNTISMTHPRIPIEHPHRFVVDDSDCHPLQPGIWYYKIIEADHILFIVNRERAGVQFDLLYDGIFQRCRKHAFRKSPPTVPNETSQ

SEQ ID NO: 5325 - protein, 343 aa, Zea mays
MAPPLLSPPLLADALATPPRSFLCSRPTRQLPTVGLAGAVRGDRGRWSVRRRDPRVFATSTEADRERSEEDVADDYYSVLGVMPDATPEEIKKAYYSCMKECHPDLSGDHPDVTNFCMFINEVYSVLSDPAQRAVYDEIHGYTATAINPFFDDSAPKDHVFVDEFTCIGCKNCANICPGVFQIEEDFGRSRVYSQSGSTELIQDAIDSCPVDCIHWTSAAQLSLLENEMRRVERVNVGLMLAGMGASINVFRMASARWEKRQAKVLEKARTRMVKQETSDTRSSWSEVWASSPPRDDQSNGDGEASERAKRAAAAARRWREFSRRGADRPPTHKLPEAVGNKD

SEQ ID NO: 5326 - protein, 342 aa, Panicum virgatum
MAPPLLSLPLLPDSLATLPRSFPCSRPTRQLATVGFAGAVRSDRQGSWSARRRGNLRIRATAAEADHERPEEDVAEDYYSVLGVMPDATPEEIKKAYYSCMKACHPDLSGDDPDVTNFCMFINEVYSVLSDPAQRAVYDEIHGYTATAINPFFDDSAPKDQVFVDEFTCIGCKNCANICPNVFQIEEDFGRSRVYSQSGSTELIQDAIDSCPVDCIHWTSAAQLSLLENEMRRVERVNVGLMLAGMGASVDVFRMASVRWEKRQAKVLEKVRTRMVNQENSDTGWSWSDVWGSPPRDQNNEEEASERTKRAAAAARRWREYSRRGADRPPTYKLPEAVGNKD

SEQ ID NO: 5327 - protein, 111 aa, Setaria italica
MAPPLLSPPLLAEPLVALPRSFPCSRPTPQLATVGFAGAVRSDRQGSWSARRRRDLRIRATATEADYERPEEDVADDYYSVLGVMPDATPEEIKKAYYSCMKATLVGTTLT

SEQ ID NO: 5328 - protein, 98 aa, Saccharum officinarum
MAAASRASLVLFLVVASAVLSLLAPGAGAATCAPTQLTPCAPAIVGNAAPTAACCARLKAHPASCFCQYKKNPNMQRYVNSPNAKKVFAACKVPLPKC

SEQ ID NO: 5329 - protein, 471 aa, Zea mays
MAPADGESSPPPHVAVVAFPFSSHAAVLLSIARALAAAAAPSGATLSFLSTASSLAQLRKASSASAGHGLPGNLRFVEVPDGAPAAEETVPVPRQMQLFMEAAEAGGVKAWLEAARAAAGGARVTCVVGDAFVWPAADAAASAGAPWVPVWTAASCALLAHVRTDALREDVGDQAANRVDEPLISHPGLASYRVRDLPDGVVSGDFNYVINLLVHRMGQCLPRSAAAVALNTFPGLDPPDVTAALAEILPNCVPFGPYHLLLAEDDADTAAPADPHGCLAWLGRQPARGVAYVSFGTVACPRPDELRELAAGLEASAAPFLWSLREDSWTLLPPGFLDRAAGTGSGLVVPWAPQVAVLRHPSVGAFVTHAGWASVLEGVSSGVPMACRPFFGDQRMNARSVAHVWGFGAAFEGAMTSAGVAAAVEELLRGEEGARMRARAKELQALVAEAFGPGGECRKNFDRFVEIVCRA

SEQ ID NO: 5330 - protein, 472 aa, Panicum virgatum
MAPDASSPTPHVAVVAFPFSSHAAVLLAFARALAAAAAPAGGTLSFLSTAGSIAQLRRAVGVELPGNLRFVEVPDGAGPPAAKGAVPVPMPRQMELFMAAAEAGGVKAGLQAARAAAGGAKVSCVVGDAFVWPAAEAAAAAGAPWVPVWTAASCALLAHLRTDALRADVGDQAASRADELLVSHPGLGSYRVGDLPDGVVSGDFNYVISRLVHRMGQLLPRAAAAVALDTFPGLDPPDVTAALDETLPNCLPLGPYHLLLPKDTTDAASQAAGDPHGCLAWLDAHPARSVAYVSFGTVASPRPDELRELAAGLESSDAPFLWSLREDSWPLLPAGFLARATAAGAGLVVPWAPQVAVLRHASVGAFVTHAGWASVLEGVASGVPMACRPFFGDQRMNARSVASVWGFGLAFEGATMTRAGVAAAVGELLRGEEGARMRARAQELQAAVAAAFVPGGACRRNFDEFVQIVCRV

SEQ ID NO: 5331 - protein, 440 aa, Panicum virgatum
MGRRSSASAEPLLPPALKRGVAAVERCASRADDELRWFRSCLRWACMDHSGPAQAALSWLLFLALGVLAPAAAHFLLVLRDSRRPFSAVVQLSLSAAAAAGFLCLSASFRRVGLRRLLYLDKLRTKSDRVRAHYTARLAFSFRLLAALVAPCFAAEAAYKVWWYATSAAGAPFFGGDVLGDVLACSVEMASWMYRSAVYLLTCVLFRLICHLQGLRLEDFAGTLLEEVEEGRAGIDRVLREHLDIRKQLKVISHRFRKFIVAALLIATASQFASVLLTTRRDSVDDLLNTGELALCSVVLMSGLIIILSSAAKITHQAQALTGHTTKWHACCTIAPVPDEEGEPGSNQNSMIEQDPSSDSDTESSEETGDEDLLENTKIHLPQAHVISFQKRQALVTYLENNRAGITVFGFTLDRSYLHTIFMLEWTLFLWLLGKTIGFS

SEQ ID NO: 5332 - protein, 450 aa, Brachypodium distachyon
MGRRSSASPVGSVEPLLPEVFKGGGGGRGAATLQRSVSRADDELQWFRSCLRWVCMDHSAPGRAAMSWLLFLLLGVVVPAVAHFLLAFRASRRPFNAVVQLSLSAASAASFLCLSSSFRRIGLRRLLYLDKLRTKSDRVRLNYTTRLSFSFRLLASLVAPCFAAEAAYKAWWYATSADRVPFFANDVLSDVVACSLEMASWMYRSAIYLLTCVLFRLICHLQGLRLEDFAGSLLVEVEEGRIGVERVLREHLDIRKQLKVISHRFRRFIVAALLIGTASQFASVLLTTRHDSVDDLLNTSELALCSVVLMSGLIIILSSAAKITHQAQALTGQTTKWHACCTIEPVPDEEVDPGSNQNSMLEEYPESDSDCESSEETGDEDLLENTRFMLPHTVHVISFQKRQALVTYLENNKAGITVFGFTLDRSYLHTIFMLEWTLFLWLLGKTVGFS

SEQ ID NO: 5333 - protein, 448 aa, Sorghum bicolor
MASSLPPFTVRRGEPVLVAPSSPTPRETKPLSDIDDSEGMRFYSSGIHLYRANPAKAGQDPATVIREALAQALVPYYPLAGRLREVEGRKLVVDCAAQGVLFAEADADLTADDFGDVQSPPFPCFEQFILESTTVAGVEPVVDRPLLYVQVTRLACGGFIFGQRFCHCVVDAPGGMQFEKAVCEIARGAAAPSVAPAWGREMFMARNPPRPAYPHVEYREPAGGVGVDRMLTTPAADMVRVPFFFGAREIAGLRQRAPPGMRCSRFELVAACIWRSRTAALGYAPDEEVRLSFIVNARGRPDIPLPEGFYGNAFAYSVAATTAGELCGGDLGFALELVKMAKSAVTYDYLVSVADLMVLTGRPLFEVSRTYIVSDISHAGFKSIDFGWGEAVYGGPAKGGEGPLPGVTNYFSRAKNGKGEEGTVVPICLPKDAMEKFQLEVEGLTAEL

SEQ ID NO: 5334 - protein, 448 aa, Sorghum bicolor
MASALPPFTVRRGEPVLVAPSSPTPRETKPLSDIDDSEGMRFYSSGIHLYRANPSKAGQDPATVIREALAQALVPYYPLAGRLREVEGRKLVVDCAAQGVLFAEADVDLTADDFGDVQSPPFPCFEQFILESTTVAGVEPVVDRPLLYVQVTRLACGGFIFGQRFCHCVVDAPGGMQFEKAVCEIARGAAAPSVAPAWGREMFMARNPPRPAYPHVEYREPAGGVGVDRILTTPAADMVRVPFFFGAREIAGLRQRAPPGMRCSRFELVAACIWRSRTAALGYAPDEEVRLSFIVNARGRPDIPLLEGFYGNAFAYSVAAATAGELCGGDLGFALELVKKAKSAVTYDYLVSVADLMVLTGRPLFEVSRTYIVSDISHAGFKSIDFGWGEAVYGGPAKGGEGPLPGVTNYFSRAKNGKGEEGTVVPICLPKDAMEKFQLEVEGLTAEL

SEQ ID NO: 5335 - protein, 341 aa, Artemisia annua
MAGAVPRIKLGSQGLEVSAQGLGCMGMSAFYGAPKPEPDMIKLIHHAINSGVTFLDTSDIYGPKTNEILLGKALKDGVREKVELATKFGIRYDGVREVRGDPEYVRSACEASLERLGVACIDLYYQHRIDTRLPIEITMGELKKLVEEGKIKYVGLSEASASTIRRAHSVHPITAVQLEWSLWSRDVEEDIIPTCRELGIGIVAYSPLGRGFFSSGPKLLEKLEEGDFRKYLPRFQPENLEHNKILYERVNEIAAKKGCTPSQLALAWVHHQGNDVVPIPGTTKIENLEQNIKALSVKLTPEEMAELESIASADSVKGARYGAGLTTYAESDTPPLSSWKA

SEQ ID NO: 5336 - protein, 342 aa, Centaurea maculosa
MAGGIPRVKLGSQGLEVSAQGLGCMGMSAFYGAAKPEPDMIKLIHHAINAGVTFLDTSDMYGPKTNEILLGKALKGGIREKVELATKFGIKFEGGVREICGDPAYVRSACEASLKRLDVDCIDLYYQHRIDTRLPIEITMGELKKLVEEGKIKYVGLSEASASTIRRAHAVHPITAIQLEWSLWTRDVEEEIIPTCRELGIGIVAYSPLGRGFLSSGPKMMEKLEDGDFRKYLPRLQPENLEHNKILFERVNEIAAKKGCTPSQLALAWIHHQGNDVVPIPGTTKIENLEQNIGALSVKLTAEEMAELESIASADAVKGGRYTAGISTYLDSDTPPLSSWKA

SEQ ID NO: 5337 - protein, 340 aa, Helianthus annuus
MSRVPRIKLGSQGLEVSAQGLGCMGMSAFYGAPKPEPDMINLIHHAINAGITFLDTSDIYGPKTNEILLGKALKGGMRGKVELATKFGIKYDGVREIRGDPEYVRACCEASLERLGVESIDLYYQHRIDTRVPIEITMGELKKLVEEGKIKYVGLSEASASTIRRAHAVHPITAIQLEWSLWTRDVEQDIIPTCRELGIGIVAYSPLGRGFFSSGPKMLEKLEDGDFRKYLPRFQPENLEHNKILFERVNELASKKGCTPSQLSLAWVHHQGNDVVPIPGTTKIENLEQNIGALSVKLTPEEMAELESIASADSVKGERYGSGLSTYADSDTPPLSSWKA

SEQ ID NO: 5338 - protein, 342 aa, Helianthus annuus
MAKVPRVKLGSQGLQVSAQGLGCMGMSAFYGPPKPESDMIKLIHHAIDAGVTFLDTSDVYGPKTNEILLGKALKGGVREKVELATKFGAKYDGEWAIQGDPAYVRAACEASLQRLEVDCIDLYYQHRIDTRVPIEITMGELKKLVEEGKIKYVGLSEASASTIRRAHAVHPITAIQLEWSLWSRDVEEDIIPTCRELGIGIVAYSPLGRGFFSSGPKLLDELQDGDLRKYMPRFQPENLEHNKIVYEKVNEIASKKGCTPSQLSLAWVHHQGNDVVPIPGTTKIQNLEQNIGALSVKLTPEEMTELESIAAADLVKGDRYGAGISTYLDSETPPLSSWKAQS

SEQ ID NO: 5339 - protein, 341 aa, Carthamus tinctorius
  misc_feature (19)..(19): Xaa can be any naturally occurring amino acid
  misc_feature (143)..(143): Xaa can be any naturally occurring amino acid
MAGIPRVKLGSQGLEVSAXGLGCMGMSAFYGAAKPEPDMINLIHHAINAGVTFLDTSDMYGPKTNEILLGKALKGGIRDKVELATKFGIKIEGGAREICGDPAYVRSACEASLKRLNVDCIDLYYQHRIDTRLPIEITMGELXKLVEEGKIKYVGLSEASASTIRRAHAVHPITAIQLEWSLWTRDVEEEIIPTCRELGIGIVAYSPLGRGFLSSGPKMLEKLEDGDFRKYLPRLQPENLEHNKILFERVNEIAAKKGCTPSQLALAWIHHQGNDVVPIPGTTKIENLEQNIGALSVKLTAQEMAELESIASADAVKGGRYAAGISTYLDSDTPPLSSWKA

SEQ ID NO: 5340 - protein, 237 aa, Cynara scolymus
MAGIPRIKLGSQGLEVSAQGLGCMGMSAFYGSPKPEPDMINLIHHAINAGVTFLDTSDMYGPKTNEILLGKALKGGIREKVELATKFGFKFEGGAREICGDPAYVRSACEASLQRLDVDCIDLYYQHRIDTRLPIEITMGELKKLVEEGKIKYIGLSEASASTIRRAHAVHPITAIQLEWSLWTRDVEDEIVPTCRELGIGIVAYSPLGRGFLSSGPKMLEKLEDGDFRKYLPRFQP

SEQ ID NO: 5341 - protein, 341 aa, Helianthus annuus
MASRVPRRQLGSQGLEVSALGLGCMGMSDLYGAPKPEPDMIKLIHHAINAGVTLLDTSDVYGPKTNEILLGKALKGGMRDKVQLATKFGIKLDGSWEVQGDPAYVRAACEASLKRLEVDCIDLYYQHRIDTSVPIEITMGELKKLVEEGKIKYVGLSEASASTIRRAHAVHPITAVQLEWSLQSRDVEEEIIPTCRELGIGIVAYSPLGRGFFSHGPNMLEKLEESDARKYLPRLQPENLEHNKIMYERINDLATKKGCTTSQLALAWVLHQGNDVVPIPGTTKIENFEHNIGALSVKLTPEDMAELESIASPDSIKGDRYGAGLKTYKDSETLPLSAWKA

SEQ ID NO: 5342 - protein, 341 aa, Helianthus annuus
MASRVPRRHLGSQGLEVSALGLGCMGMSDLYGAPKPEPDMIKLIHHAINAGVTLLDTSDVYGPKTNEILLGKALKGGMRDKVELATKFGIKLDGSWQVQGDPAYVRAACEASLKRLEVDCIDLYYQHRIDTSVPIEITMGELKKLVEEGKIKYVGLSEASASTIRRAHAVHPITAVQMEWSLQSRDVEEEIIPTCRELGIGIVAYSPLGRGFFSHGPKMLEKLEESDARKYLPRLQPENLEHNKIMYERINDLATKKGCTTSQLALAWVLHQGNDVVPIPGTTKIENFEHNIGALSIKLTPEDMAELESIASPDSIKGDRYGAGLKTYKDSETLPLSAWKA

SEQ ID NO: 5343 - protein, 341 aa, Cichorium intybus
MAGVRRVKLGSLGLEVSAQGLGCMGMSAFYGAPKPEPDMIKLIHHAINSGITFLDTSDIYGPKTNEILLGKALKGGMREKVELATKFGIREVNGAREYCGDPAYVRAACEASLERLGVDCIDLYYQHRIDTRLPIEITMGALKELVEEGKIKYVGLSEASASTIRRAHAVHPLTAIQLEWSLWTRDVEEEIIPTCRELGIGIVAYSPLGRGFFSSGPKMLEKLEAGDFRKYLPRFQAENLEHNTIMFERVNAMAAKKGCTPSQLSLAWVHHQGDDVVPIPGTTKIENLEQNIGALSVKLTPEDMAELEAIASADSVKGDRYGAGIATYKDSETPPLSSWKA

SEQ ID NO: 5344 - protein, 341 aa, Lactuca sativa
MAGVRRVKLGSQGLEVSAQGLGCMGMSAFYGAPKPEPDMIKLIHHAINAGVTFLDTSDIYGPKTNEILLGKALNGGIREKVELATKFGIREVNGAREYCGDPTYVRAACEASLERLGVDCIDLYYQHRIDTRLPIEITMGALKELVEEGKIKYVGLSEASASTIRRAHAVHPLTAIQLEWSLWTRDVEEDIIPTCRELGIGIVAYSPLGRGFFSSGPKMLEKLEDSDFRKYLPRFQAENLEHNTKMFERVNEMATKKGCTPSQLSLAWVHHQGNDVVPIPGTTKIENLEQNIGALSVKLTPEDMAELEAIASADSVKGERYGAGIATYKDSETPPLSSWKA

SEQ ID NO: 5345 - protein, 341 aa, Helianthus annuus
MASRVPRRHLGSQGLEVSALGLGCMGMSDLYGAPKPEPDMIKLIHHAINAGVTLLDTSDVYGPKTNEILLGKALKGGMRDKVQLATKFGIKLDGSWQVQGDPAYVRAACEASLERLGVDCIDLYYQHRIDTSVPIEITMGELKKLVEEGKIKYVGLSEASASTIRRAHAVHPITAVQMEWSLQSRDVEEEIIPTCRELGIGIVAYSPLGRGFFSHGPKMLEKLEESDARKHLPRLQPENLEHNKIMYERINDLVTKKGCTTSQLALAWVLHQGNDVVPIPGTTKIENFEHNIGALSVKLTPEDMAELESIASPDSIKGDRYGAGLKTYKDSETLPLSAWKA

SEQ ID NO: 5346 - protein, 342 aa, Taraxacum officinale
MANVPRIKLGSQGLEVSAQGLGCMGMSAFYGPPKPEPDMISLIHHAIDAGVTLLDTSDVYGPKTNEILLGKALKGEVRKKVELATKYGINTEDGAYEIRGDPAYVRAACEASLKRLDIDCIDLYYQHRIDTRVPIEITMGEMKKLVEEGKIKYIGLSEASASTIRRAHAVHPITAVQLEWSLWSRDVEQEIIPTCRELGIGIVAYSPLGRGFLSLGPKMAENLTDGDFRQSLPRFQGENLEHNKMLYEKVSAIAEKKGCTPSQLALAWVHHQGNDVVPIPGTTKIENLQQNIGALSVKLTTEDMAELESIASDDATKGDRYMDGFPTFLNSDTPPLSSWKAS

SEQ ID NO: 5347 - protein, 341 aa, Taraxacum officinale
MAGVRRVKLGSQGLEVSAQGLGCMGMSAFYGSPKPEPDMIKLIHHAINSGITFLDTSDIYGPKTNEILLGKALKGGMRDKVELATKFGIREVNGAREYCGDPAYVRSACEASLERLGVDCIDLYYQHRIDNRLPIEITMKALKELVEEGKIKYVGLSEASASTIRRAHAVHPLTAIQLEWSLWTRDVEEEIIPTCRELGIGIVAYSPLGRGFFSSGPKMLEKLEASDFRKYLPRFQAENLEHNTIMFKKVSDMAAKKGCTPSQLSLAWVHHQGNDVVPIPGTTKIENLEQNIGALSVKLSPEDMAELEAIASADSVKGDRYGAGIATYKDSETPPLSSWKA

SEQ ID NO: 5348 - protein, 341 aa, Helianthus annuus
MAINVPRRKLGSQGLEASALGLGCMGMSALYGAPKPEPDMIKLIHHAINAGVTLLDTSDIYGPKTNEILIGKALKGGMRDKVELATKFGIKLDGSWQVLGDPAYVRAACEASLKRLEVDCIDLYYQHRIDTSVPIEITMGELKKLVEEGKIKYVGLSEASAATIRRAHAVHPVTAVQLEWSLQSRDVEEEIIPTCRELGIGIVAYSPLGRGFFSHGPKMLEKLEESDARKTLPRLQPENLEHNKIMYERINELATKKGCTTSQLALAWVLHQGNDVVPIPGTTKIENFEHNLGALSVKLTAEDMAELESIASPDSIKGDRYGVAVKTYKDSDTPPLSSWKA

SEQ ID NO: 5349 - protein, 341 aa, Vitis vinifera
MSSVKRMKLGSQGLEVSAQGLGCMGMSAFYGPPKPEQDMIALIHHAVNSGITFLDTSDIYGPFTNEILLGKALKGGVREKVELATKFGVIYDDRVRDARGDPAYVRACCEASLKRLEVDCIDLYYQHRIDTRVPIEVTVGELKKLVEEGKIKYIGLSEASASTIRRAHAVHPITAVQLEWSLWSRDVEEDIVPTCRELGIGIVAYSPLGRGFLSSGAKMVENLSDNDSRKYFPRFQPENLEHNKILYERVSEIATRKGCTPSQLALAWVHHQGDDVCPIPGTTKIENLNQNIGALSVKLTPEEMAELESIASADVVKGDRYQSTTFTWKNSDTPPLASWKA

SEQ ID NO: 5350 - protein, 226 aa, Helianthus annuus
MASRVPRRHLGSQGLEVSALGLGCMGMSTLYGAPKPEPDMIKLIHHAINAGVTLLDSSDAYGPKTNEILIGKALKGGMRDKVQLATKFGIKLDGSWQILGDPAYVRAACEDSLKRLDVDCIDLYYQHRIDTSVPIEITMGELKKLVEEGKIKYVGLSEASASTIRRAHAVHPVTAVQLEWSLQSRDVEEEIIPTCRELGIGIVAYSPLGRGFFLTWSKDVGEVGRK

SEQ ID NO: 5351 - protein, 159 aa, Helianthus annuus
MEFSLMGLDTPFLRNLHHILESTDDDTTGNKSNNGGPSRAYVRDARAAATSADVKEYPNSYVFIVDMPGLKSGDIKVQVEDDNILVISGERNREEEKEGVKYVRMERRIGKFMRKFALPENANTDKISAVCQDGVLTVTVEKLPPPEPKKPKTIQVQVA

SEQ ID NO: 5352 - protein, 162 aa, Parthenium argentatum
MDISTLMGFDAPFLRNLQHILEATDDNTTNNKSNNNSGPSRAYVRDARAMAATPADVKEYPNSYVFIVDMPGLKSGDIKVQVEDDNVLVISGERNREEEKEGVKYVRMERRIGKFMRKFALPENANMDKISAVCQDGVLTVTVEKLPPPEPKKPKTIQVQVA

SEQ ID NO: 5353 - protein, 160 aa, Helianthus annuus
MEYSLLGLDSPFLCNLHHILEATDDNTTGNKSNNSAPSRAYIRDARAMAVTPADVKEYPNSYVFIVDMPGLKSGDIKVQVEDDNVLVISGERNREEEKEGVKYVRMERRIGKFMRKFALPENANTDKISAVCQDGVLTVTVEKLPPPEPKKPKTIQVQVA

SEQ ID NO: 5354 - protein, 164 aa, Taraxacum officinale
MDISLMGFDTPFFRNLHHILDGTDDNTTNNKSSNATGPTRAYVRDARAMAATPADVKEYPNSYVFIVDMPGLKSGDIKVQVEDDNVLVISGERKREHDQEEKEGVKYVRMERRIGKFMRKFVLPENANMEKISAICQDGVLTVTVEKLPPPEPKKPKMIQVQVA

SEQ ID NO: 5355 - protein, 163 aa, Lactuca sativa
MDISLMGFDTPFFRNLHHILEATDDTTTNNKSSNAGPTGAYVRDARAMAATPADVKEYPNSYVFIVDMPGLKSEDIKVQVEEDNVLVISGERKREHDQEEKEGVKYVRMERRIGKFMRKFALPENANMEKISAICQDGVLTVTVEKLPPPEPKKPKTIQVQVA

SEQ ID NO: 5356 - protein, 160 aa, Arnica chamissonis
MDISLMGFDTPFFRNLHHILEDNTTTNKSTNSEPTRAYVRDARAMAATPADVKEYPNSYVFIVDMPGLKSGDIKVQVEEENVLVISGERKREHDEEEKEGVKYVRMERRIGKFMRKFALPENANVEKISAICQDGVLTVTVEKLPPPEPKKPKTIQVQVA

SEQ ID NO: 5357 - protein, 162 aa, Cynara scolymus
MDISLMGFDTPFFRNLHHILEVTDDGNSNKSNTAGPTRAYVRDARAMAATPADVKEYPNSYVFIVDMPGLKSGDIKVQVEEENVLVISGERKREHEQEEKEGVKYVRMERRIGKFMRKFVLPENANTEKISAICQDGVLTVTVEKLPPPEPKKPKLIQVQVA

SEQ ID NO: 5358 - protein, 163 aa, Cynara scolymus
MDISLMGFDTPFFRNLHHILDATDDGNNNKKSSTAGPTRAYVRDARAMAATPADVKEYLNSYVFIVDMPGLKSGDIKVQVEDDNVLVISGERKREHEQEEKEGVKYVRMERRIGKFMRKFVLPENANTEKISAICQDGVLTVTVEKLPPPEPKKPKLIQVQVA

SEQ ID NO: 5359 - protein, 163 aa, Taraxacum officinale
MDISLMGFDTSFFRNLHHILEATDDGTTNNKSINCGPTGAYVRDARAMAGTPADVKEYPKSYVFIVDMPGLKSGDIKVQIEEDNVLVISGERKREHDQEEKEGVKYVRMERRIGKFMRKFALPENANTEKISAICKDGILTVTVEKLPPPEPKKPKTIQVQVA

SEQ ID NO: 5360 - protein, 162 aa, Lactuca sativa
MDISLMGFDTPFFRNLHHILDATEDNSNSKSSNAGPTRAYVRDARAMAATPADVKEYPNSYVFIVDMPGLKSGDIKVQVEEDNVLVISGERKREHDQEEKEGVKYVIMERRIGKFMRKFALPENANTEKISAICKDGVLTVTVEKLPPPEPKKPKTIQVNVA

SEQ ID NO: 5361 - protein, 162 aa, Cynara scolymus
MDISLMTFDAPFFRNLHHILEATDDGNSNKSSTAGPTRAYVRDARAMAATPADVKEYLNSYVFIVDMPGLKSGDIKVQVEDDNVLVISGERKREHEQEEKEGVKYVRMERRIGKFMRKFVLPENANTEKISAICQDGVLTVTVEKLPPPEPKRPKLIQVQVA

SEQ ID NO: 5362 - protein, 153 aa, Helianthus annuus
MDIDSLMGFDPLLRNLHYILEATDDNTTGNKSNNSGPSRAYVRDARAMAATPADVKECPNSYVFIVDMPGLKSGDIKVQVERDNVLVISGKRNREEEKEGVKMGKFMKKFALPEDANTDKISAICQDGVLTVTVEKLPPPEPKKPKTIQVQVA

SEQ ID NO: 5363 - protein, 160 aa, Centaurea maculosa
  misc_feature (108)..(108): Xaa can be any naturally occurring amino acid
MDISFMGFDTPFFRNLHHILDDENTNSKKSSTASGPTRAYVRDARAMAATPADVKEYPNSYVFIVDMPGLKSGDIKVQVEDENVLVVSGERKREEEEKEGVKYVRMEXRIGKFMRKFVLPENANTEKISAICQDGVLMVTVEKLPPPEPKKPKLIQVQVA

SEQ ID NO: 5364 - protein, 158 aa, Carthamus tinctorius
MDISFMGFDTPFFRNLHHILEATDDDNNKKSTTTGPTRAYVRDARAMAATPADVKEYPNSYVFIVYMPGLKSGDIKVQVEEENVLVISGERKREDEERVKYVRMERRTGKFMRKFVLPENANLDKISAVCQDGVLTVTVEKLPPPEPKKPRLIQVQVA

SEQ ID NO: 5365 - protein, 157 aa, Artemisia annua
MDIFMGLDSPFFIHNLHNILDDTTNNKSTKSEPTRAYVRDARAMAATPADVKEYPNAYVFIVDMPGLKSGDIKVQVEDDNVLVISGERKREEEEKEGVKYVRMERRIGKFMRKFSLPENANIDKISAVCQDGVLTVTVEKLPPPEAKKPKLVQVQVA

SEQ ID NO: 5366 - protein, 156 aa, Vitis vinifera
MDSRMMGFDSPLFSALQHMLDATDDSDKSVSAPTRTYVRDAKAMAATPADVKEYPNSYTFIVDMPGLKSGDIKVQVEDDNVLVISGERKREEEKEGVKYVRMERRVGKFMRKFALPENANTDKISAVCQDGVLTVTVEKLPPPEPKKPKTIEVKIA

SEQ ID NO: 5367 - protein, 153 aa, Unknown
  Sequence found in Organisms: Arnica chamissonis, Cynara scolymus, Taraxacum officinale, Gerbera hybrid cultivar, Lactuca sativa, Carthamus tinctorius, Tragopogon dubius
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5368 - protein, 153 aa, Guizotia abyssinica
MQIFVKTLTGKTITLEVESSDTIDNVKVKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5369 - protein, 153 aa, Cynara scolymus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKP

SEQ ID NO: 5370 - protein, 153 aa, Taraxacum officinale
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNGECGAGTFMANHFDRHYCGKCGLTYVYQKA

SEQ ID NO: 5371 - protein, 153 aa, Taraxacum officinale
MQIFVKTLTGKTITLEVESSDTIDNVKAKIQDKEGIPPDQQRLIFAGKQLEDGRTLTDYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5372 - protein, 153 aa, Gerbera hybrid cultivar
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKG

SEQ ID NO: 5373 - protein, 153 aa, Senecio madagascariensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLSVLQFYKVDDSGKVQRLRKECPNAECGAGTFMANHFDRHYCGKCGLTYVYQKA

SEQ ID NO: 5374 - protein, 153 aa, Tragopogon dubius
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSILQFYKVDDSGKVQRLRKECPNAECGAGTFMANHFDRHYCGKCGLTYVYQKA

SEQ ID NO: 5375 - protein, 98 aa, Platanus occidentalis
MQIFVKTLTGKTITLEVESSDTIDNVKAKIQDKEGIPPDQQRLIFAGKQLEDGRTLADYNIQKESTLHLVLRLRGRSEEAKEEDLHEAQEDQAQEEEG

SEQ ID NO: 5376 - protein, 155 aa, Unknown
  Sequence found in Organisms: Glycine max, Cicer arietinum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAEA

SEQ ID NO: 5377 - protein, 155 aa, Unknown
  Sequence found in Organisms: Vigna unguiculata, Glycyrrhiza uralensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAGA

SEQ ID NO: 5378 - protein, 155 aa, Vigna unguiculata
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKADA

SEQ ID NO: 5379 - protein, 155 aa, Cyamopsis tetragonoloba
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKASA

SEQ ID NO: 5380 - protein, 156 aa, Gerbera hybrid cultivar
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDNGKVQRLRKECPNAECGAGTFMANHFDRHYCGKCGLTYVYQKAGGD

SEQ ID NO: 5381 - protein, 155 aa, Glycyrrhiza uralensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAAA

SEQ ID NO: 5382 - protein, 265 aa, Capsicum annuum
MAAATMALSSPSFAGQAVKLSPSDSEISGNGRISMRKTASKPAASSSPWYGPDRVKYLGPFSGEPPSYLTGEFPGDYGWDTAGLSADPETFAKNRELEVIHCRWAMLGALGCVFPELLARNGVQFGEAVWFKAGSQIFSEGGLDYLGNPSLVHAQSILAIWACQVVLMGAVEGYRIAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 5383 - protein, 156 aa, Unknown
  Sequence found in Organisms: Malus domestica, Fagopyrum esculentum, Petunia hybrida, Tripterygium wilfordii, Vinca minor
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAGGD

SEQ ID NO: 5384 - protein, 155 aa, Unknown
  Sequence found in Organisms: Medicago truncatula, Trigonella foenum-graecum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKAEA

SEQ ID NO: 5385 - protein, 155 aa, Unknown
  Sequence found in Organisms: Medicago truncatula, Trigonella foenum-graecum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKADA

SEQ ID NO: 5386 - protein, 155 aa, Unknown
  Sequence found in Organisms: Brachypodium distachyon, Secale cereale, Triticum aestivum
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNAECGAGTFMANHFDRHYCGKCGLTYVYNQKA

SEQ ID NO: 5387 - protein, 155 aa, Glycine max
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLALLQFYKVDDSGKVQRLRKECPNAECGAGTFMANHFDRHYCGKCGLTYVYQKAEA

SEQ ID NO: 5388 - protein, 155 aa, Unknown
  Sequence found in Organisms: Phaseolus coccineus, Cajanus cajan
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNAECGAGTFMANHFDRHYCGKCGLTYVYQKAGA

SEQ ID NO: 5389 - protein, 155 aa, Phaseolus coccineus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNAECGAGTFMANHFDRHYCGKCGLTYVYQKAGV

SEQ ID NO: 5390 - protein, 155 aa, Unknown
  Sequence found in Organisms: Pennisetum glaucum, Cenchrus ciliaris, Panicum virgatum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNADCGAGTFMANHFDRHYCGKCGLTYVYNQKA

SEQ ID NO: 5391 - protein, 155 aa, Unknown
  Sequence found in Organisms: Pennisetum glaucum, Cenchrus ciliaris
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNAECGAGTFMANHFDRHYCGKCGLTYVYNQQA

SEQ ID NO: 5392 - protein, 155 aa, Cicer arietinum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKTDA

SEQ ID NO: 5393 - protein, 155 aa, Vigna unguiculata
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNAECGAGTFMANHFDRHYCGKCGLTYVYQKADA

SEQ ID NO: 5394 - protein, 155 aa, Cyamopsis tetragonoloba
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAGA

SEQ ID NO: 5395 - protein, 155 aa, Eschscholzia californica
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNQECGAGTFMANHFDRHYCGKCGLTYVYQKAGG

SEQ ID NO: 5396 - protein, 155 aa, Lotus japonicus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKAAA

SEQ ID NO: 5397 - protein, 155 aa, Zea mays
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDATGKVTRLRKECPNTECGAGVFMANHFDRHYCGKCGLTYVYNQKA

SEQ ID NO: 5398 - protein, 155 aa, Glycine max
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLGILQFYKVDDSGKVQRLRKECPNAECGAGTFMANHFDRHYCGKCGLTYVYQKADA

SEQ ID NO: 5399 - protein, 307 aa, Triticum aestivum
MQIFVKTLTGKTITLEVESSDTIDNVKAKIQDKEGIPPDQQRLILAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNAECGAGTFMANHFDRHYCGKCGLTYVYNQKA

SEQ ID NO: 5400 - protein, 120 aa, Primula obconica
MQIFVKTLTGKTITLEVESSDTIDNVKAKIQDKEGIPPDQQRLIFAGKQLEDGRTLADYNIQKESTLHLVLRLRGGTKKRKKKTYTKPKKIKHKHKKVKLAVLQFYKVEDSGKVQRLRKE

SEQ ID NO: 5401 - protein, 56 aa, Ipomoea nil
CERRRDAKMQIFVKTLTGKTITLEVESSDTIDNVKAKIQDKEGIPPDQQRLIFAGK

SEQ ID NO: 5402 - protein, 152 aa, Trigonella foenum-graecum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDESGKVQRLRKECPNAECGAGTFMANHFDRHYCGKCGLTYVYQK

SEQ ID NO: 5403 - protein, 151 aa, Lactuca sativa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVLD

SEQ ID NO: 5404 - protein, 156 aa, Unknown
  Sequence found in Organisms: Solanum lycopersicum, Aristolochia fimbriata, Theobroma cacao, Ricinus communis, Citrus sinensis, Citrus clementina, Coffea canephora, Solanum melongena, and additional organisms as disclosed in Tables 70 and 71
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5405 - protein, 156 aa, Citrus clementina
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGSD

SEQ ID NO: 5406 - protein, 156 aa, Unknown
  Sequence found in Organisms: Antirrhinum majus, Cucumis sativus, Cucurbita pepo, Cucumis melo, Momordica charantia, Olea europaea, Capsicum annuum, Petunia hybrida, Lippia dulcis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYNKAGGD

SEQ ID NO: 5407 - protein, 156 aa, Euonymus alatus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLSVLQFYKVDDSGKVQRLRKECPNGECGAGTFMANHFDRHYCGKCGLTYVYQKAGGD

SEQ ID NO: 5408 - protein, 156 aa, Unknown
  Sequence found in Organisms: Euonymus alatus, Fagopyrum esculentum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNGECGAGTFMANHFDRHYCGKCGLTYVYQKAGGD

SEQ ID NO: 5409 - protein, 156 aa, Fagopyrum esculentum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPSAECGAGTFMANHFDRHYCGKCGLTYVYQKAGGD

SEQ ID NO: 5410 - protein, 156 aa, Fagopyrum esculentum
MQIFVKTLTGKTITLEVESSDTIDNLKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAGGD

SEQ ID NO: 5411 - protein, 156 aa, Humulus lupulus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLSLLQFYKVDDSGKVQRLRKECPNAECGAGTFMANHFDRHYCGKCGLTYVYQKAGGD

SEQ ID NO: 5412 - protein, 156 aa, Unknown
  Sequence found in Organisms: Vitis vinifera, Platanus occidentalis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGE

SEQ ID NO: 5413 - protein, 156 aa, Primula obconica
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVEDSGKVQRLRKECPNAECGAGTFMANHFDRHYCGKCGLTYVYQKAGGD

SEQ ID NO: 5414 - protein, 156 aa, Scabiosa columbaria
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHADRHYCGKCGLTYVYQKAGGD

SEQ ID NO: 5415 - protein, 156 aa, Fragaria vesca
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQKLRKECPNAECGAGTFMANHFDRHYCGKCGLTYVYQKAGGD

SEQ ID NO: 5416 - protein, 155 aa, Vinca minor
QIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAGGD

SEQ ID NO: 5417 - protein, 156 aa, Vinca minor
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYNKAAEE

SEQ ID NO: 5418 - protein, 156 aa, Vinca minor
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYNKAVEE

SEQ ID NO: 5419 - protein, 156 aa, Solanum melongena
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDTGKVQRLRKECPNAECGAGTFMANHFDRHYCGKCGLTYVYQKAGGD

SEQ ID NO: 5420 - protein, 156 aa, Ipomoea batatas
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQVYKVDDSGKVQRLRKECPNAECGAGTFMANHFDRHYCGKCGLTYVYQKAGGD

SEQ ID NO: 5421 - protein, 156 aa, Quercus alba
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNAECGAGTFMANHFDRHYCGKCGLTYVYQKAGGD

SEQ ID NO: 5422 - protein, 231 aa, Triticum aestivum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNADCGAGTFMANHFDRHYCGKCGLTYVYNQKA

SEQ ID NO: 5423 - protein, 155 aa, Unknown
  Sequence found in Organisms: Hordeum vulgare, Pseudoroegneria spicata, Triticum aestivum
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNADCGAGTFMANHFDRHYCGKCGLTYVYNQKA

SEQ ID NO: 5424 - protein, 153 aa, Unknown
  Sequence found in Organisms: Adiantum capillus-veneris, Pteridium aquilinum
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQFYKVDDSGKVQRLRKECPNAECGAGTFMANHHDRHYCGKCGLTYVYQKA

SEQ ID NO: 5425 - protein, 155 aa, Cryptomeria japonica
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNQECGAGTFMANHFDRHYCGKCGLTYVYQKAEA

SEQ ID NO: 5426 - protein, 155 aa, Ipomoea nil
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDESGKVQRLRKECPNAECGAGTFMANHFDRHYCGKCGLTYVYQKGGD

SEQ ID NO: 5427 - protein, 155 aa, Lotus japonicus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKPTA

SEQ ID NO: 5428 - protein, 155 aa, Unknown
  Sequence found in Organisms: Zea mays, Sorghum bicolor, Saccharum officinarum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGVFMANHFDRHYCGKCGLTYVYNQKA

SEQ ID NO: 5429 - protein, 155 aa, Unknown
  Sequence found in Organisms: Zea mays, Sorghum bicolor, Saccharum officinarum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNAECGAGVFMANHFDRHYCGKCGLTYVYNQQA

SEQ ID NO: 5430 - protein, 155 aa, Avena sativa
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLALLQFYKVDDATGKVTRLRKECPNAECGAGTFMANHFDRHYCGKCGLTYVYNQKA

SEQ ID NO: 5431 - protein, 155 aa, Arachis hypogaea
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKIDDTGKVQRLRKECPNAECGAGTFMANHFDRHYCGKCGLTYVYQKAAA

SEQ ID NO: 5432 - protein, 155 aa, Arachis hypogaea
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKIDDSGKVQRLRKECPNAECGAGTFMANHFDRHYCGKCGLTYVYQKAAA

SEQ ID NO: 5433 - protein, 155 aa, Oryza sativa
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNAECGAGTFMANHFDRHYCGKCGLTYVYNQQA

SEQ ID NO: 5434 - protein, 155 aa, Oryza sativa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNNDCGAGTFMANHFDRHYCGKCGLTYVYNQKA

SEQ ID NO: 5435 - protein, 155 aa, Glycine max
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLGILQFYKVDDSGKVQRLRKECPNAGCGAGTFMANHFDRHYCGKCGLTYVYQKADA

SEQ ID NO: 5436 - protein, 155 aa, Glycine max
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNAECGAGTFMANHFDRHYCGKCGLTYVYQKSEA

SEQ ID NO: 5437 - protein, 155 aa, Panicum virgatum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGTFMANHFDRHYCGKCGLTYVYNQQA

SEQ ID NO: 5438 - protein, 61 aa, Humulus lupulus
MSRPRSRTRRASHRTSSVSSSPESSSRTAEPCGLQHPEGVDSPLGAPSQGRSQKEEEEDLH

SEQ ID NO: 5439 - protein, 259 aa, Arabidopsis lyrata
MVLIVYWYDFICFATVAAAIVASLWFLLRRERGCLGIDDTGHVSLLPLYRSKSLGSAQLWTSCWTRLHPGWLLFTRSTSFLSMAALLAWDILKWDASIFVYYTEWTFMLVIIYFAMGIAASVYGCLIHSKELALETGEDVVVEKVGDEFRQRLEVYGCFMQTIFQTSAGAVVLTDIVFWLVIVPFLSNTRFGLNKLMICMHTANAGFLLLETVLNSLPFPWFRMGYFVLWSCLYIILHNQPILIKSNLSQVAISVPRAR

SEQ ID NO: 5440 - protein, 300 aa, Arabidopsis thaliana
MALIVYWYDFICFAIVAAAIVTSLWFLSRRDRGCVVIDDTSHDSLLPLYRSNNRGSARLWASCWTRLHPGWLLFTRSTSFLSMAALLAWDVIKWDASIFVYYTEWTFMLVIIYFAMGIVASVYGCLIHLKELTLETDEDVVVEKVGDEFRRRLEVCGCFMQTIFQTSAGAVVLTDIVFWLVIVPFLSTTRFGLNTLTICMHTANAGFLLLETLLNSLPFPWFRMGYFVLWSCLYVIFQWIIHACGFTWWPYPFLELDKPWAPIWYLCMAIVHIPCYGAYAAIVKAKNSCFPYLFPNALVT

SEQ ID NO: 5441 - protein, 156 aa, Unknown
  Sequence found in Organisms: Amsonia hubrichtii, Nuphar advena
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNADCGAGTFMANHFDRHYCGKCGLTYVYQKAGGD

SEQ ID NO: 5442 - protein, 156 aa, Unknown
  Sequence found in Organisms: Gossypium hirsutum, Theobroma cacao
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDESGKVQRLRKECPNAECGAGTFMANHFDRHYCGKCGLTYVYQKAGGD

SEQ ID NO: 5443 - protein, 156 aa, Chelidonium majus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQKLRKECPNSECGAGTFMANHFDRHYCGKCGLTYVYQKAGGE

SEQ ID NO: 5444 - protein, 156 aa, Cucurbita pepo
MQIFVKTLTGKTITLEVESSDAIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYNKAGGD

SEQ ID NO: 5445 - protein, 156 aa, Eucalyptus grandis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNGECGAGTFMANHFDRHYCGKCGLTYVYQKAGGD

SEQ ID NO: 5446 - protein, 156 aa, Unknown
  Sequence found in Organisms: Euonymus alatus, Tripterygium wilfordii
MQIFVKTLTGKTITLEVESSDTIDNVKSKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQNAGGD

SEQ ID NO: 5447 - protein, 156 aa, Unknown
  Sequence found in Organisms: Bruguiera gymnorhiza, Euphorbia peplus, Jatropha curcas, Plantago ovata, Rhizophora mangle, Triphysaria pusilla
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKAGGD

SEQ ID NO: 5448 - protein, 156 aa, Hevea brasiliensis
MQIFVKTLTGKTITLEFESSDTIDNVKAKIQDKEGIPPDQQRLIFAGKQLEDGRTLADYNIQKESTLHLVLRLRGGAKKRKKKTYTKPKKIKHKKKKVKLSILQFYKVDDSGKVQRLRKECPNAECGAGTFMANHFDRHYCGKCGLTYVYQKAGGD

SEQ ID NO: 5449 - protein, 156 aa, Hevea brasiliensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAILQFYKVDDSGKVQRLRKECPNAECGAGTFMANHFDRHYCGKCGLTYVYQKAGGD

SEQ ID NO: 5450 - protein, 156 aa, Lippia dulcis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLPVLQFYKVDDSGKVQRLRKECPNAECGAGTFMANHFDRHYCGKCGLTYVYNKAGGD

SEQ ID NO: 5451 - protein, 155 aa, Unknown
  Sequence found in Organisms: Cryptomeria japonica, Sequoia sempervirens
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQYYKVDDSGKVQRLRKECPNQECGAGTFMANHFDRHYCGKCGLTYVYQKAEA

SEQ ID NO: 5452 - protein, 156 aa, Silene vulgaris
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKAGGD

SEQ ID NO: 5453 - protein, 156 aa, Tabernaemontana elegans
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLALLQFYKVDDSGKVQRLRKECPNAECGAGTFMANHFDRHYCGKCGLTYVYQKAGGD

SEQ ID NO: 5454 - protein, 156 aa, Unknown
  Sequence found in Organisms: Solanum lycopersicum, Solanum phureja
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDTGKVQRLRKECPNAECGAGTFMANHFDRHYCGKCGLTYVYNKAGGD

SEQ ID NO: 5455 - protein, 156 aa, Tripterygium wilfordii
MQIFVKTLTGKTITLEVESSDTIDNVKSKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQTAGGD

SEQ ID NO: 5456 - protein, 155 aa, Triticum aestivum
MQIFVKTLTGKTITLEVESSDTIDNVKAKIQDKEGIPPDQQRLIFAGKQLEDGRTLADYNIQKESTLHLVLRLRGGAKKRKKKTYSTPKKQKHKHKKVKLAVLQFYKVDDATGKVTRLRKECPNAECGAGTFMANHFDRHYCGKCGLTYVYNQKA

SEQ ID NO: 5457 - protein, 155 aa, Glycine max
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLALLQFYKVDDSGKLQRLRKECPNAECGAGTFMANHFDRHYCGKCGLTYVYQKSEA

SEQ ID NO: 5458 - protein, 157 aa, Musa acuminata
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDATGKVTRLRKECPNAECGAGTFMANHFDRHYCGKCGLTYVYQKAQGE

SEQ ID NO: 5459 - protein, 155 aa, Hordeum vulgare
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDSTGKVTRLRKECPNADCGAGTFMANHFDRHYCGKCGLTYVYNQKA

SEQ ID NO: 5460 - protein, 156 aa, Manihot esculenta
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLSILQFYKVDDSGKVQRLRKECPNADCGAGTFMANHFDRHYCGKCGLTYVYQKAGDD

SEQ ID NO: 5461 - protein, 156 aa, Manihot esculenta
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLSILQFYKVDDSGKVQRLRKECPNADCGAGTFMANHFDRHYCGKCGLTYVYQKAGGD

SEQ ID NO: 5462 - protein, 156 aa, Unknown
  Sequence found in Organisms: Ricinus communis, Nicotiana benthamiana, Nicotiana tabacum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKAGAD

SEQ ID NO: 5463 - protein, 156 aa, Unknown
  Sequence found in Organisms: Castanea mollissima, Quercus alba
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNSECGAGTFMANHFDRHYCGKCGLTYVYQKAGGD

SEQ ID NO: 5464 - protein, 156 aa, Citrus sinensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMASHFDRHYCGKCGLTYVYQKAGGD

SEQ ID NO: 5465 - protein, 156 aa, Taraxacum officinale
MRILVKTLTGETITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKAGGD

SEQ ID NO: 5466 - protein, 156 aa, Solanum melongena
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYSKAGGD

SEQ ID NO: 5467 - protein, 155 aa, Festuca arundinacea
  misc_feature (152)..(152): Xaa can be any naturally occurring amino acid
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLALLQFYKVDDGTGKVTRLRKECPNAECGAGTFMANHFDRHYCGKCGLTYVYXQKA

SEQ ID NO: 5468 - protein, 155 aa, Panax ginseng
QIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5469 - protein, 156 aa, Vitis vinifera
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNSECGAGTFMANHFDRHYCGKCGLTYVYQKAGGD

SEQ ID NO: 5470 - protein, 156 aa, Ipomoea nil
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDESGKVQRLRKECPNAECGAGTFMANHFDRHYCGKCGLTYVYNKAGSD

SEQ ID NO: 5471 - protein, 156 aa, Actinidia deliciosa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKSGGD

SEQ ID NO: 5472 - protein, 155 aa, Lolium multiflorum
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLALLQFYKVDDGTGKVTRLRKECPNAECGAGTFMANHFDRHYCGKCGLTYVYNQKA

SEQ ID NO: 5473 - protein, 155 aa, Zea mays
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDTTSKVTRLRKECPNTECGAGVFMANHFDRHYCGKCGLTYVYNQKA

SEQ ID NO: 5474 - protein, 156 aa, Cucumis melo
MQIFVKTLTGKTITLEVESSDTIDNVKVKIQDKEGIPPDQQRLIFAGKQLEDGRTLADYNIQKESTLHLVLRLRGGAKKRKKKTYTKPKKIKHKKKKVKLSVLQFYKVDDSGKVQRLRKECPNAECGAGTFMANHFDRHYCGKCGLTYVYQKPGGD

SEQ ID NO: 5475 - protein, 156 aa, Nicotiana benthamiana
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECDAGTFMANHFDRHYCGKCGLTYVYQKAGGD

SEQ ID NO: 5476 - protein, 155 aa, Avena sativa
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLALLQFYKVDDATGKVTRLRKECPNAECGAGTFMANHFDRHYCGKCGLTYVYNLKA

SEQ ID NO: 5477 - protein, 156 aa, Elaeis guineensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVTRLRKECPNAECGAGTFMANHFDRHYCGKCGLTYVYQKAGGE

SEQ ID NO: 5478 - protein, 156 aa, Elaeis guineensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVTRLRKECPNAECGAGTFMANHFDRHYCGKCGLTYVYQKAGAE

SEQ ID NO: 5479 - protein, 156 aa, Capsicum annuum
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5480 - protein, 156 aa, Populus trichocarpa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQTAGGD

SEQ ID NO: 5481 - protein, 156 aa, Papaver somniferum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNSECGAGTFMANHFDRHYCGKCGLTYVYQQAGQE

SEQ ID NO: 5482 - protein, 231 aa, Brachypodium distachyon
MQIFVKTLTGKTITLEVESRDTIDNVKAKIQDKEGITPDQQRLIFSGKQLEDGRTMAKYNIQKESTLHLVLRLFGGMQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDSTGKVTRLRKECPNADCGAGTFMANHFDRHYCGKCGLTYVYNQKA

SEQ ID NO: 5483 - protein, 426 aa, Zea mays
MASTSSIGDVGASGSKGVACKTFPASANTSSSHQESHNVDAKSRVEDVWKKMNGGFPNKMPKPAMTKLSSTATEKKNKPTNNWMTVLGLSPSKACNSSQGSKNGLKWTQHETREDAKKLAAKALAAAKNAAAVASGRGKVEITEVRDFAVKDIEIKKLVDPNSKEAIEKAKAAGAAPSAVDSILEQIRKKQKLSVLDKTKKDWGEYKEENRGLEEELDAYKKSSNQYLDKQSFLQRTDYREFERERDARLSMMAKRRTDMREDDVKGPLTGTAFDPLHLPTGVPVPMCFCGNPCKVDKSEDHDTYRQKYWMCANYAFEPMIVQRRMNLMTPPPLCDFEQWIDTEISQKDKKWLENLKKWDAEDKERIEKRREELAAEQQWVDEQEMRRVVEYREKEKKLERARRAKDAVEENPDAFRKGKWPHCMQ

SEQ ID NO: 5484 - protein, 428 aa, Ceratodon purpureus
MAGLTHSLRLSALDQAVTASGELFKQSRQHDQRCRLPRSQRVMVRAASEGPDLSVVVNGLKLPNPFVIGSGPPGTNYTVMKRAFDEGWGGVIAKTVSLDSSKVVNVTPRYARLKASAVAGTKAEVIGWQNIELISDRPFETMLAEMKQLKEEYPDRILIASIMEEYNRDAWEEIIERVEETGVDAFEINFSCPHGMPERKMGMAMGQDCSVLGEVCGWINAKATIPVWAKMTPNITDITQPARTALHAGCEGVAAINTITSVMGINLDTLRPEPCVEGYSTPGGYSSKAVRPIALAKVMSIAQMMKAEFPGQDKSLSGIGGVETGNHAAEFILLGASTVQVCTGVMLHGYGHVKHLCTELQAFMDKHGFTSIEDFRGVSLEYFTTHADLVQRQKEATENKKKVRKGLASDKDWTGEGFVKETETMVSN

SEQ ID NO: 5485 - protein, 97 aa, Senecio madagascariensis
MQIFVKTLTGKTITLEVESSDTIDNVKTKIQDKEGIPPDQQRLIFAGKQLEDGRTLADYNIQKESTLHLVLRLRGGAKKGRRRHILNLRKSNINIGK

SEQ ID NO: 5486 - protein, 92 aa, Thalictrum flavum
MQIFVKTLTGKTITLEVESSDTIDNVKAKIQDKEGIPPDQQRLIFAGKQLEDGRTLADYNIQKESTLHLVLRLRGGAKKRKRRLTLSQRDQA

SEQ ID NO: 5487 - protein, 107 aa, Medicago truncatula
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFIS

SEQ ID NO: 5488 - protein, 117 aa, Quercus alba
MQIFVKTLTARPSPRGRVLRHHRQCEGQGPRQGRNPAGPAAPHLRRKAARGRPHPRRLQHPEGVDPPPRAPPPRRRQEAQEEDLHQAQEDQAQAQEGEARDPSVLQGGRFRKGPEAS

SEQ ID NO: 5489 - protein, 163 aa, Elaeis guineensis
  misc_feature (16)..(16): Xaa can be any naturally occurring amino acid
  misc_feature (45)..(45): Xaa can be any naturally occurring amino acid
HVLPYPLPLQALLGCXHHADLRENPHGGRQSPLRWSLPTQSRTSXPRSRTRRASPQISSASSSPESSSRMAGPSPTTTFRRSPPSTSSFVSAAAPRSARRRHIPSQRKSSTRRRRLSSPFSSSTKWMTLARSPASGRSAPTPSAVPGPSWPITSIATTAASAA

SEQ ID NO: 5490 - protein, 151 aa, Salvia sclarea
MQIFVKTLTGKTITLEVESSDTIDNVKAKIQDKEGIPPDQQRLIFAGKQLEDGRTLADYNIQKESTLHLVLRLRAKKRKKKTYTKPKKIKHKKKKVKLAVLQFYKVDDSGKVQRLRKECPNAECGAGTFMANHFDRHYCGKCGLTYVYNKT

SEQ ID NO: 5491 - protein, 156 aa, Amsonia hubrichtii
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNSECGAGTFMANHFDRHYCGKCGLTYVYNKAGGD

SEQ ID NO: 5492 - protein, 156 aa, Catharanthus roseus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDAGNVQRLRKECPNGDCGAGTFMANHFDRHYCGKCGLTYVYQKAGGD

SEQ ID NO: 5493 - protein, 156 aa, Gossypium hirsutum
MQIFVKTLTGKTITLEVESSDTIDNVKAKIQDKEGIPPDQQRLIFAGKQLEDGRTLADYNIQKESTLHLVLRLRGGAKKRKKKTYTKPKKMKHKKKKVKLAVLQFYKVDESGKVQRLRKECPNAECGAGTFMANHFDRHYCGKCGLTYVYQKAGGD

SEQ ID NO: 5494 - protein, 156 aa, Distylium racemosum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNQECGAGTFMANHFDRHYCGKCGCTYVYQKAGAE

SEQ ID NO: 5495 - protein, 156 aa, Unknown
  Sequence found in Organisms: Euphorbia peplus, Euphorbia esula
MQIFVKTLTGKTITLEVESSDTIDNVKAKIQDKEGIPPDQQRLIFAGKQLEDGRTLADYNIQKESTLHLVLRLRGGAKKRKKKTYIKPKKIKHKKKKVKLAVLQFYKVDDSGKVQRLRKECPNAECGAGTFMANHFDRHYCGKCGLTYVYNKAGGD

SEQ ID NO: 5496 - protein, 156 aa, Euphorbia peplus
MQIFVKTLTGKTITLEVESSDTIDNVKSKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKAGGD

SEQ ID NO: 5497 - protein, 156 aa, Euphorbia peplus
MQIFVKTLTGNPITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5498 - protein, 156 aa, Plantago ovata
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNGECGAGTFMANHFDRHYCGKCGLTYVYNKAGGE

SEQ ID NO: 5499 - protein, 156 aa, Platanus occidentalis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQKLRKECPNQECGAGTFMANHFDRHYCGKCGLTYVYQKAGGD

SEQ ID NO: 5500 - protein, 156 aa, Platanus occidentalis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQKLRKECPNQECGAGTFMANHFDRHYCGKCGLTYVYQKAGGE

SEQ ID NO: 5501 - protein, 155 aa, Silene vulgaris
QIFVKTLTGKTITLEVESSDTIDNVKTKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKAGGD

SEQ ID NO: 5502 - protein, 154 aa, Silene vulgaris
IFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5503 - protein, 156 aa, Tabernaemontana elegans
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLALLQFYKVDDSGKVQRLRKECPNAECGAGTFMANHFDRHYCGKCGLTYVYNKAGGD

SEQ ID NO: 5504 - protein, 156 aa, Taxus baccata
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNQECGAGTFMANHFDRHYCGKCGLTYVYQKAGAE

SEQ ID NO: 5505 - protein, 156 aa, Tripterygium wilfordii
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLALLQFYKVDDSGKVQRLRKECPNGECGAGTFMANHFDRHYCGKCGLTYVYQKAGGD

SEQ ID NO: 5506 - protein, 156 aa, Acacia harpophylla
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNTECGAGTFMANHFDRHYCGKCGTTYVYQKAGGD

SEQ ID NO: 5507 - protein, 156 aa, Antirrhinum majus
MQIFVKTLTGKTITLEIESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYNKAGGD

SEQ ID NO: 5508 - protein, 156 aa, Manihot esculenta
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVEDSGKVQRLRKECPNAECGAGTFMANHFDRHYCGKCGLTYVYNKAGGD

SEQ ID NO: 5509 - protein, 156 aa, Coffea canephora
MQIFVKTLTGKTITLEVESSDTIDNVKARIQDKEGIPPDQQRLIFAGKQLEDGRTLADYNIQKESTLHLVLRLRGGAKKRKKKTYTKPKKIKHKKKKVKLAVLQFYKVDDTGKVQRLRKECPNAECGAGTFMANHFDRHYCGKCGLTYVYNKAGGD

SEQ ID NO: 5510 - protein, 156 aa, Cycas rumphii
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQYYKVDDSGKVQRLRKECPNQECGAGTFMANHFDRHYCGKCGLTYVYQKAGAE

SEQ ID NO: 5511 - protein, 156 aa, Tropaeolum majus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKIEDSGKVQRLRKECPNAECGAGTFMANHFDRHYCGKCGLTYVYQKAGGD

SEQ ID NO: 5512 - protein, 156 aa, Tropaeolum majus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKIEDSGKVQRLRKECPNAECGAGTFMANHFDRHYCGKCGLTYVYQKAGAE

SEQ ID NO: 5513 - protein, 156 aa, Carica papaya
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYRVEDGGKVQRLRKECPNAECGAGTFMANHFDRHYCGKCGLTYVYQKAGGD

SEQ ID NO: 5514 - protein, 156 aa, Carica papaya
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKVKLPVLQFYKVDDSGKVQRLRKECPNAECGAGTFMANHFDRHYCGKCGMTYVYQKAGGD

SEQ ID NO: 5515 - protein, 156 aa, Salvia sclarea
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKTAGD

SEQ ID NO: 5516 - protein, 157 aa, Euphorbia esula
KTQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5517 - protein, 156 aa, Camellia sinensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAELQFYKVDDSGKVQRLRKEYPNAECGAGTFMANHFDRHYCGKCGLTYVYQKAGGD

SEQ ID NO: 5518 - protein, 153 aa, Tragopogon dubius
FVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSILQFYKVDDSGKVQRLRKECPNAECGAGTFMANHFDRHYCGKCGLTYVYQKAGGD

SEQ ID NO: 5519 - protein, 155 aa, Catharanthus roseus
MQIFVKTLTGKTITLEVESSDTIDNVKAKIQDKEGIPPDQQRLIFAGKQLEEGRTLADYNIQKESTLHLVLRLRGGAKKRKKKTYTKPKKIKHKKKKVKLAVLQFYKVDDTGKVQRLRKECPNAECGAGTFMANHFDRHYCGKCGLTYVYNKGGD

SEQ ID NO: 5520 - protein, 155 aa, Acacia harpophylla
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGTTYVYNKGGD

SEQ ID NO: 5521 - protein, 155 aa, Festuca arundinacea
  misc_feature (50)..(50): Xaa can be any naturally occurring amino acid
MQIFVKTLTGKTITLEVESSDTIDNVKAKIQDKEGIPPDQQRLIFAGKQXEDGRTLADYNIQKESTLHLVLRLRGGAKKRKKKTYTKPKKQKHKHKKVKLALLQFYKVDDSTGKVTRLRKECPNAECGAGTFMANHFDRHYCGKCGLTYVYNQKA

SEQ ID NO: 5522 - protein, 155 aa, Medicago truncatula
MQIFVKTLTGKTITLEVESSDTIDNVEAKIQDKEGIPPDQQRLIFAGKQLEDGRTLADYNIQKESTLHLVLRLRGGAKKRKKKTYTKPKKIKHKKKKVKLAVLQYYKVDDSGKVQRLRKECPNQECGAGTFMANHFDRHYCGKCGLTYVYQKAEA

SEQ ID NO: 5523 - protein, 90 aa, Ceratodon purpureus
MQIFVKTLTGKTITLEVESSDTIDNVKTKIQDKEGIPPDQQRLIFAGKQLEDGRTLADYNIQKESTLHLVLRLRGGAKKRKKKPTPSRRS

SEQ ID NO: 5524 - protein, 159 aa, Malus domestica
RCCRQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYQKAGGD

SEQ ID NO: 5525 - protein, 155 aa, Cephalotaxus harringtonia
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKIKLAVLQYYKVDDSGKVQRIRKECPNQECGAGTFMANHFDRHYCGKCGLTYVYQKAEA

SEQ ID NO: 5526 - protein, 155 aa, Cephalotaxus harringtonia
MQIFVKTLTGKTITLEVESSDTIDNVKAKIQDKEGIPTDQQRLIFAGKQLEDGRTLADYNIQKESTLHLVLRLRGGAKKRKKKTYTKPKKIKHKKKKIKLAVLQYYKVDDSGKVQRLRKECPNQECGAGTFMANHFDRHYCGKCGLTYVYQKAEA

SEQ ID NO: 5527 - protein, 156 aa, Pseudotsuga menziesii
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLAVLQYYKVDDSGKVQRLRKECPNQECGAGTFMANHFDRHYCGKCGLTYVYQKAAAE

SEQ ID NO: 5528 - protein, 156 aa, Sciadopitys verticillata
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKVKLAVLQYYKVDDSGKVQRLRKECPNQECGAGTFMANHFDRHYCGKCGLTYVYQKAGAE

SEQ ID NO: 5529 - protein, 156 aa, Zostera marina
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVVRLRKECPNGECGAGTFMANHFDRHYCGKCGMTYVYSKAGEE

SEQ ID NO: 5530 - protein, 156 aa, Amborella trichopoda
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLPVLQFYKVDDSGKVQKLRKECPNQECGAGTFMANHFDRHYCGKCGLTYVYQKAGAE

SEQ ID NO: 5531 - protein, 156 aa, Aquilegia formosa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKLAKLRKECPNAECGAGTFMANHFDRHYCGKCGLTYVYQKAGGE

SEQ ID NO: 5532 - protein, 156 aa, Ocimum basilicum
MQIFVKTLTGKTITLEVESSDTIDNVKAKIQDKEGIPPDQQRLIFAGKQLEDGRTLADYNIQKEWTLHLVLRLRGGAKKRKKKTYTKPKKIKHKKKKVKLPLLQFYKVDDSGKVQRLRKECPNAECGAGTFMANHFDRHYCGKCGLTYVYNKAGGD

SEQ ID NO: 5533 - protein, 156 aa, Beta vulgaris
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLPVLQFYKVSDSAKIQRLRKECPNAECGAGTFMANHFDRHYCGKCGLTYVYQKAGGD

SEQ ID NO: 5534 - protein, 156 aa, Manihot esculenta
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVEDSGKVQRLRKECPNSECGAGTFMANHFDRHYCGKCGLTYVYNKAGGD

SEQ ID NO: 5535 - protein, 156 aa, Liriodendron tulipifera
MQIFVKTLTGKTITLEVESSDSIDTVKSKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGE

SEQ ID NO: 5536 - protein, 156 aa, Mimulus guttatus
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLSVLQYYKIDDSGKVQRLRKECPNAECGAGTFMANHFDRHYCGKCGLTYVYAKAGGD

SEQ ID NO: 5537 - protein, 156 aa, Physcomitrella patens
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQFYKVDDSGKVQRLRKECPNPECGAGTFMANHFDRHYCGKCGLTYVYQKAGAE

SEQ ID NO: 5538 - protein, 155 aa, Physcomitrella patens
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQFYKVDDSGKVQRLRKECPNPDCGAGTFMANHFDRHYCGKCGLTYVYQKAEA

SEQ ID NO: 5539 - protein, 155 aa, Physcomitrella patens
MQIFVKTLTGKTITLEVESSDTIDNVKSKIQDKEGIPPDQQRLIFAGKQLEDGRTLADYNIQKESTLHLVLRLRGGAKKRKKKTYTKPKKLKHKKKKVKLAVLQFYKVDDSGKVQRLRKECPNPDCGAGTFMANHFDRHYCGKCGLTYVYQKAEA

SEQ ID NO: 5540 - protein, 156 aa, Rhizophora mangle
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKRKKVKLAVLQFYKVDDSGKVHKLRKECPNAECGAGTFMANHFDRHYCGKCGLTYVYNKAGGD

SEQ ID NO: 5541 - protein, 156 aa, Rosa hybrid cultivar
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQKLRKECPNAECVAWTFMANHFDRHYCGKCGLFYVYQKAGGD

SEQ ID NO: 5542 - protein, 155 aa, Picea glauca
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLAVLQYYKVDDSGKVQRLRKECPNQECGAGTFMANHFDRHYCGKCGLTYVYQKGAE

SEQ ID NO: 5543 - protein, 156 aa, Tamarix hispida
MQIFVKTLTGKTITLEVESSDTIDNVKAKIQDKEGIPPDQQRLIFAGKQLEDGRTLADYNIQKESTLHLVLRLRGGAKKRKKKTYTKLKKIKHKHKKVKLAVLQFYKVDDSGKLNRLRKECPNSECGAGTFMANHFDRHYCGKCGLTYVYQKAGGD

SEQ ID NO: 5544 - protein, 156 aa, Triphysaria pusilla
MQIFVKTLTGKTITLEVEPSDTIDNVKAKIQDKEGIPPDQQRLIFAGKQLEDGRTLGDYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKAGGD

SEQ ID NO: 5545 - protein, 85 aa, Fragaria vesca
LRRCQDADLRENPNGEDDHVGGGVLRHHRQCEGQDPRQGGHPAGPATPYLRRKIARGRPDSRRLQHPEGVDSPPGAPPPRWRQEA

SEQ ID NO: 5546 - protein, 184 aa, Catharanthus roseus
QRIRHEAACRSYNFRTLNPFVLTSGSKEFGTRVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDAGNVQRLRKECPNGDCGAGTFMANHFDRHYCGKCGLTYVYQKAGGD

SEQ ID NO: 5547 - protein, 109 aa, Pisum sativum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQILQGR

SEQ ID NO: 5548 - protein, 153 aa, Adiantum capillus-veneris
MQIFVKTLTGKTITLEVESSDTIVNVKTKIQDKEGIPPDQQRLIFAGKQLEDGRTLADYNIQKESTLHLVLRLRGGAKKRKKKTYTKPKKLKHKKKKVKLAALQFYKVDDSGKVQRLRKECPNGECGAGTFMANHHDRHYCGKCGLTYVYQKA

SEQ ID NO: 5549 - protein, 156 aa, Abies balsamea
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQYYKVDDSGKVQRLRKECPNQECGAGTFMANHFDRHYCGKCGLTYVYQKAGAE

SEQ ID NO: 5550 - protein, 156 aa, Cedrus atlantica
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQYYKVDDSGKVQRLRKECPNQECGAGTFMANHFDRHYCGKCGLTYVYQKAAAE

SEQ ID NO: 5551 - protein, 156 aa, Ceratodon purpureus
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQFYKVDDSGKVQRLRKECPNPDCGAGTFMANHFDRHYCGKCGLTYVYQKAGAE

SEQ ID NO: 5552 - protein, 156 aa, Primula obconica
MQIFVKTLTGKTITLEVESSDTIDNVKSKIQDKEGIPPDQQRLIFAGKQLDDGRTLADYNIQKESTLHLVLRLRGGAKKRKKKTYTKPKKIKHKKKKVKLSVLQFYKVDDSGKVQRLRKECPTPECGAGTFMANHFDRHYCGKCGLTYVYQKPGGD

SEQ ID NO: 5553 - protein, 156 aa, Sciadopitys verticillata
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKIKLAVLQYYKVDDSGKVQRLRKECPNQECGAGTFMANHFDRHYCGKCGLTYVYQKAGGE

SEQ ID NO: 5554 - protein, 157 aa, Unknown
  Sequence found in Organisms: Brassica napus, Arabidopsis lyrata, Brassica juncea, Brassica oleracea, Brassica rapa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGGEA

SEQ ID NO: 5555 - protein, 157 aa, Arabidopsis thaliana
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAQE

SEQ ID NO: 5556 - protein, 156 aa, Artemisia annua
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVGDDGKVMRLRKECPNAECGAGTFMASHKDRHYCGKCGLTYVYQKAGGD

SEQ ID NO: 5557 - protein, 157 aa, Unknown
  Sequence found in Organisms: Brassica napus, Brassica juncea, Brassica oleracea, Brassica rapa, Raphanus sativus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAEA

SEQ ID NO: 5558 - protein, 157 aa, Curcuma longa
MQIFVKTLTGKTITLEVESSDTIDNVKAKIQDKEGIPPDQQRLIFAGKQLDDGRTLADYNIQKESTLHLVLRLRGGAKKRKKKTYTKPKKIKHKKKKVKLAVLQFYKVDDATGKVTRLRKECPNTECGAGTFMANHFDRHYCGKCGLTYVYNKAGAE

SEQ ID NO: 5559 - protein, 156 aa, Liriodendron tulipifera
MQIFVKTLTGKTITLEVESSDSIDTVKSKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNTECGAGTFMANHFDRHYCGKCGLTYVYQKAGGE

SEQ ID NO: 5560 - protein, 156 aa, Mimulus guttatus
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLSVLQYYKIDDSGKVQRLRKECPNAECGAGTFMANHFDRHYCGKCGLTYVYAKTAGD

SEQ ID NO: 5561 - protein, 156 aa, Picea glauca
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLAVLQYYKVDDSGKVQRLRKECPNQDCGAGTFMANHFDRHYCGKCGLTYVYQKAAAE

SEQ ID NO: 5562 - protein, 156 aa, Triphysaria pusilla
MQVFVKTLTGKTITLEVEPSDTIDNVKSKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKAGES

SEQ ID NO: 5563 - protein, 156 aa, Zamia vazquezii
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKIKLAVLQYYKVDDSGKVQRLRKECPNQECGAGTFMANHFDRHYCGKCGLTYVYQKAGAE

SEQ ID NO: 5564 - protein, 144 aa, Arnica chamissonis
GKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5565 - protein, 155 aa, Pseudotsuga menziesii
MQIFVKTLTGKTITLEVEASDTIDNVKAKIQDKEGIPPDQQRLIFAGKQLEDGRTLADYNIQKESTLHLVLRLRGGAKKRKKKTYTKPKKLKHKKKKVKLAVLQYYKVDDSGKVQRLRKECPNQECGAGTFMANHFDRHYCGKCGLTYVYQKGAE

SEQ ID NO: 5566 - protein, 155 aa, Selaginella moellendorffii
MQIFVKTLTGKTITLEVESSDTIDNVKTKIQDKEGIPPDQQRLIFAGKQLEDGRTLADYNIQKESTLHLVLRLRGGGKKRKKKTYTKPKKIKHKKKKVKLAVLQYYKVDDSGKVNRLRKECPNPECGAGTFMANHFDRHYCGKCGLTYVYQKAEA

SEQ ID NO: 5567 - protein, 145 aa, Pisum sativum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGLLWRITLIVTTVASVV

SEQ ID NO: 5568 - protein, 62 aa, Artemisia annua
MRKAATAKKVAPSGSPWYGPDRVKYLGPFSGEAPSYLTGEFPGDYGWDTFLLTQRLLPRTVS

SEQ ID NO: 5569 - protein, 157 aa, Zostera marina
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVVRLRKECPNAECGAGTFMANHFDRHYCGKCGMTFVYSNAAGVD

SEQ ID NO: 5570 - protein, 157 aa, Arabidopsis lyrata
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKIDGSGKVQRLRKECPNATCGAGTFMASHFDRHYCGKCGLTYVYQKEGGDE

SEQ ID NO: 5571 - protein, 157 aa, Arabidopsis thaliana
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKIDGSGKVQRLRKECPNATCGAGTFMASHFDRHYCGKCGLTYVYQKEGVEA

SEQ ID NO: 5572 - protein, 157 aa, Zingiber officinale
  misc_feature (51)..(51): Xaa can be any naturally occurring amino acid
MQIFVKTLTGKTITLEVESSDTIDNVKAKIQDKEGIPPDQQRLIFAGKQLXDGRTLADYNIQKESTLHLVLRLRGGAKKRKKKTYTKPKKIKHKKKKVKLAVLQYYKVDDGTGKVTRLRKECPNAECGAGTFMANHFDRHYCGKCGLTYVYNKAGAE

SEQ ID NO: 5573 - protein, 157 aa, Thellungiella halophila
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDGSGKVQRLRKECPNATCGAGTFMASHFDRHYCGKCGLTYVYQKEGGEE

SEQ ID NO: 5574 - protein, 157 aa, Thellungiella halophila
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDGSGKVQRLRKECPNATCGAGTFMASHFDRHYCGKCGLTYVYQKEGAEE

SEQ ID NO: 5575 - protein, 155 aa, Abies balsamea
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKVKLAVLQYYKVDDSGKVQKLRKECPNQDCGAGTFMANHFDRHYCGKCGLTYVYQKGAE

SEQ ID NO: 5576 - protein, 156 aa, Centaurea maculosa
GGPKADLRETLTGKTITLEVESSDTIDNVKSKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5577 - protein, 151 aa, Eucalyptus grandis
KTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5578 - protein, 156 aa, Linum usitatissimum
MQIFVKTLTGKTITLEVESSDTIDNVKAKIQDKEGIPPDQQRLIFAGKQLEDGRTLADYNIQKESTLHLVLRLRGGAKKRKKKVFTKPKKIKHKKKKVKLAVLQFYKVEDSGKVQRLRKECPNAECGAGTFMANHFDRHYCGKCGMTYVYNKAGSD

SEQ ID NO: 5579 - protein, 156 aa, Marchantia polymorpha
  misc_feature (151)..(151): Xaa can be any naturally occurring amino acid
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKVKLAVLQYYKVDDSGKVQRLRKECPTPECGAGTFMANHFDRHYCGKCGLTYVYXKAGGE

SEQ ID NO: 5580 - protein, 147 aa, Heritiera littoralis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNPECGAGTFMANHFDRHYCGKCGMT

SEQ ID NO: 5581 - protein, 160 aa, Euphorbia peplus
SVCKDAIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGD

SEQ ID NO: 5582 - protein, 157 aa, Cleome gynandra
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDGSGKVQRLRKECPNTTCGAGTFMASHFDRHYCGKCGLTYVYQKEGGDE

SEQ ID NO: 5583 - protein, 155 aa, Cleome spinosa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSNKVQRLRKECPNCGAGTFMASHFDRHYCGKCGLTYVYQKDGGDE

SEQ ID NO: 5584 - protein, 157 aa, Raphanus sativus
  misc_feature (62)..(62): Xaa can be any naturally occurring amino acid
  misc_feature (116)..(116): Xaa can be any naturally occurring amino acid
MQIFVKTLTGKTITLEVESSDTIDNVKAKIQDKEGIPPDQQRLIFAGKQLEDGRTLADYNIXKESTLHLVLRLRGGAKKRKKKTYTKPKKIKHKHKKVKLAVLQFYKVDGSGKVQXLRKECPNATCGAGTFMASHFDRHYCGKCGLTYVYQKEGAEA

SEQ ID NO: 5585 - protein, 155 aa, Cedrus atlantica
MQIFVKTLTGKTITLEVEASDTIDNVKTKIQDKEGIPPDQQRLIFAGKQLEDGRTLADYNIQKESTLHLVLRLRGGAKKRKKKTYTKPKKLKHKKKKVKLAVLQYYKVDDSGKVQKLRKECPNQECGAGTFMANHFDRHYCGKCGLTYVYQKGAE

SEQ ID NO: 5586 - protein, 155 aa, Pinus pinaster
MQIFVKTLTGKTITLEVEASDTIDNVKAKIQDKEGIPPDQQRLIFAGKQLEDGRTLADYNIQKESTLHLVLRLRGGAKKRKKKTYTKPKKLKHKKKKIKLAVLQYYKVDDSGKVKRLRKECPNQECGAGTFMANHFDRHYCGKCGLTYVYQKGDE

SEQ ID NO: 5587 - protein, 156 aa, Podocarpus macrophillus
MQIFVKTLTGKTITLEVESSDTIDNVKAKIQDKEGIPPDQQRLIFAGKQLEDGRTLADYNIQKESTLHLVLRLRGGAKKRKKKTYTKPKKLKHKKKKIKLAVLQYYKVDDSGKVQRLRKECPNQECGAGTFMANHFDRHYCGKCSLTYVYSKAGAA

SEQ ID NO: 5588 - protein, 156 aa, Podocarpus macrophillus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKIKLAVLQYYKVDDSGKVQRLRKECPNQECGAGTFMANHFDRHYCGKCSLTYVYSKGGAN

SEQ ID NO: 5589 - protein, 156 aa, Marchantia polymorpha
MQIFVKTLTGKTITLEVESSDTIDNVKTKIQDKEGIPPDQQRLIFAGKQLEDGRTLADYNIQKESTLHLVLRLRGGAKKRKKKTYTKPKKIKHKKKKVKLAVLQYYKVDDSGKVHRLRKECPTPECGAGTFMANHHDRHYCGKCGLTYVYQKAGAE

SEQ ID NO: 5590 - protein, 154 aa, Mesostigma viride
MQIFVKTLTGKTITLEVESSDTIDNVKAKIQDKEGIPPDQQRLIFAGKQLEDGRTLADYNIQKESTLHLVLRLRGGAKKRKKKTYTKPKKNKHKKKKVKLAVLQYYKVDDSGKVQRLRKECPNPDCGAGCFMASHKDRHYCGKCGLTYVYQKGE

SEQ ID NO: 5591 - protein, 98 aa, Gnetum gnemon
MQIFVKTLTGKTITLEVESFGHDRQCEGEDSGQGGHSAGSAEADFRRKAAGGRQDSCGLQYPEGVDSSSGSQAPGRCEEAQEEDLHQAQEDQAQEEEG

SEQ ID NO: 5592 - protein, 159 aa, Cichorium intybus
GGHIRRNADLRETLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5593 - protein, 159 aa, Cynara scolymus
  misc_feature (2)..(2): Xaa can be any naturally occurring amino acid
IXARSDLRQTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKAGGD

SEQ ID NO: 5594 - protein, 156 aa, Distylium racemosum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKIKLAVLQFYKVDDSGKIQRLRKECPNQECSAGTFMANHFDRHYCGKCGLTYVFNSAAAA

SEQ ID NO: 5595 - protein, 156 aa, Pinus taeda
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQYYKVDDSGKVKRLRKECPNQECGAGTFMANHFDRHYCGKCGLTYVYKTAGEE

SEQ ID NO: 5596 - protein, 157 aa, Cleome gynandra
MQIFVKTLTGKTITLEVESSDTIDNVKAKIQDKEGIPPDQQRLIFAGKQLEDGRTLADYNIQKESTIHLVLRLRGGAKKRKKKTYTKPKKIKHKKKKVKLAVLQFYKVDGSGKVQRLRKECPNSTCGAGTFMASHFDRHYCGKCGLTYVYQKDGGDE

SEQ ID NO: 5597 - protein, 150 aa, Jatropha curcas
TLTGKTITLEVESSDTIDNVKAKIQDKEGIPPDQQRLIFAGKQLEDGRTLADYIIQKESTLHLVLRLRGGAKKRKKKTYTKPKKIKHKKKKVKLAVLQFYKVDDSGKVQRLRKECPNAECGAGTFMANHFDRHYCGKCGLTYVYQKAGGE

SEQ ID NO: 5598 - protein, 155 aa, Pinus taeda
MQIFVKTLTGKTITLEVEASDTIDNVKAKIQDKEGIPPDQQRLIFAGKQLEDGRTLADYNIQKESTLHLVLRLRGGAKKRKKKTYTKPKKLKHKKKKIKLAVLQYYKVDDSGKVKRLRKECPNLECGAGTFMANHFDRHYCGKCGLTYLYQKGDE

SEQ ID NO: 5599 - protein, 156 aa, Pinus pinaster
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQYYKVDDSGKVKRLRKECPNQECGAGTFMANHFDRHYCGKCGLTYLYKTAGEE

SEQ ID NO: 5600 - protein, 150 aa, Lippia dulcis
TLTGKTITLEVESSDTIDNVKAKIQDKEGIPPDQQRLIFAGKQLEDGRTLADYNIQKESTLHLVLRLRGGAKKRKKKTYTKPKKIKHKKKKVKLPVLQFYKVDDSGKVQRLRKECPNAECGAGTFMANHFDRHYCGKCGLTYVYNTAGGD

SEQ ID NO: 5601 - protein, 156 aa, Tripterygium wilfordii
MQIFVKTLTGKTITLEVESSDTIDNVKAKIQDKEGIPPDQQRLIFAGKQLEDGRTLADYNIQKESTLHLVLRLRGGAKKRKKKSYTKPKKIKHIKKKVKLAALQFYKIDDSGKVQRLRKECPNGDCGAGTFMANHFDRHYCGKCGLAYVYQKTGGD

SEQ ID NO: 5602 - protein, 156 aa, Arabidopsis lyrata
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPSVSCGPGTFMASHFDRHYCGKCGTTYVFKKADEE

SEQ ID NO: 5603 - protein, 156 aa, Raphanus sativus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPSASCGPGTFMASHFDRHYCGKCGTTYVFKKPDEE

SEQ ID NO: 5604 - protein, 136 aa, Setaria italica
MQIFVKTLTGKTITLEVESIDNVKAKIQDKEGIPPDQQRLIFAGKQLEDGRTLADYNIQKESTLHLVLRLRGGAKKRKKKTYTKPKKIKHKHTRRAPVLQGRRRHRQGYPPPQGMPQRRVRRGNLHGQPLRPPLLR

SEQ ID NO: 5605 - protein, 158 aa, Taxus baccata
MVQDADFRETLTGKTITLEVESSDTIDNVKAKIQDKEGIPPDQQRLIFAGKQLEDGRTLADYNIQKESTLHLVLRLRGGAKKRKKKTYTKPKKIKHKKKKIKLSVLQYYKVDDSGKVQRLRKECPNQECGAGTFMANHFDRHYCGKCGLTYVYQKAEA

SEQ ID NO: 5606 - protein, 157 aa, Aquilegia formosa
MQIFVKTLTGKTITLEVEASDTIDNVKTKIQDKEGIPPYQQRLIFAGKQLEDGRTLADYNIQKESTLHLVLRLRGGAKKRKKKTYTKPKKIKHMKKKVKLAVLQFYKVDDLNGKVEKLRKECPNGDCGAGTFMANHFDRHYCGKCGLTYVYQKAGGD

SEQ ID NO: 5607 - protein, 156 aa, Unknown
  Sequence found in Organisms: Brassica juncea, Raphanus sativus, Thellungiella halophila
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGTGKVQRLRKECPSVSCGPGTFMASHFDRHYCGKCGTTYVFKKPDEE

SEQ ID NO: 5608 - protein, 156 aa, Unknown
  Sequence found in Organisms: Brassica napus, Brassica rapa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPSVSCGPGTFMASHFDRHYCGKCGTTYVFKKPDEE

SEQ ID NO: 5609 - protein, 156 aa, Brassica napus
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPSVSCGPGTFMASHFDRHYCGKCGTTYVFKKPGEE

SEQ ID NO: 5610 - protein, 163 aa, Ipomoea batatas
MQIFVKTLTGKTITLEVESSDTIDNVKAKIQEKEGIPPDQQRLIFAGKQLEDGRTLADYNIQKESTLHLVLRLRGGAKKRKKKTYTKPKKIKHKHKKVKLAVLQFYKVDESGKVQRLRKECPNAECGAGTFMANHFDRHYCGKCGLTYVYIKLVPIDRSSIHL

SEQ ID NO: 5611 - protein, 156 aa, Antirrhinum majus
DADLRETLTGKTITLEVESSDTIDNVKAKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYNKAGAD

SEQ ID NO: 5612 - protein, 156 aa, Arabidopsis thaliana
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHTHKKVKLAVLQFYKVDGSGKVQRLKKECPSVSCGPGTFMASHFDRHYCGKCGTTYVFKKADEE

SEQ ID NO: 5613 - protein, 144 aa, Lactuca sativa
ITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKAGGD

SEQ ID NO: 5614 - protein, 148 aa, Orobanche aegyptiaca
TGKTITLEVESSDTIDNVKTKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYNKAGGD

SEQ ID NO: 5615 - protein, 145 aa, Unknown
  Sequence found in Organisms: Citrus clementina, Citrus sinensis
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMASHFDRHYCEFVP

SEQ ID NO: 5616 - protein, 159 aa, Elaeis guineensis
MQIFVKTLTGKTITLEVESSDTIDNVKSKIQDKEGIPPDQQRLIFAGKQLEDGRTLADYNIQKESTLHLVLRLRGGAKKRKKKTYTKPKKINHKKKKVKLPVLQFYKIDDSGKVTRLRKECPNAECGAGTFMANYFDRHYCGKCGLNVYQKAGGFLDVC

SEQ ID NO: 5617 - protein, 141 aa, Cichorium intybus
MTLEVESSYTIDNVKSKIQDKEGIPPDQQRLIFPGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5618 - protein, 148 aa, Zamia vazquezii
TGKTITLEVESSDTIDNVKAKIQDKEGIPPDQQRLIFAGKQLEDGRTLADYNIQKESTLHLVLRLRGGAKKRKKKTYTKPKKIKHKKKKIKLAVLQYYKVDDSGKVNRLRKECPNQECGAGTFMANHFDRHYCGKCGLTYVYQKAGGE

SEQ ID NO: 5619 - protein, 143 aa, Artemisia annua
KTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVGEDGKVNRLRKECPNAECGAGTFMANHENRHYCGKCGLTYLYQKA

SEQ ID NO: 5620 - protein, 156 aa, Cleome spinosa
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHTKKKVKLAVLQFYKVDGSCKVQRLRKECPSVGCGPGTFMASHFDRHYCGKCGTTYAFKAPADE

SEQ ID NO: 5621 - protein, 156 aa, Hordeum vulgare
MQIFVKTLTGKTITLEVESFDTIDNVKAKIQDMEGIPPDQQRLIFAGKQLEHGRTLADYNIQKESTLHLVLRLTGGAKNMKKNTYTKPKKMKHKTKNVKLAVLQFYNVDESWKVQRLRKECPNAECGAGTFMANHFDGHYCGECGLTYLYQKAGGD

SEQ ID NO: 5622 - protein, 141 aa, Avena sativa
WRLSLPTPSTTSRPRSRTRRASPRTQQRLIFAGKQLEDGRTLADYNIQKESTLHLVLRLRGGAKKRKKKTYTKPKKQKHKHKKVKLALLKFYKVDDATGKVTRLRKECPNAECGAGTFMANHFDRHYCGKCGLTYVYNQKA

SEQ ID NO: 5623 - protein, 153 aa, Silene vulgaris
MQIFVKTLTGKTITLEVEPSDTIDNVKAKIQDKEGIPPDQQRLIFAGKQLEDGRTLSDYNIQKESTLHLVLRLRGGAKKRKKKAYTTPKKIKHKRKKVKLAVLKYYKVDENGKITRLRRECPNELCGAGVFMANHKDRQYCGKCGLTYVFKKD

SEQ ID NO: 5624 - protein, 165 aa, Pteridium aquilinum
MQIFVKTLTGKTITLEVESSDTIDNVKTKIQDKEGIPPDQQRLIFAGKQLEDGRTLADYNIQKESTLHLVLRLRGGAKKRKKKTYTKPKKLKHKKKKVKLAVLQFYKVDDSGKVQRLRKECPNAECGAGTFMANHHDRHYCGKCGLTYSLPEGLIMCMSWSLVFI

SEQ ID NO: 5625 - protein, 116 aa, Arachis hypogaea
MQIFVKTLTGKTITLEVESSDTIENVKQKIQDKEGIPPDQQRLIFAGKQLEDGRTLADYNIQKESTLHLVLRLRGGGKRERRRSTPSQRRTSTRRRRSSSLFSNTTRSTKTARSLD

SEQ ID NO: 5626 - protein, 150 aa, Mesembryanthemum crystallinum
MQIFVKTLTGKTITLDVEPSDSIDNVKQKIQDKEGIPPDQQRLIFAGKQLEDGRTLSDYNIQKESTLHLVLRLRGGGKKRKKKTYTKPKKIKHKHKKVKLAVLKFYKVDDNGKISRLRKECPQCGAGVFMATHFDRHYCGKCHVTYQFQN

SEQ ID NO: 5627 - protein, 173 aa, Cichorium intybus
FRARGPSCRNFGHGHGSGGKCRSSVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLSVLQFYKVDDSGKVQRLRKECPNAECGAGTFMANHFDRHYCGKCGLTYVYQKA

SEQ ID NO: 5628 - protein, 139 aa, Castanea mollissima
ESSDTIDNVKAKIQDKEGIPPDQQRLIFAGKQLEDGRTLADYNIQKESTLHLVLRLRGGAKKRKKKTYTKPKKIKHKHKKVKLAILQFYKVDDSGKVQRLRKECPNAECGAGTFMANHFDRHYCGKCGLTYVYQKAGGD

SEQ ID NO: 5629 - protein, 156 aa, Vigna unguiculata
MQIFVKTLTGKTITLEVESSDTIDNVKQKIQDKEGIPPDQQRLIFAGKQLEDGRTLADYNIQKESTLHLVLRLRGGAKKKKKKVYTKPKKIPHKKKKVKLHVLKFYKVDDDGKIGRLRRECPSPSCGGGTFMASHFDRQYCGKCGLTYVYNNKGSE

SEQ ID NO: 5630 - protein, 151 aa, Olea europaea
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKGQARCPPVLTRSTTPERSRGCGRSVPMPSAGRGTSRDTFSLRTDDLTLRWVTVT

SEQ ID NO: 5631 - protein, 143 aa, Helianthus annuus
VLVPGIRPLRPGIDNVKAKIQDKEGIPPDQQRLIFAGKQLEDGRTLADYNIQKESTLHLVLRLRGGAKKRKKKTYTKPKKIKHKHKKVKLSVLQFYKVDDAGKVQRLRKECPNAECGAGTFMANHFDRHYCGKCGLTYVYQKA

SEQ ID NO: 5632 - protein, 150 aa, Avena sativa
MQIFVKTLTGKTITLDVEPSDSIDNVKQKIQDKEGIPPDQQRLIFAGKQLEDGRTLSDYNIQKESTLHLVLRLRGGGKKRKKKVYTKPKKISHKHKKVKLAVLKFYKVDDNGKISRLRKECPQCGAGIFMATHFDRHYCGKCHVTYQFQK

SEQ ID NO: 5633 - protein, 167 aa, Pinus taeda
RAEFGTRQIFVKTLTGKTITLEVESSDTIENVKQKIQDKEGIPPDQQRLIFAGKQLEDGRTLADYNIQKESTLHLVLRLRGGAKKRKKKVYTKPKKAHHKKKKVKLAVLKYYKVDDNGKITRLRRECPSAQCGAGVFMAIHFDRQYCGKCGLTYVFKNEKGEAADEE

SEQ ID NO: 5634 - protein, 157 aa, Silene vulgaris
MQIFVKTLTGKTITLEVESSDTIDNVKQKIQDKEGIPPDQQRLIFAGKQLEDGRTLADYNIQKESTLHLVLRLLGAGKKRKKKTYTKPKKIKHKKKKSKLAVLKYYKVDDSLKITRLRRECPNAECGPGTFMAAHFDRQYCGKCGLTYVFNKPAAKA

SEQ ID NO: 5635 - protein, 143 aa, Brassica juncea
LEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAEA

SEQ ID NO: 5636 - protein, 154 aa, Silene vulgaris
MQIFVKTLTGKTITLEVESSDTIDNVKAKIQDKEGIPPDQQRLIFAGKQLEDGRTLSDYNIQKESTLHLVLRLRGGAKKKKKKTYTTPKKIPHKRKKVKLAVLKYYKVDGGKVTRLRRECPNESCGAGVFLANHKDRQYCGRCRLTYVNKQAAE

SEQ ID NO: 5637 - protein, 160 aa, Theobroma cacao
  misc_feature (32)..(32): Xaa can be any naturally occurring amino acid
  misc_feature (86)..(86): Xaa can be any naturally occurring amino acid
  misc_feature (93)..(93): Xaa can be any naturally occurring amino acid
  misc_feature (96)..(96): Xaa can be any naturally occurring amino acid
  misc_feature (120)..(121): Xaa can be any naturally occurring amino acid
  misc_feature (123)..(123): Xaa can be any naturally occurring amino acid
  misc_feature (137)..(137): Xaa can be any naturally occurring amino acid
  misc_feature (144)..(144): Xaa can be any naturally occurring amino acid
  misc_feature (160)..(160): Xaa can be any naturally occurring amino acid
MIFVKTLTGKTITLEVESSDTIDNVKAKIQDXEGIPPDQQRLIFAGKQLEDGRTLADYNIQKESTLHLVLRLRGGAKKRKKKTYTXPKKIKHXKKXVKLAVLQFYKVDEIREGSKVEEKXXLXRSVGPGNVHWLTIXNRPFLRXSGGLTLPFTKKGRWGX

SEQ ID NO: 5638 - protein, 141 aa, Tamarix hispida
  misc_feature (32)..(32): Xaa can be any naturally occurring amino acid
  misc_feature (38)..(38): Xaa can be any naturally occurring amino acid
  misc_feature (51)..(51): Xaa can be any naturally occurring amino acid
  misc_feature (56)..(56): Xaa can be any naturally occurring amino acid
  misc_feature (78)..(78): Xaa can be any naturally occurring amino acid
  misc_feature (101)..(101): Xaa can be any naturally occurring amino acid
  misc_feature (115)..(115): Xaa can be any naturally occurring amino acid
  misc_feature (117)..(117): Xaa can be any naturally occurring amino acid
  misc_feature (119)..(119): Xaa can be any naturally occurring amino acid
MQIFVKTLTGKTITLEVESSDTIENVKAKIQXKEGIPXDQQRLIFAGKQLXDGRTXADYNIQKESTLHLVLRLRGGAXKRKKKTYTKPKKIKHKHKKVKLXVLQFYKVDDSGKLXRXRXECPNSECGAGTFMANHFDRHYC

SEQ ID NO: 5639 - protein, 154 aa, Pinus taeda
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDGDGKVERLRRECPTPECGASTFMASHTDRQYCGKCHLTYVFDQSK

SEQ ID NO: 5640 - protein, 154 aa, Triticum aestivum
MQIFVKTLTGKTITLEVESSDTIDNVKSKIQDKEGIPPDQQRLIFAGKQLEDGRTLSDYNIQKESTLHLVLRLRGGAKKRKKKVYTTPKKIKHKRKKTKLAVLKYYKVDGDGKIERLRRECPQAECGAGVFMAAMHNRQYCGKCHLTYVFDEAK

SEQ ID NO: 5641 - protein, 161 aa, Hordeum vulgare
RGTPACSIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYYKVDENGKIHRLRRECPADECGAGVFMASHFDRHYCGKCTLTYCFNKPEDK

SEQ ID NO: 5642 - protein, 157 aa, Cedrus atlantica
MQIFVKTLTGKTITLEVESSDTIDNVKAKIQDKEGIPPDQQRLIFAGKQLEDGRSLSDYNIQKESTLHLVLRLRGGGKKRKKKVYTKPKKIAHKKKKVKLAVLKYYKVDENQKITRLRRECPECGAGTFMANHFDRLYCGKCGLRYVYKKDGEAAKE

SEQ ID NO: 5643 - protein, 133 aa, Sesamum indicum
MQIFVKTLTGKSITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDSGKVHRLRKECPNAECGAGTLMA

SEQ ID NO: 5644 - protein, 159 aa, Phaseolus coccineus
MQIFVKTLTGKTITLEVESSDTIENVKQKIQDKEGIPPDQQRLIFAGKQLEDGRTLADYNIQKESTLHLVLRLRGGGKKRKKKVYTKPKKNAHKKKKVKLAVLKYYKVDENGKITRLRRECPNKECGAGVFMASHFDRQYCGKCGLTYVFNKPGETSDE

SEQ ID NO: 5645 - protein, 145 aa, Mesostigma viride
MPIFVNTLTGKTITLEVESSDTIDNVKAKIQDKEGIPPDQQRLIFAGKQLEDGRTLADYNIQKESTLHLVLCLRGGAKKRKKKTYTKAEKNKHKKKKAKLAVLQYYKVDDSGKVQRLRKECPNPDCGAGCFMASHKDRHYCGSAA

SEQ ID NO: 5646 - protein, 151 aa, Picea glauca
MQIFVKTLTGKTITLEVESSDTIDNVKSKIQDKEGIPPDQQRLIFAGKQLEDGRTLSDYNIQKESTLHLVLRLRGGAKKRKKKTYTTPKKIKHKRKPVKLAILKYYRVDSDGKIKRLRRECPNETCGAGVFMAAHHNRQYCGKCGLTYMLS

SEQ ID NO: 5647 - protein, 159 aa, Triticum aestivum
MQIFVKTLTGKTITLEVESADTIDNVKTKIQEKEGIPPDQQRLIFAGKQLEDGRTLADYNIQKESTLHLVLRLRGGAKKRKKKTYTTPKKIKHKRKKVKMAVLKYYKVESNGTIKRLRRECPAQTCGAGVFMAWHFDRQYCGKCGLTYLFGDKNLAKPT

SEQ ID NO: 5648 - protein, 155 aa, Humulus lupulus
MQIFVKTLTGKTITLEVESSDTIDNVKSKIQDKEGIPPDQQRLIFAGKQLEDGRTLSDYNIQKESTLHLVLRLRGGMAKKRKKKVYTTPKKIKHKRKKTKLAVLKYYKVDGDGKIERLRRECPQPECGAGVFMAAMHNRQYCGKCHLTYVFDEAK

SEQ ID NO: 5649 - protein, 155 aa, Avena sativa
MQIFVKTLTGKTITLEVESSDTIDNVKTKIQDKEGIPPDQQRLIFAGKQLEDGRTLADYNIQKESTLHLVLRLRGGAKKRKKKVYTTPKKIKHKRKKTKLAVLKYYKVDGDGKIERLRRECPSADCGAGVFMAAMQDRQYCGRCHLTYIFDDAAK

SEQ ID NO: 5650 - protein, 160 aa, Saccharum officinarum
MQIFVKTLTGKTITLEVESSDTIDNVKAKIQDKEGIPPDQQRLIFAGKQLEDGRTLSDYNIQKESTLHLVLRLRGGMAKKRKKKNYTTPKKIKHKRKKVKMAILKYYKVGSDGKIQRLRRECPAPTCGAGVFMAWHKDRQSCGKCGLTYTFEPGTKPTAA

SEQ ID NO: 5651 - protein, 154 aa, Hordeum vulgare
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKHKKTKLAILKYYKVDGDGKIERLRRECPAPECGAGVFMAAMHNRQYCGKCHLTYVFDEAK

SEQ ID NO: 5652 - protein, 154 aa, Unknown
  Sequence found in Organisms: Gossypium hirsutum, Hordeum vulgare
MQIFVKTLTGKTITLEVESSDTIDNVKSKIQDKEGIPPDQQRLIFAGKQLEDGRTLSDYNIQKESTLHLVLRLRGGMAKKRKKKVYTTPKKIKHKRKKTKLAVLKYYKVDSDGKIERLRRECPSDTCGAGVFMAAMQDRQYCGRCHLTYVFDKQ

SEQ ID NO: 5653 - protein, 159 aa, Artemisia annua
MQIFVKTLTGKTITLEVESSDTIDNVKAKIQDKEGIPPDQQRLIFAGKQLEDGRTLSDYNIQKESTLHLVLRLRGGAKKRKKKTYNTPKKIKHKRKKVKMSILKYYKVESDGKIKRLRRECPSAECGAGIFMAFHQDRQYCGKCGLTYTFQPGSKPPVV

SEQ ID NO: 5654 - protein, 154 aa, Unknown
  Sequence found in Organisms: Medicago truncatula, Saccharum officinarum
MQIFVKTLTGKTITLEVESSDTIDNVKSKIQDKEGIPPDQQRLIFAGKQLEDGRTLSDYNIQKESTLHLVLRLRGGMAKKRKKKVYTTPKKIKHKRKKTKLAVLKYYKVDSDGKIERLRRECPADTCGAGVFMAAMQDRQYCGRCHLTYVFDKQ

SEQ ID NO: 5655 - protein, 154 aa, Picea glauca
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDGDGKIERLRRECPTAECGAGVFMAAMHNRQYCGKCHLTYVFDESK

SEQ ID NO: 5656 - protein, 132 aa, Abies balsamea
HRQCESQDPGQRRHPTRPTTFDLRRKAARRRPYLSRLQHPKRVHSFILVLRLRGGAKKRKKKTYTKPKKIKHKHKKVKLAVLQFYKVGDDGKVNRLRKECPNAECGAGTFMANHEDRHYCGKCGLTYLYQKA

SEQ ID NO: 5657 - protein, 159 aa, Parthenium argentatum
MQIFVKTLTGKTITLEVESSDTIDNVKSKIQDKEGIPPDQQRLIFAGKQLEDGRTLSDYNIQKESTLHLVLRLRGGAKKRKKKTYTTPKKIKHVRKKNKMAILKYYKVDSDGKIKRLRRECPQETCGAGVFMAWHSDRQYCGKCGLTYKFEAGTQPPKA

SEQ ID NO: 5658 - protein, 151 aa, Silene vulgaris
MQIFVKTLTGKTITLDVESGDTIENVKAKIQDKEGIPPDQQRLIFAGKQLEDGRTLSDYNIQKESTLHLVLRLRGGGKKRKKKVYTKPKKIAHKHKKVKLAVLKFYKVEGDKITRLRTECPHPTCGAGVFMANHKDRQYCGKCHLTYFLGQ

SEQ ID NO: 5659 - protein, 159 aa, Phaseolus coccineus
  misc_feature (25)..(25): Xaa can be any naturally occurring amino acid
  misc_feature (119)..(119): Xaa can be any naturally occurring amino acid
MQIFVKTLTGKTITLDVESADTIDXVKAKIQDKEGIPPDQQRLIFAGKQLEDGRTLADYNIQKESTLHLVLRLRGGAKKRKKKTYTTPKKIKHKRKKVKMAVLKYYKVESNGSIKRLRXECPAPSCGAGVFMAWHEDRQYCGKCGLTYLFGDKKLPKPT

SEQ ID NO: 5660 - protein, 153 aa, Theobroma cacao
  misc_feature (145)..(145): Xaa can be any naturally occurring amino acid
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDSDGKIERLRRECPSDSCGAGVFMAAMQDRQYCGRCXLTYVFEKN

SEQ ID NO: 5661 - protein, 162 aa, Arachis hypogaea
MQIFVKTLTGKTITLEVESSDTIDNVKSKIQDKEGIPPDQQRLIFAGKQLEDGRTLSDYNIQKESTLHLVLRLRGGGKKRKKKVYTPPRRSSTSARRPSSLCSSTTRLMAMARSSVSAVNALPPSVVPVSSWPPCTTVSTAESATLPTSSMNPNKRLVTISM

SEQ ID NO: 5662 - protein, 162 aa, Hordeum vulgare
MQIFVKTLTGKTITLEVESSDTIDNVKAKIQDKEGIPPDQQRLIFAGKQLEDGRTLADYNIQKESTLHLVLRLRGGAKKRKKKTYSTPKKVKHEREKTPLAVLGYYRVDDATGKVERLRKECPNPDCGAGTFMAAHADRHACGKCGLTYAYAEAQGPEIDSD

SEQ ID NO: 5663 - protein, 162 aa, Triticum aestivum
MQIFVKTLTGKTITLEVESSDTIDNVKAKIQDKEGIPPDQQRLIFAGKQLEDGRTLADYNIQKESTLHLVLRLRGGAKKRKKKTYSTPKKVKHEREKTPLAVLGYYRVDDATGKVERLRKECPNPDCGAGTFMAAHADRHACGKCGLTYAYAEAQSPEIDSD

SEQ ID NO: 5664 - protein, 156 aa, Pinus taeda
  misc_feature (155)..(155): Xaa can be any naturally occurring amino acid
MQIFVKTLTGKTITLEVEASDTIENVKAKIQDKEGIPPDQQRLIFAGKQLEDGRTLSDYNIQKESTLHLVLRLRGGAKKRKKKNYSTPKKIKHKKKKVKLAVLKFYKVDENGKIHRLRRECPSEQCGAGVFMAAMEDRHYCGKCGFTLVFNKPEXK

SEQ ID NO: 5665 - protein, 156 aa, Quercus alba
MQIFVKTLTGKTITLEVEPSDTIENVKAKIQDKEGIPPDQQRLIFAGKQLEDGRTLSDYNIQKESTLHLVLRLRGGAKKRKKKNYSTPKKIKHKRKKVKLAVLKYYKVDENGKIHRLRRECPGENCGAGVFMAAHEDRHYCGKCSLTFVFSKNEEK

SEQ ID NO: 5666 - protein, 156 aa, Quercus alba
MQIFVKTLTGKTITLEVESSDTIENVKAKIQDKEGIPPDQQRLIFAGKQLEDGRTLSDYHIQKESTLHLVLRLRGGAKKRKKKNYSTPKKIKHKKKKVKLAVLKFYKVDENGKIHRLRRECPSEQCGAGVFMAAMEDRHYCGKCGYTLVFNKPEEK

SEQ ID NO: 5667 - protein, 155 aa, Unknown
  Sequence found in Organisms: Hordeum vulgare, Triticum aestivum
MQIFVKTLTGKTITLEVESSDTIDNVKTKIQDKEGIPPDQQRLIFAGKQLEDGRTLADYNIQKESTLHLVLRLRGGAKKRKKKVYTTPKKIKHKRKKTKLAVLKYYKVDGDGKIERLRRECPSTDCGAGVFMAAMQDRQYCGRCHLTYIFDDAAK

SEQ ID NO: 5668 - protein, 154 aa, Unknown
  Sequence found in Organisms: Malus domestica, Artemisia annua, Picea glauca
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDGDGKIERLRRECPQPECGAGVFMAAMHNRQYCGRCHLTYVFDEAK

SEQ ID NO: 5669 - protein, 147 aa, Malus domestica
MQIFVKTLTGKTITLEVENGDTIDNVKAKIQDKEGIPPDQQRLIFAGKQLEDGRTLSDYNIQKESTLHLVLRLRGGAKKRKKKTYTTPKKIKHKRKKVKMSVLKFYKVDASTGAVKRLRKECPAPTCGASVFMSWHKDRSYCGKCHL

SEQ ID NO: 5670 - protein, 154 aa, Brassica rapa
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKHKKTKLAILKYYKVDGDGKIERLRRECPAPECGAGVFMAAMHNRQYCGKCHLTYVFDESK

SEQ ID NO: 5671 - protein, 154 aa, Picea glauca
MQIFVKTLTGKTITLEVESSDTIDNVKSKIQDKEGIPPDQQRLIFAGKQLEDGRTLSDYNIQKESTLHLVLRLRGGAKKRKKKVYTTPKKIKHKRKKTKLAVLKYYKVDGDGKIERLRRECPNDTCGAGIFMAAMHNRQYCGRCHLTYVFDDPK

SEQ ID NO: 5672 - protein, 153 aa, Picea glauca
ARGFVKTLTGKTITLEVESSDTIDNVKSKIQDKEGIPPDQQRLIFAGKQLEDGRTLSDYNIQKESTLHLVLRLRGGMAKKRKKKVYTTPKKIKHKRKKTKLAVLKYYKVDGDGKIERLRRECPQPECGAGVFMAAMHDRQYCGKCHLTYVFDK

SEQ ID NO: 5673 - protein, 78 aa, Pinus taeda
MAKKRKKKVYTTPKKIKHKRKKTKLAVLKYYKVDSDGKIERLRRECPADTCGAGVFMAAMQDRQYCGRCHLTYVFDKQ

SEQ ID NO: 5674 - protein, 162 aa, Brachypodium distachyon
MQIFVKTLTGKTITLEVESSDTIENVKAKVQDKEGVPPEQQRLIFAGKQLEDGRTLADYNVQKESTLHLVLRLRGGAKKRKKKTHTTPKKAKHERTKTELAVLGLYRVDEATGAVERLRKECPNPECGAGTFMAAHADRLACGKCGLTYAYAEAQSPEIDSD

SEQ ID NO: 5675 - protein, 105 aa, Triticum aestivum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVNSPCCIL

SEQ ID NO: 5676 - protein, 97 aa, Quercus alba
TITLEVESSDTIDNVKAKIQDKEQRLIFAGKQLEDGRTLADYNIQKESTLHLPRWQEEDLHQTQEDQAQAQEGQARYPPVLQGRRLWESSEAQERVP

SEQ ID NO: 5677 - protein, 151 aa, Podocarpus macrophillus
MQIFVKTLTGKTITLEVESSDTIDNVKSKIQDKEGIPPDQQRLIFAGKQLEDGRTLSDYNIQKESTLHLVLRLRGGAKKRKKKVYTTPKKIKHKRKKTKLAVLKYYKVDGDGKIERLRRECPAETCGAGIFMAAMHNRQYCGRCHLTYVFD

SEQ ID NO: 5678 - protein, 133 aa, Theobroma cacao
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDESGKVQRLRKECPNAECGARNVHG

SEQ ID NO: 5679 - protein, 152 aa, Unknown
  Sequence found in Organisms: Citrus sinensis, Triticum aestivum
MQIFVKTLTGKTITLEVEPSDSIDNVKQKIQDKEGIPPDQQRLIFAGKQLEDGRTLSDYNIQKESTLHLVLRLRGGAKKRKKKTYTKPKKAHHKRKKVKLAVLKFYQVDKDGKVIRARKDCPHETCGAGVRMALHKNRHHCGKCSLTYFIEK

SEQ ID NO: 5680 - protein, 153 aa, Quercus alba
MQIFVKTLTGKTITLEVESSDTIDNVKTKIQDKEGIPPDQQRLIFAGKQLEDGRTLSDYNIQKESTLHLVLRLRGGGKKRKKKVYTTPKKIKHKRKKTKLAVLKYYKVDGDGKIERLRRECPQDTCGAGVFMAAMHNRQYCGKCHLTYVFEEK

SEQ ID NO: 5681 - protein, 153 aa, Picea glauca
MQIFVKTLTGKTITLEVESSDTIDNVKSKIQDKEGIPPDQQRLIFAGKQLEDGRTLSDYNIQKESTLHLVLRLRGGAKKRKKKVYTTPKKIKHKRKKTKLAVLKYYKVDGDGKIERLRRECPQEGCGAGVFMAAMHNRQYCGRCHLTYVFEES

SEQ ID NO: 5682 - protein, 136 aa, Zingiber officinale
TIDNVKAKIQDKEGIPPDQQRLIFAGKQLEDGRTLADYNIQKESTLHLVLRLRGGAKKRKKKTYTKPKKIKHKKKKVKLAVLQYYKVDDATGKVTRLRKECPNAECGAGTFMANHFDRHYCGKCGLTYVYQKSSSE

SEQ ID NO: 5683 - protein, 133 aa, Cucurbita pepo
DNVKAKIQDKEGIPPDQQRLIFAGKQLEDGRTLADYNIQKESTLHLVLRLRGGAKKRKKKTYTKPKKIKHKKKKVKLAVLQFYKVDDSGKVQRLRKECPNAECGAGTFMANHFDRHYCGKCGLTYVYQKPGGD

SEQ ID NO: 5684 - protein, 156 aa, Ocimum basilicum
MQIFVKTLTGKTITLEVEPSDTIENVKAKIQDKEGIPPDQQRLIFAGKQLEDGRTLSDYNIQKESTLHLVLRLRGGAKKRKKKNYSTPKKIKHKKKKIKLAVLKFYKVDENGKIFRLRRECPMERCGAGVFMAAMSDRHYCGKCGYTLVYDGNEGK

SEQ ID NO: 5685 - protein, 80 aa, Eucalyptus grandis
MQIFVKTLTGKTITLEVESSDTIDNVKAKIQDKEGIPPDQQRLIFAGKQLEDGRTLADYNIQEGVHPPPRPPPPGRRQEA

SEQ ID NO: 5686 - protein, 155 aa, Avena sativa
MQIFVKTLTGKTITLEVESSDTIDNVKSKIQDKEGIPPDQQRLIFAGKQLEDGRTLSDYNIQKESTLHLVLRLRGGMAKKRKKKVYTTPKKIKHKRKKTKLAVLKYYKVDGDGKIERLRRECPQPECGAGVFMAAMHNRQYCGRCHLTYVFDESK

SEQ ID NO: 5687 - protein, 169 aa, Triticum aestivum
MQIFVKTLTGKTITLEVESSDTIDNVKAKIQDKEGIPPDQQRLIFAGKQLEDGRTLSDYNIQKESTLHLVLRLRGGMAKKRKKKTYTTPKKIKHKRKPVKMAVLKYYRVDSDGKVKRLRRECPAETCGAGVFMAAHKERQTCGRCGLTTSTRPKLGVAFALTITLFVSH

SEQ ID NO: 5688 - protein, 164 aa, Triticum aestivum
  misc_feature (138)..(138): Xaa can be any naturally occurring amino acid
  misc_feature (152)..(153): Xaa can be any naturally occurring amino acid
MQIFVKTLTGKTITLEVESSDTIDNVKAKIQDKEGIPPDQQRLIFAGKQLEDGRTLSDYNIQKESTLHLVLRLRGGMAKKRKKKTYTTPKKIKHKRKPVKMAVLKYYRVDSDGKVKRLRRECPAETCGAGVFMAAHKXRQTCGRCGLTTSTXXKLGVAFALTIT

SEQ ID NO: 5689 - protein, 154 aa, Humulus lupulus
MQIFVKTLTGKTITLEVESSDTIDNVKSKIQDKEGIPPDQQRLIFAGKQLEDGRTLSDYNIQKESTLHLVLRLRGGGKKRKKKVYPTPKKIKHKRKKTKLAVLKYYKVDGDGKIERLRRECPNDTCGAGIFMAAMHNRQYCGRCHLTYVFDEAK

SEQ ID NO: 5690 - protein, 154 aa, Humulus lupulus
  misc_feature (79)..(79): Xaa can be any naturally occurring amino acid
  misc_feature (151)..(151): Xaa can be any naturally occurring amino acid
MQIFVKTLTGKTITLEVESSDTIDNVKSKIQDKEGIPPDQQRLIFAGKQLEDGRTLSDYNIQKESTLHLVLRLRGGGKXRKKKVYTTPKKIKHKRKKTKLAVLKYYKVDGDGKIERLRRECPQPECGAGVFMAAMHNRQYCGRCHLTYVFXEAK

SEQ ID NO: 5691 - protein, 154 aa, Pinus taeda
MQIFVKTLTGKTITLEVESSDTIDNVKSKIQDKEGIPPDQQRLIFAGKQLEDGRTLSDYNIQKESTLHLVLRLRGGAKKRKKKVYTTPKKIKHKRKKTKLAVLKYYKVDADGKVERLRRECPTPECGASCFMSAMHNRQYCGRCHLTYVFDETK

SEQ ID NO: 5692 - protein, 154 aa, Pinus taeda
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDGDGKIERLRRECPNETCGAGIFMAAMHNRQYCGRCHLTYVFDEVK

SEQ ID NO: 5693 - protein, 116 aa, Cephalotaxus harringtonia
MQIFVKTLTGKTITLEVESSDTIDNVKSKIQDKEGIPPDQQRLIFAGKQLEDGRTLSDYNIQKESTLHLVLRLRGGAKKRKKKVYTTPRRSSTSARRPSWPSSSTTRSTVMARSSD

SEQ ID NO: 5694 - protein, 154 aa, Humulus lupulus
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDGDGKIERLRRECPAETCGAGIFMAAMHNRQYCGRCHLTYVFDESK

SEQ ID NO: 5695 - protein, 156 aa, Lippia dulcis
MQIFLRSVACNTRLLEVEPSDTVEHLKAKIQDTEFISPDEQRLIYGGKQLEDGSTLADYGIQKESTIHVLLRLLGGAKKRKKKTYTKPKKIKHKKKKVKLPVLQFYKVDDSGKVQRLRKECPNAECGAGTFMANHFDRHYCGKCGLTYVYNKAGGD

SEQ ID NO: 5696 - protein, 169 aa, Podocarpus macrophillus
MQIFVKTLTGKTITLEVESSDTIDNVKSKIQDKEGIPPDQQRLIFAGKQLEDGRTLSDYNIQKESTLHLVLRLRGGGKKRKKKVYTTPRRSSTSARRTSLPSSSTTRLTVTARLSVCAASAPPTPAVPVSSWPPCTTASTAVAATSPTSLTTLSKCVAKTGVDDFCLLC

SEQ ID NO: 5697 - protein, 154 aa, Picea glauca
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKNKLAVLKYYKVDGDGKIERLRRECPSDTCGAGIFMAAMHNRQYCGRCHLTYVFDDPK

SEQ ID NO: 5698 - protein, 155 aa, Picea glauca
MQIFVKTLTGKTITLEVEPSDTIENVKAKIQDKEGIPPDQQRLIFAGKQLEDGRTLSDYNIQKESTLHLVLRLRGGAKKRKKKNYSTPKKIKHKKKKVKLAVLRYYKVDENGKIHRLRRECTGEQCGAGVFMAVMEDRHYCGKCHSTMVFKDDDK

SEQ ID NO: 5699 - protein, 154 aa, Picea glauca
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKRKKTKLAVLKYYKVDGDGKIERLRRECPADTCGAGIFMAAMHNRQYCGRCHLTYVFDDPK

SEQ ID NO: 5700 - protein, 165 aa, Triticum aestivum
MQIFVKTLTGKTITLEVEPSDTIENVKAKIQDKEGIPPDQQRLIFAGKQLEDGRTLSDYNIQKESTLHLVLRLRGGGKKRKKKVYTTPKKKAHKKKKVKLAVLRYYRVDGSGNVTRLRRECNSEQCGAGIFMASHYDRQYCGKCGLTYMLPKSEIKPKPVPGQSA

SEQ ID NO: 5701 - protein, 68 aa, Triticum aestivum
MQIFVKTLTGKTITLEVEASDTIDNVKSKIQDKEAFPRTSSVSFSPASSSRMAALFRTTTSRRSPPSI

SEQ ID NO: 5702 - protein, 131 aa, Eschscholzia californica
VKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNSECGAGTFMANHFDRHYCGKCGLTYVYQKAGGE

SEQ ID NO: 5703 - protein, 143 aa, Pisum sativum
MLSTSSYKYLLTCVEKKIQDKEGIPPDQQRLIFAGKQLEDGRTLADYNIQKESTLHLVLRLRGGAKKRKKKTYTKPKKIKHKHRKVKLAVLQFYKVDDSGKVQRLRKECPNAECGAGTFMANHFDRHYCGKCGLTYVYQKAEA

SEQ ID NO: 5704 - protein, 359 aa, Unknown
  Sequence found in Organisms: Solanum tuberosum, Solanum phureja
MAKSFENEHPIKAFGWATRDTSGVLSPFNFSRRVTGEKDVQFKVMYCGICHSDLHQLKNEWGNSKYPMVPGHEVVGVVIEVGSKVEKFKVGDKVGVGCMVGSCRKCENCSVDLENYCPRQIPTYNGYSLDGTFTFGGYSDMMVSDEHFVVHWPENLSMDAAPLLCAGITTYSPLKYFGLDKPGMHIGVVGLGGLGHMAVKFAKAFGTKVTVISTSANKKQEAIERLGADSFLISRDPEQMKAAMNTLDGIIDTVSAVHPILPLLMLMKSHGKLVMVGAPEKPVELPVFPLLMGRKLVAGSCIGGMKETQEMLDFAAKHNITPDIEVVPMDYVNTALERLLKSDVKYRFVLDIGNTLNKK

SEQ ID NO: 5705 - protein, 78 aa, Solanum phureja
MAKSYENEHPIKAFGWATRDTSGVLSAFNFSRRVTGEKDVQFKVMYCGICHSDLHQLKNEWGNSKYPMVPDCLGKLIC

SEQ ID NO: 5706 - protein, 359 aa, Capsicum annuum
MAKSYENEHPIKAFGWAARDTSGALSPFNFSRRVTGEKDVQFKVMYCGICHSDLHQLKNEWGNSKYPVVPGHEIVGVVTEVGSKVEKFKVGDKVGVGCLVGSCRECENCSVDLENYCRRPTWTYNSYNSDGTLTFGGYSDIMVCDEHFVVHWPENLSMDAAPLLCAGITTYSPLKYFGLDKPGMHIGVVGLGGLGHMAVKFAKAFGTKVTVISTSASKKQEAIERLGADSFLISRDSEQMQDAVNTLDGIIDTVSAVHPILPLLMLLKSNGKLVMVGAPEKPVELPVFPLLMGRKLVAGSGIGGMKETQEMVDFAAKHNITPDVEIVPMDYVNIALERLLKSDVKYRFVLDIGNTLNKN

SEQ ID NO: 5707 - protein, 194 aa, Solanum phureja
MAKSFENEHPIKAFGWETRDTSGVLSPFNFSRRVTGEKDVQFKVICGICHSDLHQLKNEWGNSKYPMVPRKVGNKVGAGCMVGSCRKCENCSVDLKNYCPRQIPTYNGFSLDGTLTFGGYSDMMVSDEHFVVRWPENLSMDATPLLCAGITTYSPLKYFGLDKPVMHIGIVGLGGLGHKAVKFAKAFGTKVTCH

SEQ ID NO: 5708 - protein, 261 aa, Solanum phureja
MVGSCRKCENCSVDLENYCPRQIPTYNGYSLDGTLTFGGYSDMMVSDEHFVVRWPENLSMDAAPLLCAGITTYSPLKYFGLDKPGMHIGVVGLGGLGHMAVKFAKAFGTKVTVISTSANKKQEAIECLGADSFLISRDPEQMKAAMNTLDGIIDTVSAVHPILPLLMLMKSHGKLVMVGAPEKPVELPVFPLLMGRKLVAGSCIGGMRDTQEMLDFTAKHNITPDIEVVPMDYVNTALERLLKSDVKYRFVLDVGNTLNKK

SEQ ID NO: 5709 - protein, 356 aa, Solanum tuberosum
MEKSHENVKAFGWAARDTSGVLSPFNFSRRVTGEKDVQFKVMYCGICHSDLHQLKNEWSNSIYPMVPGHEVVGVVTEVGSKVEKFKTGDKVGVGCLVGSCRKCENCDNDLENYCRDQIMTYNGVYTDGIPTYGGYSDIMVTNEHYVVHWPENLPMEAAPLLCAGITTYSPLRYYGLDKPGMHIGVVGLGGLGHMAVKFAKAFGTKVTVISTSVSKKDEAIDRLGADSFLVSRDPDQMQGAAGSLDGIIDTVSVIHPLLPLINLLKTNGKLVMVGAPEKPLELPVFPLLLGRKLVAGSAIGGVKETQEMVDFAAKHNITPDVEVVPMDYVNTALERLLKSDVKYRFVLDIGNTLNKN

SEQ ID NO: 5710 - protein, 362 aa, Petunia hybrida
MEKSHENEHPTKAFGWAARDTSGVLSPFKFSRRATGEKDVQFKVKYCGICHSDLHQLKNEWGNSIYPIVPGHEVVGVVTEVGSKVEKFKVGDKVGVGCMVGSCRKCENCNNDLENYCRDQTLTYNGIYSDGTTTYGGYSDIMVTDEHFVVHWPENLPMEAAPLLCAGITTYSPLKYFGLDKPGMHIGVVGLGGLGHMAVKFAKAFGTKVTVISTSSSKKHEAIERLGVDSFLVSRDPDQMQAAMGSLDGIIDTVSAVHPLLPLINLLEILIGEGLVDGLGAPEKPLELPVFPLLMGRKLVAGSGIGGMKETQEMVDFAAKHNITPDVEVVPMDYVNTALDRLLKSDVKYRFVLDIANTLNKT

SEQ ID NO: 5711 - protein, 356 aa, Solanum phureja
MEKSHENVKAFGWAARDTSGVLSPFNFSRRVTGEKDVQFKVVYCGICHTDLHQLKNEWSNSIYPMVPGHEVVGVVTEIGSKVEKFKIGDKVGVGCLVGSCRKCENCDNNLENYCRDQIMTYNGVYTDGIPTYGGYSDIMVTNEHYVVHWPENLPMEAAPLLCAGITTYSPLRYFGLDKPGMHIGVVGLGGLGHMAVKFAKAFGTKVTVISTSVSKKDEAIDRLGADSFLVSRDPDQMQGAAGSLDGIIDTVSEIHPLLPLINLLKTHGKLVMVGAPEKPLELPVFPLLLGRKLVAGSAIGGMKETQEMVDFAAKHSITPDVEVVPMDYVNKALERLLKSDVKYRFVLDIGNTLNKN

SEQ ID NO: 5712 - protein, 356 aa, Solanum lycopersicum
MEKSNENVEAFGWAARDTSGVLSPFNFSRRVTGEKDVQFKVMYCGICHSDLHQIKNEWSNSIYPMVPGHEVVGVVTEVGSKVERFKTGDKVGVGCLVGSCRKCENCDNDLENYCPDQIMTYNGVYTDGTPTYGGYSDIMVTNEHYVVHWPENLRMEAAPLLCAGITTYSPLRHYGLDKPGMHIGVVGLGGLGHMAVKFAKAFGTKVTVISTSASKRDEAMDRLGADSFLVSRDPDQMQGAAGSLDGIIDTVSAIHPLLPLINLLKTHGKLVMVGAPEKPLELPVFPLLLGGKLVAGSAIGGMKETQEMVDFAGKHNITPDIEVVSMDYVNTALERLLKSDVKYRFVLDIGNTLKKN

SEQ ID NO: 5713 - protein, 359 aa, Nicotiana tabacum
MAKLYENEHPVKAFGWAARDASGVLSPFNFTRRATGEKDVQFKVMYCGICHSDLQQLKNEWSTSIYPMVPGYEVVGVVTEIGRKVEKFKVGDKVGVGCLVGSCRKCENCDNNLENYCPGHIMTYNDIYIDGITTYGGYSNIMVTDEHYMVHWPENLPMEAAPLLCAGITTYSPLKYFGLDKPGMHIGVVGLGGLGHMAVKFAKAFGTKVTVISTSASKKQEAIGRLGADSFLVSRDPDQMQAAAGSLDGIIDTVSAIHPLLPLINLLKTHGKLVMVGAPEKPLELPVFPLLLGRKLVAGSAIGGIKETQEMVDFAAKHNITPDVEVVPMDYVNTALDRLLKSDVKYRFVLDVGNTLNKN

SEQ ID NO: 5714 - protein, 356 aa, Solanum melongena
SYENEHPIKAFGWAARDTSGVLSPYNFSRRVTGEKDVQFKVLYCGICHTDLHQIKNDWGITKYPIIPGHEIVGVVTEFGNKVDKFKVGDAIGVGYLVGSCRECENCVNDLENYCPGLTMTANGTYSDGTITHGGYSDLMVVDEHFVVRWPENLPMEAAPLLCAGLTTYSPLKYFGLDKPGMHIGVVGLGGLGHMAVKFAKAFGTKVTVISTSRSKRDEAIERLGADSFLVSRDPDQMEAARGSLDGIIDTVSAVHPIFPLLNLMKTNGKLVMVGAPEKPLELPVFPLISGRRLVAGSSTGGVNEMQNMLDFAAKHSITPDVEVVPMEYVNTALERLVKSDVKYRFVLDIGNTLNKS

SEQ ID NO: 5715 - protein, 356 aa, Solanum phureja
MEKTHENVKAFGWAARDTFGVLSPFNFSRRVTGEKDVQFKVVYCGICHTDLHQLKNEWSNSIYPMVPGHEVVGVVTEIGTKVEKFKIGDKVGVGGLVESCRKCENCDNDLENYCRDQIMTYNGVYTDGTTTYGGYSDIMVTNEHYVVHWPENLPMEAAPLLCAGITIYSPLKYFGLDKPGMHIGVVGLGGLGHMAVKFAKVFGTKVTVISTSLSKKDEAIEHLGADSFLVSRDPDQMQGAAGSLDGIIDTVSVIHPLLPLINLLKTRGKLAMLGAPEKPLELPVFPLLLGRKLVAGSFIGGMKETQEMVDFAAKHSITPDVEVVPMDYVNTAFERLLKSNVKYRFVLDIGNTLNKN

SEQ ID NO: 5716 - protein, 360 aa, Capsicum annuum
MAKSPEEEHPIKAFGWAARDTSGVLSPFNFSRRATGEKDVQFKIFYCGICHTDLHFLKNEWGVTRYPIVPGHEIVGVVTEVGTKVEKFKIGDKVGVGCLVGSCKNCDNCSNDLENYCPKQIMTYGHPYHDGTMTYGGYSDLMVVDEHFAVRWPENLSMEAAPLLCAGITTYSPLKYFGLDKPGMHIGVVGLGGLGHMAVKFAKAFGANVTVISTSTGKKDEALQHLGADKFLLSNNPEQIQGAMNTLDGIIDTVSAVHPLLPLIGMLKPHGKLVMVGAVAQPLEVPVFPLLIMGRKLIAGSCIGGMKETQEMLDFAAKHNITPDVEVVAMDYVNTALDRLLKSDVKYRFVLDIGKTMNSV

SEQ ID NO: 5717 - protein, 566 aa, Gossypium hirsutum
MEMRDIDDLPKNAANYMALTPLWFLERAATVHPTRKAVIHGSRTYTWLQTYQRCRRLASALSKRSIGVGSSVAIIAPNVPALYEAHFGIPMSGAVVNTINIRLNASTIAFLLGHSQSTIVIVDQEFFNLAEDALRIMKEKSQSNFRPPLVIVIADGSCNPETLEYALGQGAIEYEKFLESGDPDFAWKPPQDEWQSIALGYTSGTTASPKGVLLHHRGAYLMALSNPIIWEMNEGAVYLWTLPMFHCNGWCFPWTLAAVCGINICLRQVTAKGIYSAIAKYRVTHFCAAPVVLNSIVNASPEDTILPLPHVVRVMTAGAAPPPSVLSGMSQKGFRVTHTYGLSETYGPSTVCAWKPEWDSLPPETQARLNARQGVRYVGLECLDVISTQTGQPVPADGKTIGEIVFRGNIVMKGYLKNPKANEETFANGWFHSGDLGVKNPDGYIEIKDRSKDIIISGGENISSVEVENNLYLHPAVMEASVVARADERWGESPCAFVTLKPGVDKSDEQRLAEDIMKFCRSKMPAYWVPKSVIFGPLPKTATGKIQKHVLRAKAKELGPVRMSKL

SEQ ID NO: 5718 - protein, 567 aa, Gossypium hirsutum
MEMRDIDNLPKNAANYTALTPLWFLERAATVHPARKAVVHGSRTFTWLQTYQRCRRLASALSNLSVGFGSTVAVIAPNVPAAYEAHFGIPMSGAVINPVNIRLNASTVAFLLGHSQSAVVIVDQEFFTLAEDSLKIMKEKSQGNFKPPLLVVVADESCDPKTLRYALGQGAIEYEKFLESGDPEFSWKPPQDEWQSIALNYTSGTTASPKGVVLHHRGAYLMSLSNPLIWGMNEGVIYLWTLPMFHCNGWCFTWALAALCGTNLCLRQVTAKGVYSAIAKYGVTHFCAAPVVLNSIVNAPSEDTILPLPHVVHVMTAGAAPPSAVLFAMSQKGFRVTHTYGLSETYGPSTVCAWKPEWDSLPPETQARLNARQGVRYIGLEGLDVISSQTGEPVAADGKTIGEIVMRGNLVMKGYLKNPKANEETFANGWFHSGDLGVKHPDGYIEIKDRSKDIIISGGENISSVEVENSLYLHPAVLEASVVARADERWGESPCAFVTLKPGVADKSKEQELSEEIMQFCRSKMPAYWVPKSVVFGPLPKTATGKIQKHILRGKAKELGPVKLSKL

SEQ ID NO: 5719 - protein, 566 aa, Gossypium hirsutum
MAIRDIDDLPKNAANYTALTPLWFLERAATVHPSRKAVVHGSRTYTWLQTYQRCRRLASALAKRSVGAGSTVAVIAPNIPATYEAHFGIPMCGAVINPVNIRLNASTIAFLLGHSQSATVIVDQEFFTLAEDSLKIMKEKSQGHFNPPLLVVVADEACDPEALRYALGQGAIEYEKFLESGDPDFAWKPPQDEWQSIALGYTSGTTASPKGVVLHHRGAYLMSLCNPLVWGMNEGAIYLWTLPMFHCNGWCFTWALAALCGTNICLRQVTAKGVYSAIEKHGVTHFCAAPVVLNTIVNAAPEDTILALPHVVHVMTAGAAPPPAVLFAMSRKGFRVTHTYGLSETYGPSTICAWKPEWDSLPPDTQARLNARQGVRYTTLECLDVISTKTGEPVPADGKSMGEIVMRGNVVMKGYLKNPKANEETFANGWFHSGDLGVKHQDGYIEIKDRSKDIIISGGENISSVEVENSLYLHPAVLEASVVARADEQWGESPCAFVTLKPEVNKSDEQWLAEDIMKFCKSKMPAYWVPKSVVFGPLPKTATGKIQKHVLRGKAQQLGPVKVSKL

SEQ ID NO: 5720 - protein, 551 aa, Gossypium hirsutum
MEMRDIDNLPKNAANYTALTPLWFLERAATVHPARKAVVHGSRTFTWLQTYQRCRRLASALSNLSVGFGSTVAVIAPNVPAAYEAHFGIPMSGAVINPVNIRLNASTVAFLLGHSQSAVVIVDQEFFTLAEDSLKIMKEKSQGNFKPPLLVVVADESCDPKTLRYALGQGAIEYEKFLESGDPEFSWKPPQDEWQSIALNYTSGTTASPKGVVLHHRGAYLMSLSNPLIWGMNEGAIYLWTLPMFHCNGWCFTWALAALCGTNICLRQVTAKGVYSAIAKYGVTHFCAAPVVLNSIVNAPSEDTILPLPHVVHVMTAGAAPPSAVLFAMSQKGFRVTHTYGLSETYGPSTVCAWKPEWDSLPPETQARLNARQGVRYIGLEGLDVISSQTGEPVAADGKTIGEIVMRGNLVMKGYLKNPKANEETFANGWFHSGDLGVKHPDGYIEIKDRSKDIIISGGENISSVEVENSLYLHPAVLEASVVARADERWGESPCAFVTLKPGVADKSKEQELSEEIMQFCRSKMPAYWVPKSVVFGPLPKTATGKIQNIY

SEQ ID NO: 5721 - protein, 567 aa, Citrus sinensis
MSMAKDIDDLQKNAANYMALTPLWFLDRAATVHPTRTSVVHGSKRYTWLQTYQRCRRLASALSKRSIGLGCTVAIIAPNIPAIYEAHFGVPMAGAVLNAVNIRLNAPTIAFLLGHSASAVIMVDQEYFKLAEEALKIMEEKSNGRFKPPLLIVIGDESCDPKDLKYALGRGAVEYEKFLQTGDPQFDWKPPQDEWQSIALGYTSGTTASPKGVVLSHRGAYLMSLSVALIWGMNEGAVYLWTLPMFHCNGWCYTWSLAALCGTNICLRQVTAKAVYSAIAKYGVTHFCAAPVVLNSIVNAPSEDTILPLPHVVHVNTAGAAPPPSVLHAMSQKGFHVTHTYGLSETYGPSTVCAWKPEWDSLPPETQARMKARQGVRFIGLEKLDVIDTRTQQPVPADGKTIGEIVMSGNVVMKGYLKNPKANEETFANGWYHTGDLGVKHPDNYIEIKDRSKDIIISGGENISSVEVENMMYLHPAVLEASVVARADERWGESPCAFVTLKPEVDKSNEQQLAEDIMKLCRAKMPAYWVPKSIVFGPLPKTATGKIQKHVLRAKAKEMGPVRKSKL

SEQ ID NO: 5722 - protein, 567 aa, Citrus sinensis
MSMAKGIDDLPKNAANYMALTPLWFLDRAATVHPTRTSVVHGSTRYTWLQTYQRCRRLASALCKRSIGLGCTVAIIAPNIPAIYEAHFGVPMAGAVLNAVNIRLNAPTIAFLLGHSASAVIMVDQEYFKLAEEALKIMEEKSNGRFKPPLLIVIGDESCDPKDLKYALGRGAVEYEKFLQTGDPQFDWKPPQDEWQSIALGYTSGTTASPKGVVLSHRGAYLMSLSVALIWGMNEGAVYLWTLPMFHCNGWCYTWSLAALCGTSICLRQVTAKAVYSAIAKYGVTHFCAAPVVLNSIVNAPSEDTILPLPHVVHVNTAGAAPPPSVLHAMSQKGFHVTHTYGLSETYGPSTVCAWKPEWDSLPPETQARMKARQGVRFIGLEKLDVIDTRTQQPVPADGKTIGEIVMSGNVVMKGYLKNPKANEETFANGWYHTGDLGVKHPDNYIEIKDRSKDIIISGGENISSVEVENMMYLHPAVLEASVVARADERWGESPCAFVTLKPEVDKSNEQQLAEDIMKFCRAKMPAYWVPKSIVFGPLPKTATGKIQKHVLRAKAKEMGPVRKSKL

SEQ ID NO: 5723 - protein, 567 aa, Citrus clementina
MSMAKGIDDLPKNAANYMALTPLWFLDRAATVHPTRTSVVHGSTRYTWLQTYQRCRRLASALCKRSIGLGCTVAIIAPNIPAIYEAHFGVPMAGAVLNAVNIRLNAPTIAFLLGHSASAVIMVDQEYFKLAEEALKIMEEKSNGRFKPPLLIVIGDESCDPKDLKYALGRGAVEYEKFLQTGDPQFDWKPPQDEWQSIALGYTSGTTASPKGVVLSHRGAYLMSLSVALIWGMNEGAVYLWTLPMFHCNGWCYTWSLAALCGTNICLRQVTAKAVYSAIAKYGVTHFCAAPVVLNSIVNAPSEDTILPLPHVVHVNTAGAAPPPSVLHAMSQKGFHVTHTYGLSETYGPSTVCAWKPEWDSLPPETQARMKARQGVRFIGLEKLDVIDTRTQQPVPADGKTIGEIVMSGNVVMKGYLKNPKANKETFANGWYHTGDLGVKHPDNYIEIRDRSKDIIISGGENISSVEVENMMYLHPAVLEASVVARADERWGESPCAFVTLKPEVDKSNEQQLAEDIMKFCRAKMPAYWVPKSIVFGPLPKTATGKIQKHVLRAKAKEMGPVRKSKL

SEQ ID NO: 5724 - protein, 567 aa, Vitis vinifera
MVVERDIDDLPKNAANYTALTPLWFLERAAVVHPNRKSVIHGSLQYTWLQTYQRCRRLASALSKYSIGAGSTVAIIAPNIPAMYEAHFGVPMSGAVVNCVNIRLNAPTIAFLLEHSSAAVVMVDQEFFPLAEEALKIWSGKSKNDFKPPLLIVIADESCDPKGLEYALRKGAIEYEQFLETGDPEFAWKPPQDEWQSIALGYTSGTTASPKGVVLHHRGAYVMALSGALVWGMNEGAVYLWTLPMFHCNGWCFTWTLAALCGTNICLRQVATKAIYQAIANDGVTHLCAAPVVLNSIVNAPKSETILPLPRVVHVMTAGAAPPPSVLFAMSQQGFRVTHTYGLSETYGPSTVCAWKPEWDELPPETQARLNARQGVRYIGLEGLDVVSTTDMKPVPADGTTIGEIVMRGNTVMKGYLKNPKANEETFANGWFHSGDLGVKHPDGYIQLKDRSKDIIISGGENISSVEIENAVYLHPAVLEASVVARPDDRWGESPCAFVTLKPGVDRSDERRLAEDIMKFCRSKLPAYWIPKSVVFGPLPKTATGKIQKHLLRARAKEMGTLKKSKL

SEQ ID NO: 5725 - protein, 565 aa, Arachis hypogaea
MVARDIDELPKNAANYTALTPLWFLERAAQVHPTRASLIHGSRRYTWQQTYHRCRRFASALNNRSIGLGNTVAVIAPNIPALYEAHFGIPMAGAVLNPVNIRLNASTIAFLLGHSSASAVIVDQEFFTLAEEALKIWSDKTKGFKPPLLVVIGDENCDPKQLRYAKGKGAIEYEDFLESGDPGYAWKPPEDEWQSIALGYTSGTTASPKGVVLHHRGAYLMSLSGAVIWGMNEGAVYLWTLPMFHCNGWCYTWTLAALCGTNICLRQVAAKAVYEAIAKYKVTHFCAAPVVLNTIVNAPPEDTILPLPHVVHVNTAGAAPPPSVLAAMSQRGFRVTHTYGLSETYGPSTVCAWKPEWESLPPETQARLNARQGVRYIGLEGLEVVNTTTMQPVPADGKTIGEIVMRGNVVMKGYLKNPKANEETFANGWFHSGDLAVKHPDGYIEIKDRSKDIIISGAENISSVEIENVMYTHPAILEASVVARPDEKWGESPCAFVTLKPGVDASNEQRLVEDIMKFCRAKMPAYWVPKSVVFGPLPKTATGKIQKHLLRAKAKEMGPVKISKL

SEQ ID NO: 5726 - protein, 564 aa, Manihot esculenta
MARDIDDLPKLEANHMALTPLWFLERAATVHPTRTAVVHGSVHYTWQQTYQRCRRLASALSKRNIGAGSTVATIAPNVPAMYEAHFGIPMAGAVLNTVNIRLNASTIAFLLGHSKSAIVMVDQEFFPLAENALKILAEKDSHYNPPLLIVIADESCDPKSLKDALGKGAIEYDKFLESGDPDFAWKPPEDEWQSIALGYTSGTTASPKGVVLSHRGAYLMALSCAMIWGLNEGAIYLWTLPMFHCNGWCYPWSLAALCGTNICLRQVTAKAVYSAIANQGVTHFCAAPVVLNTIVNAPNEETILPLPRVVHVNTAGAAPPPSVLFAMSEKGFRVTHTYGLSETYGPSTVCAWKPEWDSLPPIKQARLNARQGVRYIGLEGLEVVDTKTMKPVPADGKTMGEIVMRGNLVMKGYLKNPEANKEAFANGWFHSGDLAVKHPDGYIEIKDRSKDIIISGGENISSLEVENVLYTHPAVYEVSVVAREDERWGESPCAFVTLKPGMEKSSEGSLAEDIIKFCRSKMPAYWVPKSVVFGPLPKTATGKIQKHVLRAKAKEMGPVKKSRL

SEQ ID NO: 5727 - protein, 132 aa, Tropaeolum majus
MWRDIDDLPKNAANYTALTPLWFLERAAKVHPTRPSVIHGSLQYTWEQTYQRCRRLASALSNHSIGPGKTVAIIAPNIPAMYEAHFGVPMSGAVVNCVNIRLNAQTIAFLLGHSGTEVLMVDQEFFPWQRMP

SEQ ID NO: 5728 - protein, 568 aa, Fragaria vesca
MVAERDIDDLPKNEANYTALTPLWFLERAAVVHPTRKSVVHGSLHYTWLQTYQRCRRMASALNSHSVGLGCTVSIIAPNVPALYEAHFGVPMAGAVINTVNIRLNASTIAFLLGHSASVVVMVDQEFFPLVEEALKIWAEKSKGQFKPPLLIVIGDESLDPKGLKYAVGRGAIEYEKFLETGDPEYAWQPPKDEWQSIALGYTSGTTASPKGVVLHHRGAYLMSLSGGLVWEMNEGAVYLWTLPMFHCNGWCYTWALAALCGTNICLRQVSAKAVYSAIHKYAVTHFCAAPVVLNTIVNAPQDETILPLPHIVRVMTAGAAPPPSVLFGMSQRGFKVTHTYGLSETYGPSTVCAWKPEWDSLPPESQARLNARQGVRYIGLEGLDVLNPRTMEPVPADGKTVGEIMMRGNLVMKGYLKNPKANEETFANGWFHSGDLAVKHPDSYIEIKDRSKDIIISGGENISSVEVENTLYQHPAILEVSVVARPDEKWGESPCAFVTLKSGVNKSDEKRVAEDIMKFCREKMPAYWVPKSVVFGPLPKTATGKIQKHLLRAKAEELGPVKKMSKL

SEQ ID NO: 5729 - protein, 565 aa, Eucalyptus grandis
MARDIDDLPKNAANYTALTPLWFLDRAATVHPGRRSLVHGSVTFTWRQTYQRCRRLASALSRRSIGLGNSVAVIAPNVPALFEAHFGVPMAGAVVNAVNIRLNAAAVGFLLGHSSSEVVMVDQEFFPLAEEALKIVAEKSDKNYKPPLLIVIADESCDPRTLTHALGKGAIEYEKFLETGDPEFAWQPPEDEWQSIALGYTSGTTASPKGVVLHHRGAYLMSISAPLVWGMNEGAIYLWTLPMFHCNGWCFTWGLAAFCATSICLRQVTAKAVYSAIAKYGVTHFCAAPVVLNTIVNAAPEDTILPLPHTVHVMTAGAAPPPSVLFGMSQKGFRVAHTYGLSETYGPSTICAWKPEWDSLPPEEQARLNSRQGVRYTGLEGLEVLSTQDMKPVPADGKTVGEIVMRGNVVMKGYLKNPKANEESFAGGWYHSGDLGVKHPDGYIEIKDRSKDIIISGGENISSVEVENALYTHPAILEVSVVARPDVRWGESPCAFVTLKPGVDKSDERRLAQDIMKFSREKLPAYWVPKSVVFGPLPKTATGKIQKHVLRAKAKEMGPVKTSKL

SEQ ID NO: 5730 - protein, 565 aa, Eucalyptus grandis
MARDIDDLPKNAANYTALTPLWFLDRAATVHPDRRSLVHGAVAFTWRQTYRRCRRLASALSRRSVGLGSTVAVIAPNVPALFEAHFGVPMAGAVVNCVNIRLNAPTVAFLLGHSSSAVIMVDQEFFPLAEEALKILAEKSDKNYKPPLLIVIADENCDPRTLKYALGKGAIEYEKFLETGDPEFAWKPPEDEWQSITLGYTSGTTASPKGVVLSHRGAYLMSVSGPLVWGMNEGAIYLWTLPMFHCNGWCFTWSLAALCGTSICLRQVTAEAVYSAIAKYGVTHFCAAPVVLNTIVNAAAEETILPLPHTVHVMTAGAAPPPSVLFAMSQKGFRVTHTYGLSETYGPSTICAWKPEWDSLPPEQQARLNARQGVRYTALEGLDVVSTQDMKPVPADGKTVGEIVMRGNAIMKGYLKNPKANEETFAGGWFHSGDLGVKHPDGYIEIKDRSKDIIISGGENISSVEVENILYSHPAILEVSVVARPDVRWGESPCAFVTPKPGANKSDERRLAEDIMKFCREKMPAYWVPKSVIFGPLPKTATGKIQKHVLRAKAKEMGPVKYSKL

SEQ ID NO: 5731 - protein, 567 aa, Prunus persica
MVVERDIDDLPKNNANYTALTPLWFLERAAVVHPTRKSVVHGSLHYTWQQTYQRCRRLASALSKRSIGLGTTVSIIAPNIPAIYEAHFGVPMAGAVLNTVNVRLNAPTIAFLLGHSSSVVVMVDQEYFPLAEEALKIWEEQSKGHYKPPLLIVIGDENCDPGALKSALGRGAVEYEKFLESGDPEYAWKPPEDEWQSISLGYTSGTTASPKGVVLHHRGAYLMALSGPLVWGMTEGAVYLWTLPMFHCNGWCFPWSVAALCGTNICLRQVTAKAVYSAIAEYGVTHFCAAPVVLNTIVNAPPDETILPLPHVVHVMTAGAAPPPSVLLAMSQKGFRVTHTYGLSETYGPSTVCAWKPEWDLLSPVTQARLNARQGVRYIGLEGLDVFNPQTMQPVPADGATMGEIMMRGNLVMKGYLKNPKVNEEVFANGWYHTGDLAVKHPDGYIEIKDRSKDIIISGGENISSVEVENTLYQHPAIFEVSVVARPHEKWGETPCAFVTLKPGVDKSDEKRLAEDIINFCRSKLPAYWVPRSVVFGPLPKTATGKIQKHLLRAKAKELGPLKMSKL

SEQ ID NO: 5732 - protein, 564 aa, Castanea mollissima
MGQDIDDLPKHAANFTALTPLWFLDRAALAHPDKTSLLHGSLRYTWRDTYNRCRRLASSLSKHSIGLGSTVAVIAPNIPALYEAHFGIPMAGAVLNAVNIRLNASTIGFLLGHSLAAVVMVDQEYFGLAEEALKIWAEKSRSFKPPLLIVIGDKNCDPNGLKYALGRGAIEYEKFLEAGDPEFAWKPPEDEWQSISLGYTSGTTASPKGVVLHHRGAYIMAMSNPIIWGMNDRPVYLWTLPMFHCNGWCFPWTLAAICATSICLRQVKAKEIYSAIAKHGVTHFCAAPVVLNSIVNAPPEETILPLPHTVHVMTAGAAPPPSVLLSMAEKGFRVTHTYGLSETYGPSTVCVWKPEWDSLPPVTQARLNARQGVRYVGLECVDVVNPKTMQPVPADGTTVGEIVFRGNVVMKGYLKNPKANEEAFANGWYHSGDLAVKHQDGYIEIKDRAKDIIISGGENISSVEVENALYLHPAIFEVSVVARPDERWGESPCAFVTLKPNVDKSDEQRLAEDIITFCKSKLPAYWVPKSVIFGPLPKTATGKIQKHLLRAKAKEMGPVRNSKL

SEQ ID NO: 5733 - protein, 564 aa, Ricinus communis
MAKDIDDLPKLQANYTALTPLWFLERAATVHPTRTAVVHGSERYSWLQTYHRCRRLASALNNRNIGAGSTVAVIAPNIPALYEAHFGVPMAGAVLNTVNIRLDAPTIAFLLGHSRSTVVMVDQEYFHLAEGAFKILAEKENNFSPPLLIVIADESCDPKQLQHALKRGAIEYEKFLENGDPEFAWKPPEDEWQSIALGYTSGTTASPKGVVLSHRGAYLMALSCAMIWGLNEGAVYLWTLPMFHCNGWCYTWSLAALCGTNICLRQVTAKAVYSAIANQGVTHFCAAPVVLNTIVNAPKEEAILPLPRVVHVNTAGAAPPPSLLFAMSEKGFRVTHTYGLSETYGPSTVCAWKPEWDSLPPIKQARLNARQGVRYIGLEGLDVVDTKTNKPVPADGKTMGEIVMRGNLVMKGYLKNPEANKEAFANGWFHSGDLAVKHPDGYIEIKDRNKDIIISGGENISSLEVENVLYTHPAVFEVSVVAREDERWGESPCAFVTLKEGTDKSDEGRLAEDIMKFCKSKMPAYWVPKSVVFGPLPKTATGKIQKHVLRDKAKKMGPVKKSKL

SEQ ID NO: 5734 - protein, 565 aa, Ricinus communis
MVVKDIDELPKNAANYTALTPLLFLDRAATVHPSRVSLVHGSTHYTWLQTYKRCRRLASALTNHSVGFGSTVAIIAPNVPAMYEAHFGVPMAGAVVNCVNIRLNASTVAFLLGHSKSEVVMVDQEFFSLAEEALEILAKSESSFKPALLIVIADKSCDPKSLKHALGRGAIEYEKFLESGDPEFAWKQPEDEWQSIALGYTSGTTASPKGVVLSHRGAYLMSLSNPLIWGMNEGAVYLWTLPMFHCNGWCFTWSLAALCGTNICLRQVTAKAVYSAIANNGVSHFCGAPVVLNTIVNAPKEETILPLPRIVHVMTAGAAPPPSVLFAMSEKGFRVTHTYGLSETYGPSTVCAWKPEWDSQPPIVQARLNARQGVRYIGLEGLDVVDPKTMKPVPADGKTIGEIVMRGNIVMKGYLKNPKANEEAFANGWFHSGDLAVKHPDNYMEIKDRSKDIIISGGENISSLEVENILYTHPAVYEASVVARPDEQWGESPCAFVTLKPGVNRSDERYLAEELIKFSRSKMPAYWVPKSVVFGPLPKTATGKIQKHVLRARAKEMGPVKKSKL

SEQ ID NO: 5735 - protein, 564 aa, Quercus alba
MGQDIDDLPKNAANFTALTPLWFLDRAALAHPDKTSLLHGSLRYTWRDTYNRCRRLASSLSKHSVGLGSTVAVIAPNVPALYEAHFGIPMAGAVLNAVNIRLNASTIGFLLGHSLAAVVMVDQEFFGLAEEALKIWAEKSRSFKPPLLIVIGDKNCDPNGLKYALGRGAIEYEKFLEAGDPEFAWKPPEDEWQSISLGYTSGTTASPKGVVLHHRGAYIMAMSNPLIWEMNDRPVYLWTLPMFHCNGWCFPWTLAAICATSICLRQVRAKEIYSAIAKHGVTHFCAAPVVLNSIVNAPPEETILPLPRTVHVMTAGAAPPPSVLLSMTEKGFRVTHTYGLSETYGPSTVCVWKPEWDSLPPVTQARLNARQGVRYVGLECLDVVDSKTMQPVPADGTTVGEIVFRGNIVMKGYLKNPKANEEAFANGWYHSGDLAVKHQDGYIEIKDRAKDIIISGGENISSVEVENALYLHPAIFEVSVVARPDERWGESPCAFVTLKPNVDKSDEQRLAKDILTFCKSKLPAYWIPKSVIFGPLPKTATGKIQKHLLRAKVKEMGPVRNSKL

SEQ ID NO: 5736 - protein, 567 aa, Vinca minor
MVVEKDIDDLPKNPANYATLTPLVFLERAALVHPNRKSLIHGSIHFTWLQTYQRCRRLASALTQRSVTFGSTVSVIAPNVPAMYEGHFGIPMSGAVLNAVNVRLNAQTIAFLLGHSESAVIMVDQEFFTLTEEALKILSEKSGNKFKPPLLIVIADESCDPKLLQHALRKGAIEYEEFLKSGDPNFAWKPPQDEWHSITLGYTSGTTASPKGVVLHHRGAYLMALSNPIIWGIQEGAVYLWTLPMFHCNGWCFTWTLAAICGTNVCLRQVTAKGVYSAIANQGVTHFCAAPVVLNTLLNAPQEETILPLPRLVHVMTAGAAPPPSVLFAMSQQGFRVTHTYGLSETYGPSTVCAWKPEWDSLPPETQARLNARQGVRYVGLEGLDVVNTQTMEPVPADGKTVGEIVFRGNLVMKGYLKNPKANEESFAGGWYHSGDLAVKHPDNYIEIKDRSKDIIISGGENISSVEVENILYQHPAILEVSVVARPDERWGESPCAFVTLKPGAEKSDEKRLAEDIMSFSKSKMPAYWVPKSVIFGPLPKTATGKIQKNLLRVKAKELGPVKRSKL

SEQ ID NO: 5737 - protein, 561 aa, Cajanus cajan
GIDDLPKNAANYTALTPLWFLQRAAQVHPTRNSLIHGSRRYTWQQTYHRCRQFASALSNRSIGLAKTVAVIAPNIPALYEAHFGIPMAGAVLNPVNIRLNASTIAFLLGHCTAAAVIVDQEFFSLAEEALKIWSEKAKTFNPPLLVVIGDENCDPKTLRYALGKGAIEYEDFLQSGDPEYAWIPPEDEWQSISLGYTSGTTASPKGVVLHHRGAYLMSLSGALIWGMTEGAVYLWTLPMFHCNGWCFTWTLAALCGTNICLRQVTAKAVYEAIAKYKVTHFCAAPVVLNTIINAPSEETILPLPHVVHVNTAGAAPPPSVLAGMSKRGFRVTHTYGLSETYGPSVYCAWKPEWDSLPPEDQARLNARQGVRYISLEGLEVVNTKTMQPVPADGKTVGEIVMRGNIVMKGYLKNPEANKETFANGWFHSGDLAVKHEDGYIEIKDRSKDIIISGAENISSVEIENALYSHPAILEAAVVARADEKWGESPCAFVTLKPGVDKSNEQVIVEDILKFCRAKMPAYWVPKSVVFGPLPKTATGKIQKHLLRAKAKEMGPVRMSKL

SEQ ID NO: 5738 - protein, 568 aa, Glycine max
MVGARPRDIDDLPKNAANYTALTPLWFLERAATVHPTRNSLIHGSRRYTWQQTYHRCRRFASALSNHSIGLGNTVAVIAPNIPALYEAHFGIPMSGAVLNPVNIRLNASTVAFLLGHCTAAAVIVDQEFFSLAEEALKIWSEKAKTFSPPLLIVISDENCDPKALKYALGKGAIEYEDFLQSGDPEYAWKPPEDEWQSIALGYTSGTTASPKGVVLHHRGAYLMSLSGALIWGMTEGAVYLWTLPMFHCNGWCYTWTLAALCGTNICLRQVTAKAVYGAIAKYKVTHFCAAPVVLNTLINAPAEDTILPLPHVVHVNTAGAAPPPSVLSGMSERGFRVTHTYGLSETYGPSVYCAWKPEWESLPPENQARLNARQGVRYIGLEGLAVVNTKTMEPVPADGKTVGEIVMRGNSVMKGYLKNPKANEETFANGWFHSGDLAVKHPDGYIEIKDRSKDIIISGAENISSVEIENTLYSHPSILEAAVVARADEKWGESPCAFVTLKPGVDKSNEQRIIEDILKFSRAKMPAYWVPKSVVFGALPKTATGKIQKHILRAKAKEMGPVKLSKL

SEQ ID NO: 5739 - protein, 567 aa, Malus domestica
MVVGRDIDDLPKNEANYTALTPLWFLDRAALVHPTRTSMVHGSIRYTWQQTYQRCRRLASALAKRSIGLGTTVSIIAPNVPALFEAHYGVPMAGAVLNTVNVRLNAATIAFLLGHSSSVVVMVDQEFFPLAEEALKIWAEKSEGSCKPPLLVVIGDESCDPMALKSALGRGAIEYETFLESGDPEFAWKPPEDEWQSIALGYTSGTTASPKGVVLHHRGAYLMALSGPLVWGMTEGAVYLWTLPMFHCNGWCFTWSLAALCGTNICLRQVTAKAVYSAIAEHGVTHFCAAPVVLNTLVNASPEETILPLPHVVQVMTAGAAPPPSILFAMSQKGFRVTHTYGLSETYGPSTVCAWKPEWDSLPPVKQARLNARQGVRYIGMEGVDVFNPETMQPVPADGATMGEIMMRGNLVMKGYLKNPKVNNEVFANGWFHSGDLAVKHPDNYIEIKDRSKDIIISGGENISSVEVENTLYQHPAIFEVSVVARPHEKWGETPCAFVTLKPGVDKSDENRMAEDIMKFCRSKLPAYWVPRSVVFGPLPKTATGKIQKHLLRAKAKELGPVTLSKL

SEQ ID NO: 5740 - protein, 567 aa, Cucumis sativus
MAGARDIDDLPKNHANYTALTPLWFIERAALVHPSRLSVVHGSRRYNWRQTYQRCRRLASALSNRSIGAGDTVAIIAPNIPAIYEAHFGVPMAGAVLNCVNIRLNAQTISFLLGHSASAVVMVDQEFFPLAEEALNILAAKGDGHYKPPLLIVIGDENCDPEALKYALSKGAIEYEKFLEIGNPEYAWKPPEDEWQSITLGYTSGTTASPKGVVLSHRGAYVMSLSAGLVWGMNEGAIYLWTLPMFHCNGWCYTWALAALCGTSICLRQVTAKAVYSAIAKHKVTHFCAAPVVLNTIVNAPKEDTILPLPHVVHVMTAGAAPPPSVLYAMSQKGFRITHTYGLSETYGPSTICAWKPEWDSLPPEAQARMNARQGVRYVGLEGLDVVNTQTMQPVPSDGKTVGEIVMRGNAVMKGYLKNPKANKEAFANGWFHSGDLGVKHPDGYIEIKDRSKDIIISGGENISSVEIENTLYQHPAILEVSVVARADERWGESPCAFVTLKSKIDKGDEQRMAEDIMKFCKSKMPAYWVPKSVVFGELPKTATGKVQKHLLRAKAKEMGPVKMSKL

SEQ ID NO: 5741 - protein, 566 aa, Trigonella foenum-graecum
MVTKQDIDDLPKNAANYIALTPLWFLERAAQVHPTRESLIHGSRHYTWHQTYQRCRRFASALSNRSIGLGNTVAVIAPNIPALYEAHFGIPMAGAVINPVNIRLNASTIAFLLGHCTASVVIVDQEFFSLAEEALKIWSEKTKTFKSPILIVIGDENCDPKSLRYALSKGAIEYEDFLRSGDPEYHWKPPEDEWQSIALGYTSGTTASPKGVVLHHRGAYLMSLSGALIWGMNEGAVYLWTLPMFHCNGWNYPWTLAAVFGTSICLRQVSAKAVYEAIAKYKVTHFCAAPVVLNSIINAPAEETILPLPHVVHVNTAGAAPPPSVLSGMSERGFRVTHTYGLSETYGPSVYCAWKPEWDSLPPESRARLHARQGVRYIALECLDVVNTKTMQPVPADGKTVGEIVMRGNAVMKGYLKNPKANEESFANGWYHSGDLAVKHPDGYIEIKDRSKDIIISGAENISSVEVENALYSHPAILEASVVARPDDKWGESPCAFVTLKPGVDSSNEQRLVEDILKFCRAKMPAYWVPKSVVFGPLPKTATGKVQKHLLRAKAKEMGPLKMSKL

SEQ ID NO: 5742 - protein, 568 aa, Catharanthus roseus
MGVVEKDIDDLPKNSANYTTLTPLGFLERAAQVHPNRKSVIHGSIHYTWLQTYHRCRQLASALSQRSVTFGSTVSVIAPNVPAMYESHFGIPMAGAVLNAVNIRLNAQTIAFLLGHSSSAVIMVDQEFFTLAEEALKLLSEKSKGKFKHPLLIVIADESCDPKSLQHALRKGAIEYEEFLKTGDPNFAWKPPQDEWHSITLGYTSGTTASPKGVVLHHRGAYLMAMSNAIIWGMQEGAVYLWTLPMFHCNGWCFTWTLAAICGTNVCLRQVTAKGVYSAIANQGVTHFCAAPVVLNTLVNAPQEETILPLPRLVHVMTAGAAPPPSVLFKMSQQGFRVAHTYGLSETYGPSTICAWKPEWDSLPPETQARMNARQGVRYVGLEGLDVVNTQNMKPVPADGTTVGEIVFRGNVVMKGYLKNPKANEEAFAGGWFHSGDLAVKHPDNYIEIKDRSKDIIISGGENISSVEVENVLYQHPAILEVSVVSRPDERWGESPCAFVTLKPGAQKSDEPRLAEDIISFSRSKMPAYWVPKSVIFGPLPKTATGKIQKHILRAKAKELGPVKKSRL

SEQ ID NO: 5743 - protein, 568 aa, Glycine max
MVRARPRDIDHLPKNAANYTALTPLWFLERAATVHPTRNSLIHGSRHYTWQQTYHRCRRFASALSNHSIGLGNTVAVIAPNIPAVYEAHFGIPMAGAVLNPLNIRLNASTIAFLLGHCTAAAVIVDQEFFSLAEEALKIWSEKAKTFSPPLLIVIGDENCDPKALKYALGKGAVDYEDFLQSGDPEYAWKPPEDEWQSISLGYTSGTTASPKGVVLHHRGAYLMSLSGALIWGMTEGAVYLWTLPMFHCNGWCYTWTLAALCGTNICLRQVTPKAVYEAIAKYKVSHFCAAPVVLNTIVNAPAEDTILPLPHVVHVNTAGAAPPPSVLSGMSERGFRVTHTYGLSETYGPSVYCAWKPEWESLPPENRARLNARQGVRYVGLEGLDVVNTKTMEPVPADGKTVGEIVMRGNSVMKGYLKNPKANEETFANGWFHSGDLAVKHPDGYIEIKDRSKDIIISGAENISSVEIENTLYSHPAILEAAVVARADEKWGESPCAFVTLKPGVDKSNGQRIIEDILKFCKAKMPAYWVPKSVVFGALPKTATGKIQKHILRAKAKEMGPVKLSKL

SEQ ID NO: 5744 - protein, 269 aa, Triticum aestivum
MARCSNGLLGLLNAGVLVLALVVLGGGIWLSHRASTTDCERFLERPVIALGALLLALSLAGLAGSLCRASCLLWLYLVALFLLIALLLVFTVFAFVVTNRGAGSVVSGRGYKEYRLGEYSTWLQRRVESADNWAKIRSCLRDGGVCQRFGARGESLQQFVTNNLSPIQSGCCKPPTGCNFTYQSETVWAKPTGLNSTNDPDCNTWSNDQRALCYDCQSCKAGVLANLKNDWKKIATVNIIFLIFLIIVYSVGCCAFRNNRRDNSYPAWK

SEQ ID NO: 5745 - protein, 269 aa, Triticum aestivum
MARCSNGLLGLLNAGVLVLALVVLGGGIWLSHRAATTDCERFLERPVIALGALLLALSLAGLAGSLCRASCLLWLYLVALFLLIALLLVFTVFAFVVTNRGAGSVVSGRGYREYRLGEYSTWLQRRVESAGNWAKIRSCLRDGGVCQRFGARGESLQQFVTNNLSPIQSGCCKPPTGCNFTYQSETVWAKPTGFNSTNDPDCNTWSNDPRALCYDCQSCKAGVLANVKNDWKKIATVNIIFLIFLIIVYSVGCCAFRNNRRDNSYPAWK

SEQ ID NO: 5746 - protein, 269 aa, Triticum aestivum
MARCSNGLLGLLNAGVLVLALVVLGGGIWLSHRASTTDCERFLERPVIALGALLLALSLAGLAGSLCRASCLLWLYLVALFLLIALLLVFTVFAFVVTNRGAGSVASGRGYREYRLGEYSTWLQRRVENADNWAKIRSCLRDGGVCQRFGARGESLQQFVTNNLSPIQSGCCKPPTGCNFTYQSETMWNKPPGFNSTNDPDCNTWSNDPRALCYDCQSCKAGVLANVKNDWKKIATVNIIFLIFLIIVYSVGCCAFRNNRRDNSYPAWK

SEQ ID NO: 5747 - protein, 257 aa, Avena sativa
MARCSNGLLGMLNAGVLVLSLVVLGGGIWLSHRAATTDCERFLERPVIALGVLLLALSLAGLAGSLCRASCLLWLYLVALFLLIALLLVFTVFAFVVTNRGAGSVVSGRGYKEYRVGEYSTWLQRRVENSDNWAKIRSCLHDGKVCQKLGARRETLQQFVTNNLSPIQSGCCKPPTGCNFTYQSETIWIKPPGLNSTDDPDCNTWSNDQNALCYDCQSCKAGVLANLRNDWKKIATVNIIFLIFLIIVYSVGCCAFR

SEQ ID NO: 5748 - protein, 269 aa, Oryza sativa
MARCSNGLLGLLNAGVLVLAVVVLGGGIWLSNRAATTDCERFMERPVVALGVLLLALSLAGLAGALCGASCLLWLYLLALFLLILALFVFTVFAFVVTNRGAGWVVSGRGYREYRLGDYSTWLQRRVENSANWAKIRSCLQDGKVCEKLGARRETMDQFVGSNLSPIQSGCCKPPTGCNFAYVSETVWTKPSGFNSTDDPDCTTWSNDQTALCYDCQSCKAGVLANLKNDWKKIATVNIIFLIFLIIVYSVGCCAFRNNRRDNSYPAWK

SEQ ID NO: 5749 - protein, 270 aa, Brachypodium distachyon
MARCSNGLLGLLNAGVLVLSLVVLGGGIWLSHRATTTDCERFLERPVIALGVLLLALSLAGLAGSLCRGASCLLWLYLLALFLLIALLFVFTVFAFAVTNPGAGSAVSGRGFKEYRLGAYSTWLQKRVEDSGNWAKIRSCLHDGGVCQKLGDRKETLQQFALSNLSPIQSGCCKPPTGCNFAYQSETVWTKPPGFNSTDNPDCITWSNNQNVLCYDCQSCKAGVLANLKNDWKKIATVNIIFLVFLIVVYSVGCCAFRNNRQDNSYPAWK

SEQ ID NO: 5750 - protein, 270 aa, Zea mays
MARCSNGLLGLLNAGVLVLAIVALGGGAWLSHRASTTDCERFLERPVIALGVLLLALSLAGLAGALCRASCLLWLYLLALFLLILLLFAFTVFAFVVTNRGAGWVVSGRGYKEYRLGDYSTWLQRRVENSQNWAKIRSCLQDGKVCQKLASRKETAAQFVNSNLSPIQSGCCKPPTGCNFTYQSETVWTKPAGFNTTTDDPDCTTWSNDQTVLCYDCMACKAGVLANLKNDWKKIATVNIVFLIFLVVVYSVGCCAFRNNRQDNSYPAWK

SEQ ID NO: 5751 - protein, 269 aa, Panicum virgatum
  misc_feature (197)..(197): Xaa can be any naturally occurring amino acid
MVRCSNGLLGLLNAGVLVLAVVALGGGAWLSHRASTDCERFLERPVIALGVLLLALSLAGLAGALCRASCLLWLYLLALFLLIVLLFAFTIFAFVVTNRGAGWVVSGRGYKEYRLGDYSTWLQRRVENAGNWAKIRSCLQDGKVCQKLGDRKETVTQFVNSNLSPIQSGCCKPPTGCNFTYQSETVWIKPAGFNTTXDDPDCTTWSNVQTVLCYDCMACKAGVLANLKNDWKKIATVNIVFLIFLIVVYSVGCCAFRNNRQDNSYPAWK

SEQ ID NO: 5752 - protein, 272 aa, Sorghum bicolor
MVRCSNGLLGLLNAGVLVLAVVALGGGAWLSHRASTTDCERFLERPVIALGVLLLVLSLAGLAGALCRASCLLWLYLLALFLLILLLFAFTVFAFVVTNRGAGWVVSGRGYKEYRLGDYSTWLQRRVENSQNWAKIRSCLQDGKVCEKLAARKETVAQFVNSNLSPIQSGCCKPPTGCNFTYQSETVWIKPAGFNTTSTTDDPDCTTWSNDQTVLCYDCMACKAGVLANLKNDWKKIATVNIIFLIFLIVVYSVGCCAFRNNRQDNSYPAWK

SEQ ID NO: 5753 - protein, 268 aa, Setaria italica
MVRCSNGLLGLLNAGVLVLAVVALGGGAWLSHRASTDCERFLERPVIALGVLLLALSLAGLAGALCRASCLLWLYLLALFLLIVLLFAFTIFAFVVTNRGAGWVVSGRGYKEYRLDYSTWLQRRVENAGNWAKVRSCLQDGKVCQKLADRKETVTQFVNSNLSPIQSGCCKPPTGCNFTYQSETVWIKPTGFNTTTDDPDCTTWSNDQTALCYDCMACKAGVLANLKNDWKKIATINIVFLIFLIVIYSVGCCAFRNNRQDNSYPAWK

SEQ ID NO: 5754 - protein, 365 aa, Zea mays
MGALHVVGEPRISFRQQPAAVVAKNGGHGAVVEEIHGLIRVYKDGHVERLPAIPAVPCTWGGTAPDAPGGVVARDVVVDPATGVWARLYAPTSAGDGARRPVVVYFHGGGFCVGSAAWSCYHEFLAQLAARAGCAVMSVDYRLAPEHRLPAAFDDGLAAVRWLRHQAAASASASACCNDDLSWWRARCGFDRVFLMGDSAGASIALHVAARLGQGQLGALPPLTVRGAVLIQPFLGGEGRTASEKNVAQPPRSALTLATSDCYWRLALPAGASREHPWCNPLSGRAAPRLETTPLPPLLVCVSETDILRDRNLELCRALREAGKRVEQAVYGGVGHAFQVLHNCHLSQPRTQEMLAHIKAFVSAR

SEQ ID NO: 5755 - protein, 354 aa, Triticum aestivum
MGALHVGEPRVSFQQQVGKNGGGHGAVVEEIHGLIRVYKDGHVERLPAIPDVPCTWGSTAAASGVLARDVAVDRATGVWARLYAPAAAAGKVPVVVYFHGGGFSVGSAAWSCYHEFLAQLPARAGCAVMSVDYRLAPENRLPAAFDDGLTALRWLRQQASRNAAASDEVSWWRSRCRFDRVFLMGDSAGAAIAFHVAARAGQGQLGALAPLSVKGAILIQPFFGGEARTASEKSMPQPPGSALSLSTSDSYWRMALPAGAGRDHPWCNPLARGAPRLETLALPPVLVCISEADILRDRNLELCRALRKAGKSVEQATYGGVGHAFQVLHNCHLSQPRTQEMLAHIRAFVSARSS

SEQ ID NO: 5756 - protein, 379 aa, Saccharum officinarum
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 5757 - protein, 379 aa, Panicum virgatum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPSRFEEARKFGCTEFVNPKDHNKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 5758 - protein, 379 aa, Sorghum bicolor
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 5759 - protein, 379 aa, Panicum virgatum
MATAGKVIKCRAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCILSCGISTGLGATINVAKPPKGSTVAIFGLGAVGLAAAEGARIAGASRIIGVDLNPSRFEEARKFGCTEFVNPKDHNKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 5760 - protein, 379 aa, Setaria italica
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHIGCVAKINPEAPLDKVCVLSCGISTGLGATINVAKPPKGSTVAIFGLGAVGLAAAEGARIAGASRIIGVDLNPSRFEEAKKFGCTEFVNPKDHSKPVQQVLADMTNGGVDRSVECTGNVNAMIQAFECVHDGWGVAVLVGVPHKDAEFKTHPMNFLNERTLKGTFFGNYKPRTDLPNVVELYMKKELEVEKFITHSVPFSEINKAFDLMAKGEGIRCIIRMQN

SEQ ID NO: 5761 - protein, 379 aa, Cynodon dactylon
MATTGKVIKCKAAVAWEAGKPLSMEEVEVAPPQAMEVRIKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPEAPLDKVCVLSCGISTGLGASINVAKPPKGSTVAVFGLGAVGLAAAEGARIAGASRIIGVDLNPNRFEEARKFGCTEFVNPKDHSKPVQEVLAEMTNGGVDRSVECTGNINAMIQAFECVHDGWGVAVLVGVPHKDAEFKTHPMNFLNERTLKGTFFGNFKPRTDLPNVVELYMKKELELEKFITHTVPFSEINKAFDLMAKGEGIRCIIRMDH

SEQ ID NO: 5762 - protein, 379 aa, Festuca arundinacea
MATAGKVIKCKAAVAWEAGKPLSMEEVEVAPPQAMEVRVKILFTSLCHTDVYFWEAKGQTPVFPRIFGHEAGGIVESVGEGVTEVAPGDHVLPVFTGECKECPHCKSAESNMCDLLRINTDRGVMISDGKSRFSIDGKPIYHFVGTSTFSEYTVLHVGCVAKINPEAPLDKVCVLSCGISTGLGASINVAKPPKGSTVAIFGLGAVGLAAAEGARIAGASRIIGVDLNANRFEEARKFGCTEFVNPKDHSKPVQEVLAEMTNGGVDRSVECTGNINAMIQAFECVHDGWGVAVLVGVPHKDAEFKTHPMNFLNERTLKGTFFGNFKPRTDLPNVVEMYMKKELEVEKFITHSVPFSEINKAFDLMAKGEGIRCIIRMEN

SEQ ID NO: 5763 - protein, 379 aa, Leymus cinereus x Leymus triticoides
MATAGKVIKCKAAVAWEAGKPLSMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNANRFEEARKFGCTEFVNPKDHSKPVQQVLAEMTNGGVDRSVECTGNVNAMIQAFECVHDGWGVAVLVGVPHKDAEFKTHPMNFLNERTLKGTFFGNFKPRTDLPNVVEMYMKKELEVEKFLTHSVPFSEINKAFDLMAKGEGIRCIIRMEN

SEQ ID NO: 5764 - protein, 379 aa, Oryza sativa
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 5765 - protein, 379 aa, Hordeum vulgare
MATAGKVIKCKAAVAWEAGKPLTMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKGEGIRCIIRMDN

SEQ ID NO: 5766 - protein, 379 aa, Saccharum officinarum
MATAGKVIKCQAPLAWEARKPLSIQEVEVAPPHAMEVRVKILFTSLCHTDVYFWEAKGHTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFVNPTDHNKPVQEVLAEMTNGGVDRSVECTGNINAMIQAFECVHDGWGVAVLVGVPHKDAEFKTHPMNLLNERTLKGTFFGNYKPRTDLPNVVELYMKKELEVEKFITHSVSFAEINKAFDLMAKGEGIRCIIRMEN

SEQ ID NO: 5767 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 5768 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGIDLNASRFEEARKFGCTEFVNPKDHSKPVQEVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 5769 - protein, 377 aa, Avena sativa
MATAGKVIKCKAAVAWEAGKPLSMEEVEVAPPQAMEVRVKILFTSLCHTDVYFWEAKGQTPVFPRIFGHEAGGIVESVGEGVTEVAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGIDLNANRFEEARKFGCTEFVNPKDHTKPVQEVLIEMTNGGVDRSVECTGNINAMIQAFECVHDGWGVAVLVGVPHKDAEFKTHPMKFLNERTLKGTFFGNFKPRTDLPNVVEMYMKKELEVEKFITHSVPFSEINKAFDLMAKGEGIRCIIHM

SEQ ID NO: 5770 - protein, 379 aa, Pseudoroegneria spicata
MATAGKVIKCKAAVAWEAGKPLSMEEVEVAPPQAMEVRVKILFTSLCHTDVYYWEAKGQTPVFPRVFGHEAGGIVESVGEGVTEVAPGDHVLPVFTGECKECPHCKSAESNMCDLLRINTDRGVMISDGKSRFSIDGKPIYHFVGTSTFSEYTVMHVGCVAKINPEAPLDKVCVLSCGISTGLGASINVAKPPKDSTVAIFGLGAVGLAAAEGARIAGASRIIGVDLNANRFEEARKFGCTEFVNPKDHSKPVQEVLAEMTNGGVDRSVECTGNISAMIQAFECVHDGWGVAVLVGVPHKDAEFKTHPMNFLNERTLKGAFFGNFKPCTDLPNVVEMYMRKELEVEKFITHSVPFSEINKAFDLMAKGEGIRCIIRMEN

SEQ ID NO: 5771 - protein, 282 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNVNAMISAF

SEQ ID NO: 5772 - protein, 162 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTDRGVMTSRGFQSMGSLSTILLGLPVHCHACWLCCKDQPRGSP

SEQ ID NO: 5773 - protein, 370 aa, Hordeum vulgare
MATAGKVIKCKAAVAWEAGKPLTMEEVEVAPPQAMEVRVKILFTSLCHTDVYFWEAKGQTPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVQGVPHKDAEFKTHPMNFLNERTLKGTFFGNFKPRTDLPNVVEMYMKKELEVEKFITHSVPFSEINKAFDLMAKGEGIRCIIRMDN

SEQ ID NO: 5774 - protein, 380 aa, Elaeis guineensis
MASTAGQVIKCKAAVAWEAGKPLVIEEVEVAPPQAMEVRVKILYTSLCHTDVYFWEAKGQTPVFPRIFGHEAGGIVESVGEGVTDLAPGDHVLPVFTGECKECAHCKSEESNMCDLLRINTDRGVMINDGKTRFSINGKPIYHFVGTSTFSEYTVIHVGCLAKINPSAPLDKVCVLSCGISTGFGATVNVAKPPKGSTVAIFGLGAVGLAAAEGARVSGASRIIGVDLNPNRFEEAKKFGCTEFVNPLDHKKPVQEVLAEMTNGGVDRSVECTGNIKAMISAFECVHDGWGVAVLVGVPHKDAEFKTHPMNFLNERTLKGTFFGNYKPRSDLPSVVEKYMNKELELEKFITHSVSFAEINKAFDLMLTGAGLRCIIRMED

SEQ ID NO: 5775 - protein, 379 aa, Panicum virgatum
MATAGKVIKCKAAVAWEAGKPLSIEEVEVAPPQAMEVRVKILYTALCHTDVYFWEAKGQTPVFPRILGHEAGGIVESVGEGVTDLAPGDHVLPVFTGECKECAHCKSEESNMCDLLRINVDRGVMIGDGKSRFSINGQPIFHFVGTSTFSEYTVIHVGCLAKINPEAPLDKVCVLSCGISTGLGATLNVAKPGKGSTVAIFGLGAVGLAAMEGARLAGASRIIGVDVNPAKYEQAKKFGCTDFVNPKDHNKPVQEVLIEMTNGGVDRSVECTGNVNAMISAFECVHDGWGVAVLVGVPHREDQFKTHPMNFLNEKTLKGTFFGNYKPRTDLPNVVEMYMKKELEVEKFITHSVPFSEINTAFDLMLKGEGLRCIMRMED

SEQ ID NO: 5776 - protein, 379 aa, Panicum virgatum
MATAGKVIKCKAAVAWEAGKPLSIEEVEVAPPQAMEVRVKILYTALCHTDVYFWEAKGQTPVFPRILGHEAGGIVESVGEGVTDLAPGDHVLPVFTGECKECAHCKSEESNMCDLLRINVDRGVMIGDGKSRFSINGQPIFHFVGTSTFSEYTVIHDGCLAKINPEAPLDKVCVLSCGISTGLGATLNVAKPAKGSTVAIFGLGAVGLAAMEGARLAGASRIIGVDVNPAKYEQAKKFGCTDFVNPKDHNKPVQEVLIEMTNGGVDRSVECTGNVNAMISAFECVHDGWGVAVLVGVPHREDQFKTHPMNFLNEKTLKGTFFGNYKPRTDLPNVVEMYMKKELEVEKFITHSVPFSEINTAFDLMLKGEGLRCIMRMED

SEQ ID NO: 5777 - protein, 380 aa, Aristolochia fimbriata
MSSTAGKVIRCKAAVAWEAGKPLVMEEVEVAPPQANEVRLKILFTSLCHTDVYFWEAKGQTPLFPRIFGHEAGGIVESVGEGVKDLSPGDHVLPVFTGECKECRHCKSEESNMCDLLRINTDRGVMIGDEKSRFSINGKPIYHFVGTSTFSEYTVVHVGCVAKINPEAPLDKVCVLSCGISTGLGATLNVAKPPKGSTVAVFGLGAVGLAAAEGARLAGASRIIGVDLNSSRFEAAKKFGVTEFVNPKDHNKPVQEVLAEMTGGGVDRSVECTGNVSAMISAFECVHDGWGVAVLVGVPNKDDTFKTHPMNLLNERTLKGTFFGNYKPRTDLPSVVEKYMKKELELEKFITHSVPFSEINKAFEYMLQGDGLRCIIRMDG

SEQ ID NO: 5778 - protein, 379 aa, Pennisetum glaucum
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFSINGQPIFHFVGTSTFSEYTVIHVGCLAKINPEAPLDKVCVLSCGISTGLGATLNVAKPVKGSTVAIFGLGAVGLAAMEGARLAGASKIIGVDVNPAKYEQAKKFGCTDFVNPKDHDKPVQEVLIEMTNGGVDRSVECTGNVNAMISAFECVHDGWGVAVLVGVPHREDQFKTHPMQFLNEKTLKGTFFGNYKPRTDLPNVVEMYMKKELEVEKFITHNVPFSEINTAFDLMLKGEGLRCIMRMED

SEQ ID NO: 5779 - protein, 380 aa, Amsonia hubrichtii
MASTAGQVIRCKAAVAWEPGKPLTIEEVEVAPPQKMEVRLKILFASLCHTDVYFWEAKGQNPVFPRILGHEAAGIVESVGEGVTELQPGDHVLPVFTGECKECAHCKSEESNMCDLLRINTDRGVMINDGKSRFSINGKPIYHFVGTSTFSEYTVVHVGCVAKINPLAPLDKVLVLSCGISTGLGATLNVAKPKKGSSVAVFGLGAVGLAAAEGARIAGASRIIGVDLNPARFEEAKKFGVTEFVNPKDYEKPVQEVIAEMTDGGVDRSVECTGNTNAMISAFECVHDGWGVAVLVGVPHKDAEFKTHPVNFLNERTLKGTFFGNYKPRSDLPSVVEQYMTGELELEKFITHEVTFSEINKAFDYMLKGEGIRCLIRMGC

SEQ ID NO: 5780 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 5781 - protein, 380 aa, Unknown
  Sequence found in Organisms: Citrus sinensis, Citrus clementina
MSSTVGQVIRCRAAVAWEAGKPLVMEEVEVAPPQANEVRVKILFTSLCHTDVYFWEAKGQNPLFPRIYGHEAGGIVESVGEGVTDLKPGDHVLPVFTGECKECAHCKSEESNMCDLLRINTDRGVMLNDGKSRFSINGKPIYHFVGTSTFSEYTVIHVGCLAKINPLAPLDKVCVLSCGISTGLGATLNVAKPAKGSTVAVFGLGAVGLAAAEGARIAGASRIIGVDLNSNRFEEAKKFGATEFVNPKDYNKPIQEVIAEMTNGGVDRSVECTGHIDAMISAFECVHDGWGVAVLVGVPHKDAVFKTHPMNLLNERTLKGTFFGNYKPRSDLPSVVEKYMSKELEVEKFITHTVPFSEINKAFEYMLRGEGLRCIIRMEE

SEQ ID NO: 5782 - protein, 227 aa, Setaria italica
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFSINGQPIFHFVGTSTFSEYTVIHVGCLAKINPEAPLDKVCVLSCGISTGLGATLNVAKPVKGSRSWSCRPCCHGRCEAGWGIKDHWCGPEPSKI

SEQ ID NO: 5783 - protein, 441 aa, Gossypium hirsutum
MNSMYMSLTNAPSKQASLTCKNISPLDSYFKRCQASKPQFTRIFFQVSKRKKRIVCQVNMSAQSTAGQVIRCKAAVAWEAGKPLVIEEVEVAPPQEMEVRLKILFTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVECTGNINAMISAFECVHDGWGVAVLVGVPNRDDAFKTHPVNFLNERTLKGTFFGNYKPRSDLPSVVEKYMNKELELEKFITQQVAFRDINKAFDYMLAGEGIRCIIRMDA

SEQ ID NO: 5784 - protein, 380 aa, Catharanthus roseus
MASTAGQVIRCKAAVAWEPGKPLVMEEVEVAPPQKMEVRLKILFTSLCHTDVYFWEAKGQNPVFPRILGHEAAGIVESVGEGVTELKPGDHVLPVFTGECKDCAHCKSEESNMCDLLRINTDRGVMIQDGKSRFSIKGKPIYHFVGTSTFSEYTVVHVGCVAKINPLAPLDKVCVLSCGISTGLGATLNVAKPTKGSSVAVFGLGAVGLAAAEGARIAGASRIIGVDLNPARFEEAKKFGVTEFVNPKDYDKPVQEVIAEMTGGGVDRSVECTGNTNAMISAFECVHDGWGVAVLVGVPHKDAEFKTHPMNFLNERTLKGTFFGNYKPRSDLPSVVEKYMTGELELEKFITHEVTFSEINKAFEYMLNGEGLRCLIRMET

SEQ ID NO: 5785 - protein, 380 aa, Manihot esculenta
MASTAGQVIRCKAAVAWEAGKPLVIEEVEVAPPQANEVRLKILFTSLCHTDVYFWEAKGQNPLFPRIYGHEAGGIVESVGEGVTDLKPGDHVLPVFTGECKECAHCKSEESNMCSLLRINTDRGVMLNDGKSRFSINGKPIYHFVGTSTFSEYTVVHVGCLAKINPLAPLDKVCVLSCGISTGLGATLNVAKPPKDSSVAVFGLGAVGLAAAEGARMAGASRIIGVDLNSGRFEEAKKFGVNEFVNPKDHKKPVHEVIAEMTDGGVDRSVECTGNVDAMISAFECVHDGWGVAVLVGVPHKDAVFKTHPVNLLNERTLKGTFFGNYKPRTDLPSVVEKYMNKELELEKFITHSVPFSEINKAFEYMLKGESLRCIIRMEE

SEQ ID NO: 5786 - protein, 379 aa, Sorghum bicolor
MATAGKVIKCKAAVAWEASKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTINGQPIFHFVGTSTFSEYTVIHVGCLAKINPEAPLDKVCILSCGISTGLGATLNVAKPVKGSTVAIFGLGAVGLAAMEGARLAGASRIFGVDINPAKYEQAKKFGCTDFVNPKDHDKPVQEVLIELTNGGVDRSVECTGNVNAMISAFECVHDGWGVAVLVGVPHREDQFKTHPMNFLNEKTLKGTFFGNYKPRTDLPNVVEMYMKKELELEKFITHSVPFSEINTAFDLMLKGESLRCIMRMED

SEQ ID NO: 5787 - protein, 379 aa, Saccharum officinarum
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTINGQPIFHFVGTSTFSEYTVIHVGCLAKINPEAPLDKVCILSCGISTGLGATLNVAKPVKGSTVAIFGLGAVGLAAMEGARLAGASRIFGVDINPAKYEQAKKFGCTDFVNPKDYDKPVQEVLIELTNGGVDRSVECTGNVNAMISAFECVHDGWGVAVLVGVPHREDQFKTHPMNFLNEKTLKGTFFGNYKPRTDLPNVVEMYMKKELELEKFITHSVPFSEINTAFDLMLKGESLRCIMRMED

SEQ ID NO: 5788 - protein, 380 aa, Eucalyptus grandis
MSGTAGQVIHCRAAVAWEAGKPLVIEQVEVAPPQAMEVRLKILYTSLCHTDVYFWEAKGQNPLFPRIYGHEAGGIVESVGEGVTDLKPGDHVLPIFTGECKECAHCKSEESNMCDLLRINTDRGVMLSDGKSRFSIKGQPIYHFLGTSTFSEYTVVHVGCVAKINPLAPLDKVCVISCGISTGLGAMVNVAKPPKGSTVAVFGLGAVGLSAAEGARIAGASRIIGVDLNPNRFQEAKKFGVTEFVNPKDHNKPVQEVIAEMTNGGVDRSVECTGNVDAMISAFECVHDGWGVAVLVGVPHKDAVFKTHPINLLNERTLKGTFFGNYKPRSDIPSVVEKYMNKELEVEKFITHQVPFSEINKAFDYMLKGEGLRCIIRMEE

SEQ ID NO: 5789 - protein, 380 aa, Ricinus communis
MACSAGQVIRCKAAVAWEAGKPLLIEEVEVAPPQANEVRLKILFTSLCHTDVYFWEAKGQNPLFPRIYGHEAGGIVESVGEGVTDLKPGDHVLPVFTGECKECAHCKSEESNMCSLLRINTDRGVMLNDGNSRFSINGKPIYHFVGTSTFSEYTVVHVGCLAKINPLAPLDKVCVLSCGISTGLGATLNVAKPAKGSSVVVFGLGAVGLAAAEGARIAGASRIIGVDVNSSRFEEAKKFGVTEFVNPKDYKKPVQEVIAEMTDGGVDRSVECTGNIDAMISAFECVHDGWGVAVLVGVPHKDAVFRTHPVNLLNERTLKGTFFGNYKPRSDLPSVVEKYMSKELELEKFITHSVPFSEINKAFEYMLKGEGLRCIIRMEE

SEQ ID NO: 5790 - protein, 380 aa, Cucumis sativus
MSTTLGQVIKCKAAVAWEAGKPLVIEEVEVAPPQANEVRVKILFTALCHTDVYFWEAKGQTPLFPRIFGHEAGGVVESVGEGVTDLKPGDHVLPVFTGECGDCRHCRSEESNMCDLLRINTDRGVMINDGKSRFSINGKPIHHFVGTSTFSEYTVVHVGCLAKINPAAPLDKVCVLSCGISTGLGATLNVAKPKKGSSVAIFGLGAVGLAAAEGARIAGASRIIGVDLNPSRFEEAKKFGCNEFVNPKDHNKPVQEVIAEMTDGGVDRSVECTGSIQAMISAFECVHDGWGVAVLVGVPNKDDAFKTHPMNLLNERTLKGTFFGNYKPRTDIPGVVEQYLKKELELEKFITHAVPFSEINKAFDYMLKGESIRCIIRMGE

SEQ ID NO: 5791 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 5792 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 5793 - protein, 380 aa, Theobroma cacao
MSSTAGQVIRCKAAVAWEAGKPLVVEEVELAPPQAMEVRLKILFTSLCHTDVYFWEAKGQTPLFPRIFGHEAGGIVESVGEGVTDLKPGDHVLPVFTGECGDCRHCKSEESNMCDLLRINTDRGVMLNDGKTRFSINGQPIYHFVGTSTFSEYTVVHVGCVAKINPAAPLDKVCVLSCGISTGLGATLNVAKPTKGSTVAIFGLGAVGLAAAEGARIAGASRIIGVDLNSKRFEEAKNFGCTEFVNPKDHDKPVQEVLAEMTNGGVDRSVECTGSINAMISAFECVHDGWGVAVLVGVPNKDDAFKTHPMNLLNERTLKGTFFGNYKPRSDLPSVVEKYMNKELELEKFITHEVPFSEINKAFEYMLRGEGLRCIIRMDA

SEQ ID NO: 5794 - protein, 379 aa, Hordeum vulgare
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEKTLKGTFFGNYKPRTDLPEVVEMYMRKELDLEKFITHSVPFSQINTAFDLMLKGEGLRCIMRMDQ

SEQ ID NO: 5795 - protein, 379 aa, Manihot esculenta
MAGTAGKVIRCKAAVAWEAGKPLVIEEVEVAPPQASEVRLKILFTSLCHTDVYFWEAKGQNPLFPRIYGHEAGGIVESVGEGVTDLKPGDHVLPVFTGECKDCAHCKSEESNMCSLLRINTDRGVMLNDGKSRFSIKGKPIYHFVGTSTFSEYTVVHVGCLAKINPLAPLDKVCVLSCGISTGLGATLNVAKPPKGSTVAIFGLGAVGLAAAEGARIAGASRIIGVDVNSNRFEEAKKFGVTEFVNPQHHNKPVQEVIAEMTDGGVDRSVECTGNVDAMISAFECVHDGWGVAVLVGVPHKEAVFKTHPINVLNERTLKGTFFGNYKPRTDLPSVVEKYMNKELELEKFITHSVPFSKINEAFELMLKAESLRCIIRME

SEQ ID NO: 5796 - protein, 378 aa, Ipomoea batatas
MACTAGQVIRCKAAVAWEAGKPLVIEEVEVAPPQKMEVRIKILFTSLCHTDVYFWEAKGQNPVFPRILGHEAAGIVESVGEGVTELAPGDHVLPVFTGECKECRHCKSEESNMCDLLRINTDRGVMLHDQKSRFTINGQPIYHFVGTSTFSEYTVCHVGSIAKINPHAPLDKVCVLSCGISTGLGATLNVAKPKPGSTVAVFGLGAVGLAAAEGARMAGASRIIGVDLVPSRFELAKKFGVTDFVNPKDHSKPVQEVIVGMTDGGVDRSVECTGNINAMISAFECVHDGWGVAVLVGVPHKEAVFKTHPMNLLNERTLKGTFFGNYKPRTDLPAVVEKYMNKELELEKFITHEVPFAEINKAFDLMLKGEGLRCIITM

SEQ ID NO: 5797 - protein, 379 aa, Avena sativa
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTMNGKPIFHFVGTSTFSEYTVIHVGCLAKINPKAPLDKVCVLSCGISTGLGATLNVAKPKKGSTVAIFGLGAVGLAAMEGAKMAGASRIIGVDLNPEKYEQAKKFGCTDFVNPKDHTKPVQEVLVEMTNGGVDRAVECTGNVNAMISAFECVHDGWGVAVLVGVPHKEAVFKTHPMNFLNERTLKGTFFGNYKPRTDLPEVVEMYMRKELEVEKFITHSVPFSQINTAFDLMLKGEGLRCVMRMGE

SEQ ID NO: 5798 - protein, 379 aa, Triphysaria pusilla
MSTTAGQVIKCKAAVAWEAGKPLVIEEIEVAPPQKMEVRMKILFTSLCHTDVYFWEAKAQDSVFPRIFGHEASGIVESVGEGVTELVPGDHVLPVFTGECGDCAHCKSQESNMCTLLRINCDRGVMLNDEKPRFSINGKPIYHFVGTSTFSEYTVVHAGCVAKINPLAPLDKVCVLSCGISTGLGATLNVAKPPKGSSVAIFGLGAVGLAAAEGARLAGASRIIGVDLNPARFENAKKFGVTEFVNPKDHDKPVQEVIAEMTDGGVDRSVECTGNVNAMISAFECVHDGWGVAVLVGVPHKDAVFKTHPMNLLNERTLKGTFFGNYKPRSDLPSVVEMYMKKELEVEKFITHEVPFAEINTAFDLMLKGEGLRCIIRME

SEQ ID NO: 5799 - protein, 380 aa, Eucalyptus grandis
MAGTAGQVIRCKAAVSWEAGKPLVMEEVEVAPPQAMEVRIKILFTSLCHTDVYFWEAKGQTPVFPRIFGHEASGIVESVGEGVTELQPGDHVLPVFTGECKECPHCKSEESNMCDLLRINTDRGVMLNDNKSRFSINGKPIYHFVGTSTFSEYTVVHVGCVAKINPAAPLDKVCVLSCGISTGLGATLNVAKPKKGQSVAIFGLGAVGLAAAEGARMSGASRIIGVDLNPNRFDEAKKFGVTEFVNPKDHSKPVQEVIAEMTNGGVDRSVECTGNINAMISAFECVHDGWGVAVLVGVPNKDDAFKTHPMNLLNERTLKGTFFGNFKPRTDLPSVVEKYMNKELELEKFITHEVPFSEINKAFDYMLQGAGLRCLIRMGE

SEQ ID NO: 5800 - protein, 380 aa, Theobroma cacao
MSSTAGQVIRCKAAVAWEAGKPLVVEEVELAPPQAMEVRLKILFTSLCHTDVYFWEAKGQTPLFPRIFGHEAGGIVESVGEGVTDLKPGDHVLPVFTGECGDCRHCKSEESNMCDLLRINTDRGVMLNDGKTRFSINGQPIYHFVGTSTFSEYTVVHVGCVAKINPAAPLDKVCVLSCGISTGLGATLNVAKPTKGSTVAIFGLGAVGLAAAEGARIAGASRIIGVDFNFKRFEEAKNFGCTEFVNPKDHDKPVQEVLAEMTNGGVDRSVECTGSINAMISAFECVHDGWGVAVLVGVPNKDDAFKTHPMNLLNERTLKGTFFGNYKPRFDLPSVVEKYMNKELELEKFITHEVPFSEINKAFEYMLRGEGLRCIIRMDA

SEQ ID NO: 5801 - protein, 380 aa, Ricinus communis
MTSTVGKVIHCKAAVAWEAGKPLVIEEVEVAPPQANEVRLKIIFTSLCHTDVYFWEAKGQNPLFPRIYGHEAGGIVESVGEGVNDLKPGDHVLPVFTGECKNCAHCKSEESNMCNLLRINTDRGVMLNDGKSRFSIKGKPIYHFVGTSTFSEYTVVHVGCVAKINPLAPLDKVCVLSCGISTGLGATLNVAKPPKGSTVAIFGLGAVGLAAAEGARIAGASRIIGVDVNSNRFEDAKKFGVTEFVNPKHHEKPVQEVIAEMTNGGVDRSVECTGNVDAMISAFECVHDGWGVAVLVGVPHKEAVFKTHPMNVLNERTLKGTFFGNYKPRTDLPSVVEKYMTKELELEKFITHSVPFSEINEAFELMLKGESLRCIIRMEE

SEQ ID NO: 5802 - protein, 381 aa, Castanea mollissima
MSSTTAGQVIRCKAAVAWEAGKPLVIEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSINGQPIYHFVGTSTFSEYTVVHVGCVAKINPAAPLDKVCVLSCGISTGLGATLNVAKPKKGSTVAVFGLGAVGLAAAEGARISGASRIIGVDLNAKRFDEAKKFGVTEFVNPKDHDKPVHEVLAEMTNGGVDRSIECTGSINAMISAFECVHDGWGVAVLVGVPNKDDAFKTHPMNILNERTIKGTFFGNYKPRSDLPSVVEKYMNKELELEKFITHEVSFSEINKAFEYMLRGEGLRCIIRMDA

SEQ ID NO: 5803 - protein, 381 aa, Quercus alba
MSSTTAGQVIRCKAAVAWEAGKPLVIEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSINGQPIYHFVGTSTFSEYTVLHVGSVAKINPAAPLDKVCVLSCGISTGLGATLNVAKPKKGSTVAVFGLGAVGLAAAEGARIAGASRIIGVDLNAKRFDEAKKFGVTEFVNPKDHDKPVHEVLAEMTNGGVDRSIECTGSINAMISAFECVHDGWGVAVLVGVPNKDDAFKTHPMNILNERTIKGTFFGNYKPRSDLPSVVEKYMNKELELEKFITHEVSFSEINKAFEYMLRGEGLRCIIRMDA

SEQ ID NO: 5804 - protein, 381 aa, Quercus alba
MSSTTAGQVIRCKAAVAWEAGKPLVIEEVEVAPPQAMEVRLKILFTSLCHTDVYFWEAKGQTPLFPRIFGHEAGGIVESVGEGVTDLKPGDHALPVFTGECKECRHCKSEESNMCDLLRINTDRGVMLNDGKSRFSINGQPIYHFVGTSTFSEYTVLHVGSVAKINPAAPLDKVCVLSCGISTGLGATLNVAKPKKGSTVAVFGLGAVGLAAAEGARIAGASRIIGVDLNAKRFDEAKKFGVTEFVNPKDHDKPVHEVLAEMTNGGVDRSIECTGSINAMISAFECVHDGWGVAVLVGVPNKDDAFKTHPMNILNERTIKGTFFGNYKPRSDLPSVVEKYMNKELEVEKFITHEVSFSEINKAFEYMLRGEGLRCIIRMDA

SEQ ID NO: 5805 - protein, 380 aa, Populus trichocarpa
MSSTAGQVIRCKAAVAWEAGKPLVMEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIRGQPIYHFVGTSTFSEYTVVHVGCVAKINPAAPLDKVCVLSCGISTGLGATLNVAKPKKGSSIAIFGLGAVGLAAAEGARIAGASRIIGVDLNSNRFDEAKKFGVTEFVNPKDHNKPVQEVIAEMTNGGVDRSVECTGSINAMISAFECVHDGWGVAVLVGVPNKDDSFKTHPMNVLNERTLKGTFFGNYKPRSDLPSVVEKYMNKELELEKFITHEVPFSEINKAFEYMLSGAGLRCIIRMGA

SEQ ID NO: 5806 - protein, 51 aa, Quercus alba
MSSTTAAQVIRCKAAVAWEAGKPLVIEEVEVGTTTGHGGSSQDPLHLPLPH

SEQ ID NO: 5807 - protein, 379 aa, Momordica charantia
MSTAGQVIKCKAAVAWEAGKPLVIEEVEVAPPQANEVRVKILFTALCHTDVYFWEAKGQTPLFPRIFGHEAGGVVESVGEGVTDLQPGDHVLPVFTGECGDCRHCQSEESNMCDLLRINTDRGVMINDGKTRFSINGQPIHHFVGTSTFSEYTVVHVGCLAKINPAAPLDKVCVLSCGISTGLGATLNVAKPKKGSSVAIFGLGAVGLAAAEGARISGASRIIGVDLNPSRFEEAKKFGCNEFVNPKDHNKPVQEVIAEMTDGGVDRSVECTGSIQAMISAFECVHDGWGVAVLVGVPNKDDAFKTHPMNLLNERTLKGTFFGNYKPRTDIPGVVEKYLNKELELEKFITHSVPFSEINKAFEYMLKGESIRCIIKMGD

SEQ ID NO: 5808 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAASECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 5809 - protein, 379 aa, Malus domestica
MSTAGQVIKCKAAVAWEAGKPLSIEEVEVAPPQKHEVRLKILFTSLCHTDVYFWEAKGQQPLFPRIFGHEAGGVVESVGEGVTELQPGDHVLPVFTGECRECAHCKSEESNMCDLLRINTDRGTMINDGQSRFSKDGKPIYHFVGTSTFSEYTVCHVGSVAKINPAAPLDKVCVLSCGICTGFGATVNVAKPKKGSSIAIFGLGAVGLAAAEGARVSGCSRIIGVDLNPSRFEEAKKFGVNEFVNPKDHNKPVQEVIAEMTNGGVDRSVECTGSIQAMISAFECVHDGWGLAVLVGVPNKDDAFKTHPMNFLNERTLKGTFYGNYKPRTDLPGVVEKYMNKELEVEKFITHSVPFAEINKAFDLMLSGQSIRCIICMEN

SEQ ID NO: 5810 - protein, 379 aa, Cucumis melo
MSTAGQVIKCKAAVAWEAGKPLVIEEVEVAPPQANEVRLKILFTSLCHTDVYFWEAKGQTPLFPRIFGHEAGGIVESVGEGVKDLQPGDHVLPIFTGECGDCSHCQSEESNMCDLLRINTDRGVMINDGKTRFSKNGQPIHHFVGTSTFSEYTVVHVGCLAKINPAAPLDKVCVLSCGISTGLGATLNVAKPKKGQSVAIFGLGAVGLAAAEGARIAGASRIIGVDLNPARFEEAKKFGCNEFVNPKDHNKPVQEVIAEMTNGGVDRSVECTGSIQAMIAAFECVHDGWGVAVLVGVPNKDDAFKTHPMNFLNERTLKGTFFGNYKPRTDIPGVVEKYLNKELELEKFITHTVSFSEINKAFDYMLKGESIRCIIRMDN

SEQ ID NO: 5811 - protein, 382 aa, Persea americana
MSSSTAGQVIRCKAAVAWEAGKPLVIEEVEVAPPQVMEVRLKILFTSLCHTDVYFWEAKGQTPVFPRIFGHEAGGIVESVGEGVTELKPGDHVLPVFTGECKECAHCKSEESNMCDLLRINTDRGRLMISDGQSRFSINGKPIYHFVGSSTFSEYTVVHIGCLAKINPLAPLDKVCVLSCGISTGLGAALNVAKPKKGSTVAVFGLGAVGLAAAEGARISGASRIIGIDLNPSRFDEAKKFGVTEFVNPKDHEKPVQEVIVEMTGGGVDRSIECTGNVNAMISAFECVHDGWGVAVLVGVPHKDAVFKTHPMNLLNERTLKGTFFGNYKPRSDLPSVVEKYMNKELELEKFITHEVPFSEINKAFEYMLDGAGLRCIIRMEG

SEQ ID NO: 5812 - protein, 382 aa, Quercus alba
MSSSNTAGQVIRCKAAVAWEAGKPLVIEEVEVAPPKAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSINGQPIYHFVGTSTFSEYTVVHVGCVAKINPAAPLDKVCVLSCGISTGLGATLNVAKPKKGSTVAIFGLGAVGLAAAEGARIAGASRIIGVDLNAKRFDEAKKFGVTEFVNPKDHDKPVQEVIAEMTGGGVDRSVECTGSINAMISAFECVHDGWGIAVLVGVPNKDDAFKTHPMNILNERTLKGTFFGNYKPRSDLPSVVERYMNKELELEKFITHEVPFSEINKAFEFMLKGDGLRCIIRMDA

SEQ ID NO: 5813 - protein, 380 aa, Eucalyptus grandis
MASTAGQVIRCKAAVAWEAGKPLVMEEVEVAPPQAMEVRIKILFTSLCHTDVFFWEAKGQTPLFPRIFGHEASGIVESVGEGVTELEPGDHVLPVFTGECKECRHCKSVESNMCDLLRINTDRGVMLNDNASRFSINGKPIYHFVGTSTFSEYTVVHVGCVAKINPAAPLDKVCVLSCGISTGLGATLNVAKPKKGQSVAIFGLGAVGLAAAEGARMAGASRIIGVDLNPNRFAEAKKFGVTEFVNPKDHNKPVQEVIAEMTDGGVDRSLECTGNINAMISAFECVHDGWGVAVLVGVPSKDDAFKTHPMNLLNERTLKGTFFGNYKPRTDLPSVVEKYMNKELDVEKFITHEVPFSEINKAFDYMLQGASLRCIIRMGA

SEQ ID NO: 5814 - protein, 380 aa, Citrus sinensis
MSGTAGQVIRCKAAVAWEAGKPLVIEEVEVAPPQKNEVRLKILFTSLCHTDVYFWEAKGQTPLFPRIFGHEAGGIVESVGEGVTDLQPGDHVLPVFTGECKECPHCHSEESNMCDLLRINTDRGVMINDGQSRFSIKGKPIYHFVGTSTFSEYTVTHVGCVAKINPAAPLDKVCVLSCGISTGFGATVNVAKPKKGQTVAIFGLGAVGLAAAEGARVSGASRIIGVDLNPSRFNEAKKFGVTEFVNPKDYDKPVQQVIAEMTNGGVDRSVECTGSVQAMISAFECVHDGWGVAVLVGVPHKDAVFKTHPMNLLNERTLKGTFFGNYKPRSDLPSVVEKYMSKELEVEKFITHTVPFSEINKAFEYMLRGEGLRCIIRMEE

SEQ ID NO: 5815 - protein, 379 aa, Mimulus guttatus
MSSTAGKVIKCKAAVAWEAGKPLVIEEVEVAPPQKMEVRLKILFTSLCHTDVYFWEAKAQDSVFPRILGHEAAGIVESVGEGVTELVPGDHVLPVFTGECGDCAHCKSEESNMCTLLRINVERGVMINDGKSRFSINGKPIYHFVGTSTFSEYTVAHVGCVAKINPLAPLDKVCVLSCGISTGLGATLNVAKPKKGSSVAIFGLGAVGLAAAEGARLAGASRIIGVDLNSGRFEEAKKFGVTEFVNPKDHDEPVQNVIAKMTDGGVDRSVECTGNIGAMISAFECVHDGWGVAVLVGVPHKDAVFKTHPMNVLNERTLKGTFFGNYKPRSDLPAVVEMYMNKELEVGKFITHEVPFAEINKAFELMLKGEGLRCIIRME

SEQ ID NO: 5816 - protein, 379 aa, Salvia sclarea
MSATAGQVIKCKAAVAWEAGKPLVIEEVEVAPPQKMEVRIKILYTSLCHTDVYFWEAKAQDSVFPRILGHEAAGIVESVGEGVTEVAAGDHVLPVFTGECGECAHCKSTESNMCSLLRINTERGVMIGDQKSRFSINGKPIYHFLGTSTFSEYTVLHVGCVAKINPLAPLDKVCVLSCGISAGLGATLNVAKPFKGSSVAVFGLGAVGLGAAEGARLAGASRVIGVDLNTARFEEAKKFGVTEFVNPKDYSKPVQEVIAEMTDGGVDRSVECTGNINAMISAFECVHDGWGVAVLVGVPHKDAVFKTHPVNFLNERTLKGTFFGNYKPRSGLPSVVEMYMNKELEVEKFITHTVPFAEINKAFELMLKGEGLRCVIRME

SEQ ID NO: 5817 - protein, 380 aa, Nicotiana tabacum
MSSTVGQVIRCKAAVAWEAGKPLVMEEVEVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMIQDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFELAKKFGVTEFVNPKDHNKPIQEVIAEMTDGGVDRSVECTGHIDAMISAFECVHDGWGVAVLVGVPHKEAVFKTHPMKLLNERTLKGTFFGNYKPRSDLPSVVEKYMNKELELEKFITHKLPFAEINKAFDLMLKGEGLRCIINMED

SEQ ID NO: 5818 - protein, 55 aa, Catharanthus roseus
MASTAGQVIRCKAAVAWEPGKPLVMEEVEVAPPQKMEVRLKILFTSLCHTDVYFW

SEQ ID NO: 5819 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 5820 - protein, 379 aa, Brachypodium distachyon
MATTGNVIKCKAAVAWEAGKPLSMEEVEVAPPQAMEVRVKILFTALCHTDVYFWEAKGQTPVFPRILGHEAGGIVESVGEGVTELVPGDHVLPVFTGECKECAHCKSEESNLCDLLRINVDRGVMIGDGQSRFTIDGKPIFHFVGTSTFSEYTVIHVGCLAKINPEAPLDKVCVLSCGISTGLGATLNVAKPKKDSTVAIFGLGAVGLSAMEGARMAGASRIIGVDMNPAKFEQAKKFGCTDFVNPRDHTKPVQEVLVEMTNGGVDRAVECTGNVNAMISAFECVHDGWGVAVLVGVPHKEAVFKTHPMNFLNEKTLKGTFFGNYKPRTDLPEVVEMYMRKELELEKFITHSVPFSQINTAFDLMLKGEGLRCVMRMEE

SEQ ID NO: 5821 - protein, 380 aa, Cichorium intybus
MASTTDQVIRCKAAVAWEAGKPLVIEEVEVAPPQKMEVRIKILFTSLCHTDVYFWEAKGQNPVFPRILGHEAGGVVESVGEGVTDLQPGDHVLPVFTGECKECAHCKSEESNMCDLLRINTDRGVMLHDQKSRFSINGKPIFHFVGTSTFSEYTVVHVGCLAKINPLAPLDKVCVLSCGISTGLGATLNVAKPKKGSSVAIFGLGAVGLAAAEGARISGASRIIGVDLNANRFELAKKFGVTEFVNPKDCKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHEVPFSEINKAFDLMLKGEGLRCIIRMGA

SEQ ID NO: 5822 - protein, 380 aa, Taraxacum officinale
MSTTTDKVIRCKAAVAWEAGKPLVIEEVEVAPPQKMEVRIKILFTSLCHTDVYFWEAKGQNPVFPRILGHEAGGVVESVGEGVTDLQPGDHVLPVFTGECKECAHCKSEESNMCDLLRINTDRGVMIHDQTSRFSINGKPIFHFVGTSTFSEYTVVHVGCLAKINPLAPLDKVCILSCGISTGLGATLNVAKPKKGSSVAIFGLGAVGLAAAEGARMAGASRIIGVDLNANRFELARKFGVTEFVNPKDYEKPVQEVIAEMTNGGVDRSVECTGHIDAMISAFECVHDGWGVAVLVGVPHKDAVFKTSPMNLLNERTLKGTFFGNYKPRSDIPSVVEKYMNKELELEKFITHEVPFSEINKAFDLMLKGEGLRCIIRMDA

SEQ ID NO: 5823 - protein, 380 aa, Lactuca sativa
MPSTTNQVIRCKAAVAWEAGKPLVIEEVEVAPPQKMEVRIKILFTSLCHTDVYFWEAKGQNPVFPRILGHEAGGVVESVGEGVTDLQPGDHVLPVFTGECKECAHCKSEESNMCDLLRINTDRGVMINDQKSRFSINGKPIFHFVGTSTFSEYTVVHVGCLAKINPLAPLDKVCVLSCGISTGLGATLNVAKPKKGSSVAIFGLGAVGLAAAEGARIAGASRIIGVDLNANRFELAKKFGVTEFVNPKDHTKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHELPFSEINKAFDLMLKGEGLRCIIRMGE

SEQ ID NO: 5824 - protein, 378 aa, Orobanche aegyptiaca
MSSTAGQVIKCKAAVAWEAGKPLVIEEIEVAPPQKMEVRLKILFTSLCHTDVYFWEAKAQDSVFPRILGHEAAGIVESVGEGVTELAPGDHVLPVFTGECGKCAHCKSEESNMCSLLRINTERGVMINDEKTRFSINGKPIYHFVGTSTFSEYTVLHVGCVAKINPLAPLDKVCVLSCGISTGLGATLNVAKPKKGSSVAIFGLGAVGLAAAEGARLAGASRIIGVDLNSARFEEAKKFGVTEFVNPKEYDKPVQEVIAELTDGGVDRSVECTGNINAMISAFECVHDGWGVAVLVGVPHKDAVFKTHPVNFLNERTLKGTFFGNYKPRSDLPAVVEMYMRKELEVEKFITHEVPFAEINKAFELMLKGEGLRCIIRM

SEQ ID NO: 5825 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 5826 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLIEMTNGGVDRAVECTGHVDTMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 5827 - protein, 379 aa, Triticum aestivum
METAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHVDAMVSAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 5828 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMAGAARIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 5829 - protein, 383 aa, Mimulus guttatus
MPPPSSATAGQVIKCKAAVAWEAGKPLVIEEIEVAPPQKMEVRLRILFTSLCHTDVYFWEAKAQDSVFPRIFGHEAAGIVESVGEGVTELVPGDHVLPVFTGECGECAHCKSEESNMCTLLRINTERGVMINDGKSRFSINGKPIYHFIGTSTFSEYTVVHVGCLAKINPLAPLDKVCVLSCGISTGLGAMLNVAKPKKGSSVAIFGLGAVGLGAAEGARLAGASRIIGIDLNPSRFEEAKKFGVTEFVNPKDYTKPIQEVIAEMTDGGVDRSVECTGNINAMISAFECVHDGWGVAVLVGVPHKDSEFKTHPVNFLNERTLKGTFFGNYKPRTDLPGVVEMYMNKELEVEKFITHEVPFAEINKAFELMLKGEGLRCIIKME

SEQ ID NO: 5830 - protein, 380 aa, Euonymus alatus
MSSTAGQVIRCKAAVAWEAGKPLVIEEVEVAPPQANEVRLKILFTALCHTDVYFWEAKGQTPVFPRIFGHEAGGIVESVGEGVTDLKPGDHVLPVFTGECKECPHCLSEESNMCDLLRINTDRGVMLNDGKSRFSINGKPIFHFVGTSTFSEYTVVHVGCLAKINPEAPLDKVCILSCGISTGLGATLNVAKPKKGQSVAIFGLGAVGLAAAEGARMAGASRIIGIDLNPSRFNEAKKFGVTEFVNPKDYDKPVQEVIAEMTNGGVDRSVECTGSIQAMISAFECVHDGWGVAVLVGVPNKDDAFKTHPMNLLNERTLKGTFFGNYKPRTDIPGVVEKYMNKEIELEKFITHSVPFSEINKAFDYMLKGESLRCIIRMGD

SEQ ID NO: 5831 - protein, 380 aa, Lippia dulcis
MSSTQGQVIRCKAAVAWETGKPLVIEEVEVAPPQKMEVRVKILFTSLCHTDVYFWEAKGQTPLFPRIFGHEAGGIVESVGEGVTEVQPGDHVLPIFTGECKECRHCKSAESNMCDLLRINTDRGVMIGDGKSRFSKDGKPIYHFLGTSTFSEYTVTHVGSLAKINPEAPLDKVCVLSCGISTGLGAALNVAKPTQGSTVAVFGLGAVGLAAAEGARISGASRIIGVDLNPSRFDEAKKFGVTEFVNPKDHNKPVQEVIAEMTDGGVDRSVECTGNVNAMISAFECVHDGWGVAVLVGVPNKDDAFKTHPVNFLNERTLKGTFFGNYKPRSDIPGVVEKYMRKELELEKFITHQVPFSDINKAFDIMLKGEGLRCMVSMAS

SEQ ID NO: 5832 - protein, 380 aa, Coffea canephora
MASTAGQVIRCKAAIAWEAGKPLVIEEVEVAPPQKMEVRLKILFTSLCHTDVYFWEAKGQHPVFPRILGHEASGIVESVGEGVTELQPGDHVLPVFTGECKECRHCKSEESNMCDLLRINTDRGVMLNDGKSRFSINGKPIYHFVGTSTFSEYTVVHVGCLAKINPLAPLDKVCVLSCGISTGLGATLNVAKPRRGSSVAVFGLGAVGLAAAEGARIAGASRIIGIDLLPDRFEQAKKFGVNEFVNPKDYPKPVQEVIAEMTDGGVDRSVECTGNVNAMISAFECVHDGWGVAVLVGVPHKDAVFQTHPMNVLNERTLKGTFFGNYKPRSDLPSVVEKYMNKELELEKFITHEVTFSEINKAFEYMLKGEGLRCLIRMEE

SEQ ID NO: 5833 - protein, 380 aa, Solanum phureja
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPIFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 5834 - protein, 381 aa, Glycine max
MASTTAGKVIRCKAAVAWEAGKPLVIEEVEVAPPQANEVRIKILFTSLCHTDVYFWEAKGQTPLFPRIFGHEAGGIVESVGEGVTDLKPGDHVLPVFTGECKECDHCKSEESNMCDLLRINTDRGVMLNDGKARFSINGQPIYHFVGTSTFSEYTVVHVGCVAKINPAAPLDKVCVLSCGISTGLGATLNVAKPNKGSSVAVFGLGAVGLAAAEGARLAGASRIIGVDLNSKRFTEAKKFGVTEFVNPKDYDKPVQEVIAEMTGGGVDRSVECTGSINAMISAFECVHDGWGVAVLVGVPNKDDAFKTHPINVLNEKTLKGTFFGNYKPRSDLPSVVEMYMNKELELEKFITHEVPFEEINKAFEYMLKGESLRCIIRMTE

SEQ ID NO: 5835 - protein, 380 aa, Helianthus annuus
MSTTTGQVIRCKAAVAWEAGKPLVIEEVEVAPPQKMEVRIKILFTSLCHTDVYFWEAKGQNPVFPRILGHEAGGVVESVGEGVTDLQPGDHVLPVFTGECKECAHCKSEESNMCDLLRINTDRGVMLHDQKSRFSINGKPIFHFVGTSTFSEYTVVHVGCLAKINPLAPLDKVCVLSCGISTGLGATLNVAKPKKGSSVAVFGLGAVGLAAAEGARISGAFRIIGVDLNANRFELAKKFGVTEFVNPKDYKKPVQEVIAEMTNGGVDRSVECTGHVDAMISAFECVHDGWGVAVLVGVPHKDAVFKTNPMNLLNERTLKGTFFGNYKPRSDIPSVVEKYMNKELELEKFITHEVPFSEINKAFDLMHKGEGLRCIIRMDA

SEQ ID NO: 5836 - protein, 380 aa, Solanum lycopersicum
MSTTVGQVIRCKAAVAWEAGKPLVMEEVDVAPPQKMEVRLKILYTSLCHTDVYFWEAKGQNPVFPRILGHEAAGIVESVGEGVTDLAPGDHVLPVFTGECKDCAHCKSEESNMCSLLRINTDRGVMLNDGKSRFSINGNPIYHFVGTSTFSEYTVVHVGCVAKINPLAPLDKVCVLSCGISTGLGASLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPLNFLNERTLKGTFFGNYKPRSDIPCVVEKYMNKELELEKFITHTLPFAEINKAFDLMLKGEGLRCIITMAD

SEQ ID NO: 5837 - protein, 401 aa, Centaurea maculosa
MSTNVGQVIRCKAAVAWEAGKPLVIEEVEVAPPEKMEVRVKILFTSLCHTDVYFWEAKGQNPVFPRILGHEAGGIVESVGEGVTELQPGDHVLPVFTGECRECAHCKSEESNMCDLLRINTDRGVMIHDQKSRFSIKGKPIFHFVGTSTFSEYTVVHVGCLAKINPLAPLDKVCVLSCGISTGLGATLNVAKPKKGQSVAIFGLGAVGLAAAEGARIAGASRIIGIDLNANRFELAKKFGVTEFVNPKDHTKPVQEVIVEMTNGGVDRSVECTGHIDAMISAFECVHDGWGVAVLVGVPHKDAVFKTNPVNLLNERTLKGTFFGNYKPRSDLPSVVEKYMNKELEVEKFITHQVPFSEINKAFDLMLKGKVFAASFAWVNRSFATLEILFDCFPFSCLNFE

SEQ ID NO: 5838 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCILSCGISTGLGATLNVAKPKKGSTVAIFGLGAVGLAAMEGAKISGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHRVPFSQINTAFDLMLKGEGLRCVMRMDE

SEQ ID NO: 5839 - protein, 379 aa, Hordeum vulgare
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTTGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHIDAMISAFECVHDGWGVAVLVGVPHKEAVFKTHPMNFLNERTLKGTFFGNYKPRTDLPEVVEMYMRKELDLEKFITHNVPFSQINTAFDLMLKGEGLRCVMRMDE

SEQ ID NO: 5840 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLAKINPSAPLDKVCVLSCGISTGLGATLNVAKPKKGSTVAIFGLGAVGLAAMEGAKMAGASRIIGVDLNPAKYEQAKKFGCTDFVNPMDHTKPLQEVLVEMTNGGVDRAVECTGHVDAMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 5841 - protein, 380 aa, Arnica chamissonis
MLSTVGHVIRCKAAVAWEAGKPLVIEEVEVAPPQKMEVRVKILFTSLCHTDVYFWEAKGQNPLFPRILGHEAGGVVESVGEGVTDVEPGDHVLPVFTGECKECAHCKSEESNMCDLLRINTDRGVMIHDQKSRFSINGKPVFHFVGTSTFSEYTVVHVGSLAKINPLAPLDKVCVLSCGISTGLGATLNVAKPKKGSSVAIFGLGAVGLAAAEGARMAGASRIIGVDLNANRFELAKNFGVTEFVNPKDYKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHEVPFSEINKAFDLMLKGEGLRCIIRMGA

SEQ ID NO: 5842 - protein, 381 aa, Theobroma cacao
MPSTTVGQVIRCKAAVAWEAGKPLVIEEVEVAPPQAMEVRLKILFTSLCHTDVYFWEAKGQTPLFPRIFGHEAGGIVESVGEGVTDLEPGDHVLPVFTGECKECRHCKSEESNMCDLLRINTDRGVMLHDGKSRFSINGQPIYHFVGTSTFSEYTVVHVGCVAKINPAAPLDKVCVLSCGISTGLGATLNVAKPGKGSTVAIFGLGAVGLAAAEGARMAGASRIIGVDLNSKRFNEAKKFGVTEFVNPKDHGKPVQEVIAEMTGGGVDRSVECTGNINAMISAYECVHDGWGVAVLVGVPNKDDTFKTHPMNVLNEKTLKGTFFGNYKPRSDLPLVVEKYMNKELQLEKFITHEVPFSEINKAFDYMLRGDSLRCVIRMDA

SEQ ID NO: 5843 - protein, 380 aa, Unknown
  Sequence found in Organisms: Citrus sinensis, Citrus clementina
MSGTAGQVIRCKAAVAWEAGKPLVIEEVEVAPPQKNEVRLKILFTSLCHTDVYFWEAKGQTPLFPRIFGHEAGGIVESVGEGVTDLQPGDHVLPVFTGECKECPHCHSEESNMCDLLRINTDRGVMINDGQSRFSIKGKPIYHFVGTSTFSEYTVTHVGCVAKINPAAPLDKVCVLSCGISTGFGATVNVAKPKKGQSVAIFGLGAVGLAAAEGARVSGASRIIGVDLNPSRFNEAKKFGVTEFVNPKDYDKPVQQVIADMTNGGVDRSVECTGSVQAMISAFECVHDGWGVAVLVGVPNKDDAFKTHPMNLLNERTLKGTFFGNYKPRSDLPSVVEKYMNKELEVEKFITHTVPFSEINKAFDLMLAGESIRCIIRMDG

SEQ ID NO: 5844 - protein, 380 aa, Eucalyptus grandis
MSSTVGKVIRCKAAVAWEAGKPLVIEDVEVAPPQAMEVRVKIVVTALCHTDVYFWEAKGQTPVFPRIFGHEAAGIVESVGEGVTELKPGDHVLPVFTGECKECRHCKSEESNMCDLLRINTDRGVMLNDGKSRFSINGKPIYHFVGTSTFSQYSVIHVGCLAKINPAAPMDKVCILSCGVSTGLGATLNVAKPPKGSTVAIFGLGAVGLSAAEGARIAGASRIIGVDLNPKRFDEAKKFGVTEFVNPKDHHKPVQEVLAEMTDGGVDRSVECTGSVNAMISAFECVHDGWGVAVLVGVPNKDDAFKTHPMNFLNEKTLKGTFFGNYKPRTDLPNVVEMYMRKELELEKFITHEVCLSEINKAFDYMLKGESLRCIIRMDG

SEQ ID NO: 5845 - protein, 380 aa, Eucalyptus grandis
MSTTVGKVIRCKAAVAWEAGKPLVIEEVEVAPPQAMEVRVKIVVTALCHTDVYFWEAKGQTPVFPRIFGHEAAGIVESVGEGVTELKPGDHVLPVFTGECKECRHCKSEESNMCDLLRINTDRGVMLNDGKSRFSINGKPIYHFVGTSTFSQYSVIHVGCLAKINPAAPMDKVCILSCGVSTGLGATLNVAKPPKGSTVAIFGLGAVGLSAAEGARIAGASRIIGVDLNPKRFDEAKKFGVTEFVNPKDHHKPVQEVLAEMTDGGVDRSIECTGSVNAMISAFECVHDGWGVAVLVGVPNKDDAFKTHPMNFLNEKTLKGTFFGNYKPRTDLPNVVEMYMRKELELEKFITHEVCLSEINKAFDYMLKGESLRCIIRMDR

SEQ ID NO: 5846 - protein, 379 aa, Triticum aestivum
METAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHVDAMVSAFECVHDGWGVAVLVGVPHKEAVFKTHPMNLLNERTLKGTFFGNYKPRTDLPEVVEMYMRKELDVEKFITHSVPFSQINTAFDLMLKGEGLRCVMRMDE

SEQ ID NO: 5847 - protein, 380 aa, Musa acuminata
MSSTAGQVIRCRAAVAWEAGKPLVVEEIEVAPPKAMEVRVKILYTSLCHTDVYFWEAKGQTPVFPRIFGHEAGGVVESVGEGVTGLAPGDHVLPIFTGECGECAHCKSQESNMCDLLRINTDRGVMIGDGQSRFSINGKPIYHFLGTSTFSEYTVIHVGCLAKINPSAPLDKVCVVSCGISTGYGATVNVARPPKGSTVAVFGLGAVGLAAAERARASGASRIIGVDLNPSRFEGAKKFGVNEFVNPADHKKPVQEVLAEMTNGGVDRSIECTGNINAMISAFECVHDGWGVAVLVGVPHKDAVFKTHPVNFLNERTLKGTFFGNYKPRSDIPGVVEKYMNKELELEKFITHSVTFSEINKAFDYMLQGVGLRCIIRMDG

SEQ ID NO: 5848 - protein, 380 aa, Beta vulgaris
MTSTAGQVIRCKAAVAWEAGKPLVMEEVEVAPPQKMEVRVKILFTSLCHTDVYFWEAKGQTPVFPRILGHEAGGIVESVGEGVTDLQPGDHVLPVFTGECKECAHCKSEESNMCDLLRINTDRGVMLNDGKSRFSINGKPIFHFVGTSTFSEYTVVHVGCLAKINPEAPLDKVCILSCGISTGFGATVNVARPKKGQTVAIFGLGAVGLAAAEGARVSGASKIIGVDLVSSRFEAAKKFGVTDFVNPKDHNKPVQEVIAEMTNGGVDRSVECTGNIQAMISAFECVHDGWGVAVLVGVPNKDDAFKTHPVNFLNERTLKGTFFGNYKPRTDIPGVVEKYMNKELELDKFITHEVAFKDINKAFDLMLKGESIRCIIRMDA

SEQ ID NO: 5849 - protein, 380 aa, Ricinus communis
MSSTVGQVIRCKAAVAWEAGKPLVIEEVEVAPPQANEVRLKILFTSLCHTDVYFWEAKGQAPLFPRIFGHEASGIVESVGPGVTDLQPGDHVLPVFTGECKECRHCKSEESNMCDLLRINTDRGVMLTDGNSRFSINGKPIYHFLGTSTFSEYTVVHVGCVAKINPEAPLDKVCVLSCGISTGLGATLNVAKPKKGQSVAIFGLGAVGLAAAEGARLCGASRIIGVDLNPSRFEEAKKFGVNEFVNPKDYDKPVQQVLAEMTDGGVDRSVECTGSIQAMISAFECVHDGWGVAVLVGVPNKDDAFKTHPVNLLNERTLKGTFFGNYKPRTDLPSVVEKYMNKELEVEKFITHSVKFSEINKAFDYMLKGESLRCIISMEN

SEQ ID NO: 5850 - protein, 380 aa, Vitis vinifera
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPIYHFLGTSTFSEYTVVHVGCVAKINPLAPLDKVCVLSCGISTGLGATLNVAKPTKGSTVAVFGLGAVGLAAAEGARIAGASRIIGVDLNPKRYEGAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLKGEGLRCIIHMEP

SEQ ID NO: 5851 - protein, 380 aa, Actinidia deliciosa
MASTAGQVIRCRAAVAWEPGKPLVMEEVEVAPPQAMEVRLKILFTSLCHTDVYFWEAKGQTPLFPRIFGHEAGGIVESVGEGVTDLIPGDHVLPVFTGECKECRHCKSEESNMCDLLRINTDRGVMLNDGKSRFSIKGKPIYHFVGTSTFSEYTVVHVGCVAKINPAAPLDKVCILSCGISTGLGATLNVAKPKRGSTVAIFGLGAVGLAAAEGARIAGASRIIGVDLNSKRFDEAKKFGVTEFVNPKDHDKPVQEVIAEMTGGGVDRSVECTGSVNAMISAFECVHDGWGVAVLVGVPNKDDAFKTHPMNLLNEKTLKGTFFGNYKPRSDLPAVVEKYMNKELELEKFITHEVSFSEINKAFEYMLKGDSLRCIIRMDA

SEQ ID NO: 5852 - protein, 380 aa, Lactuca sativa
MSSTTNQVIRCKAAVAWEAGKPLVIEEVEVAPPQKMEVRIKILFTSLCHTDVYFWEAKGQNPVFPRILGHEAGGVVESVGEGVTELQPGDHVLPVFTGECKECAHCKSEESNMCDLLRINTDRGVMIHDQKSRFSINGKPIFHFVGTSTFSEYTVVHVGCLAKINPLAPLDKVCVLSCGISTGLGATLNVAKPKKGSSVAIFGLGAVGLAAAEGARIAGASRIIGVDLNANRFELAKKFGVTEFVNPKDYKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHELPFSEINKAFDLMLKGEGLRCIIRMGE

SEQ ID NO: 5853 - protein, 379 aa, Leymus cinereus x Leymus triticoides
  misc_feature (261)..(261): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCHLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKKEQAKKFGCTDFVNPKDHTKPVQEVLVEMXNGGVDRAVECTGHIDAMISAFECVHDGWGVAVLVGVPHKEAVFKTHPMNFLNERTLKGTFFGNYKPRTDLPEVVEMYMRKELDLEKFITHSVPFSQINTAFDLMLKGEGLRCVMSMDE

SEQ ID NO: 5854 - protein, 380 aa, Elaeis guineensis
MASTVGQVIKCRAAVAWEAGKPLVIEEVEVAPPQAMEVRMKILYTSLCHTDVYFWEAKGQTPVFPRIFGHEAGGIVESVGEGVTELAPGDHVLPIFTGECKECPHCKSEESNMCDLLRINTDRGVMIHDGKSRFSIKGKPVYHFLGTSTFCEYTVVHVGCVAKINPLAPLDKVCVISCGVSTGYGAAVNVAKPPKGSSVAVFGLGAVGLAAAEGARASGASRIIGVDVNPSTFEAAKKFGCTEFVNPLEHEKPVQEVIAGMTNGGVDRSVECTGNVNAMISAFECVHDGWGVAVLVGVPHKEAEFKTHPLNFLNERTLKGTFYGNYKPRSDIPSVVEKYMNKELELEKFITHSLPFSEINKAFDYMLKGESLRCIIHMDG

SEQ ID NO: 5855 - protein, 380 aa, Populus trichocarpa
MSSTVGKVIRCKAAVAWEAAKPLSIEEVEVAPPQANEVRLRILFTSLCHTDVYFWEAKGQTPLFPRIFGHEAGGIVESVGPGVTDLQPGDHVLPVFTGECGDCRHCKSEESNMCDLLRINTDRGVMLTDGKSRFSINGKPIYHFVGGSTFSEYTVCHIGSVAKINPAAPLDKVCILSCGISTGLGAALNVAKPKKGHTVAVFGLGAVGLAAAEGARLSGASRIIGVDLNPSRFNEAKKFGVTELVNPKDHDKPVQQVIIEMTDGGVDRSIECTGNVQAMISAFECVHDGWGVAVLVGVPGKDDEFKTHPMNLLNERTLKGTFFGNYKPRTDLPGVVEKYMNKELEVEKFITHSIPFSEINKAFDYMLKGEGLRCIIRMEG

SEQ ID NO: 5856 - protein, 380 aa, Populus trichocarpa
MSSTAGQVIRCKAAVAWEAGKPLVMEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIRGQPIYHFVGTSTFSEYTVVHVGCLAKINPAAPLDKVCILSCGVSTGLGATLNVAKPKKGSSVAIFGLGAVGLAAAEGARIAGASRIIGVDLNSNRFNEAKKFGVTEFVNPKDYKKPVQEVIAEMTNGGVDRSVECTGSINAMISAFECVHDGWGVAVLVGVPNKDDSFKTHPMSFLNEKTLKGTFFGNYKPRSDLPSVVEMYMNKELELEKFITHEVPFSEINKAFDYMLSGASLRCIIRMEA

SEQ ID NO: 5857 - protein, 380 aa, Fragaria vesca
MSSTEGKVICCRAAVAWEAGKPLVIEEVEVAPPQANVVRVKILYTSLCHTDVYFWEAKGQNPLFPRIYGHEAGGIVESVGEGVTDLKAGDHVLPVFTGECKECDHCKSEESNMCDLLRINTDRGVMLNDGKSRFSIKGKPIYHFVGTSTFSVYTVTHVGCLAKINPQSPLDKVCILSCGISTGLGATLNVRKPKKGSTVAVFGLGAVGLAAAEGARMAGASRIIGVDLNSNRFEEAKKFGITEFVNPKDHKKPVQEVIAELTNGGVDRSIECTGNIQAMIPAFECVHDGWGVAVLVGVPHKDAVFTTHPMNFLNERTLKGTFFGNYKPRTDIPSVVEKYMNKELEVDKFITHQLPFSQINKAFDYMLKGEGIRCIITMEE

SEQ ID NO: 5858 - protein, 372 aa, Helianthus annuus
IRCKAAVAWEAGKPLVIEEVEVAPPQKMEVRIKILFTSLCHTDVYFWEAKGQNPVFPRILGHEAGGVVESVGEGVTDLQPGDHVLPVFTGECKECAHCKSEESNMCDLLRINTDRGVMLHDQKSRFSINGKPIFHFVGTSTFSEYTVVHVGCLAKINPLAPLDKVCVLSCGISTGLGATLNVAKPKKGSSVAVFGLGAVGLAAAEGARIAGASRIIGVDLNANRFELAKKFGVTEFVNPKDYKKPVQEVIAELTNGGVDRSVECTGHIDAMISAFECVHDGWGVAVLVGVPHKDAVFKTSPLNVLNERTLKGTFFGNYKPRSDIPSVVEKYMNKELELEKFITHEVPFSEINKAFDLMLKGEGLRCIIRMDA

SEQ ID NO: 5859 - protein, 384 aa, Gossypium hirsutum
VNMSARSTAGQVIRCKAAVAWEAGRALTIEEVEVAPPQAMEVRLKILFTSLCHTDVYFWEAKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKICVLSCGISTGLGAILNVAKPTKGSTVAIFGLGAVGLAAAEGARIAGASRIIGVDLNPNRFEEAKKFGCNEFVNPKDYDKPVQEVLAEMTNGGVDRSVECTGNINAMISAFECVHDGWGVAVLVGVPNKDDAFKTHPVNFLNERTLKGTFFGNYKPRSDLPSVVEKYMNKELELEKFITHEVAFSDINKAFDYMLAGEGIRCLIRMDT

SEQ ID NO: 5860 - protein, 162 aa, Papaver somniferum
MANTTGQVIKCKAAVAWEAGKPLVIEEVEVAPPQDMEVRIKILFTSLCHTDVYFWEAKGQTPVFPRIFGHEAGGIVESVGKGVTDMQPGDQVLPVFTGECKECRHCKSEESNMCDLLRINTDRGVMLNDGQSRFSINGKPIYNFVGCSTFSEYTVCSCWLSC

SEQ ID NO: 5861 - protein, 380 aa, Eucalyptus grandis
MSSTVGKVIRCKAAVAWEAGKPLVIEEVEVAPPQAMEVRVKIVVTALCHTDVYFWEAKGQTPVFPRIFGHEAAGIVESVGEGVTELKPGDHVLPVFTGECKECRHCKSEESNMCDLLRINTDRGVMLNDGKSRFSINGKPIYHFVGTSTFSQYSVIHVGCLAKINPAAPMDKVCILSCGVSTGLGATLNVAKPPKGSTVAIFGLGAVGLSAAEGARIAGASRIIGVDLNPKRFDEAKKFGVTEFVNPKDHHKPVQEVLAEMTDGGVDRSIECTGSVNAMISAFECVHDGWGVAVLVGVPNKDDAFKTHPMNFLNEKTLKGTFFGNYKPRTDLPNVVEMYMRKELKLEKFITHEVRLSEINKAFDYMLKGESLRCIIRMDG

SEQ ID NO: 5862 - protein, 380 aa, Silene vulgaris
MSNTAGQVIRCKAAVAWEAGKPLVMEEVEVAPPQKMEVRVKILFTSLCHTDVYFWEAKGQTPVFPRILGHEAGGIVESVGEGVTELQPGDHVLPVFTGECKECAHCKSEESNMCDLLRINTDRGVMLNDGKSRFSINGKPIYHFVGTSTFSEYTVTHVGCLAKINPKAPLDKVCVLSCGISTGFGATVNVAKPKKGHTVAVFGLGAVGLAACEGARVSGASRIIGVDLLPSRFEAAKNFGVTDFVNPKDHDKPVQEVIAEMTNGGVDRSIECTGNVQAMISAFECVHDGWGVAVLVGVPNKDDAFKTHPMKFLNERTLKGTFFGNYKPRTDIPLVVEKYMNKEMELDKFITHEISFKDINKAFELMARGEGIRCIIRMDG

SEQ ID NO: 5863 - protein, 380 aa, Malus domestica
MSNTAGQVIRCRAAVAWEAGKPLVIEEVEVAPPQANEVRIKILFTSLCHTDVYFWEAKGQNPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPSAPLDKVCLLSCGISTGLGATLNVAKPKKGSTVAVFGLGAVGLAAAEGARLSGASRIIGVDLHSGRFEEAKKFGVTEFVNPKEHEKPVQEVIAELTNGGVDRSIECTGSTEAMISAFECVHDGWGVAVLVGVPHKDAVFKTHPVNFLNERTLKGTFFGNYKTRTDIPSVVEKYMNKELELEKFITHKVPFSEINKAFEYMLKGEGLRCIIRMEE

SEQ ID NO: 5864 - protein, 380 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSIAIFGLGAVGLAAAEGARIAGAARIIGIDLNPKRFNDAKKFGVTEFLNPKDHDKPIQEVIAEMTGGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 5865 - protein, 380 aa, Actinidia deliciosa
MSSTAGQVIRCKAAVAWEAGKPLVIEEVEVAPPQKMEVRLKILYTALCHTDVYFWEAKGQNPVFPRILGHEAGGIVESVGEGVTELTPGDHVLPVFTGECKECAHCKSQESNMCDLLRINTDRGTMIHDGKSRFSINGKPIYHFVGTSTFSEYTVVHEGCIAKINPLAPLDKVCVLSCGISTGFGATVNVAKPTKGSTVAVFGLGAVGLAAAEGARVSGASRIIGVDLNSNRFDQAKKFGVTEFVNPKDYNKPVQEVIAEMTGGGVDRSIECTGNIDVMISAFECVHDGWGVAVLVGVPHKDAVFKTHPMNFLNERTLKGTFFGNYKPRSDIPSVVEKYMNKELELEKFITHQVPFSEINKAFEYMLKGESIRCIISMKE

SEQ ID NO: 5866 - protein, 227 aa, Arachis hypogaea
MSNTAGQIIKCRAAVAWEAGKPLVIEEVEVAPPKAGEVRLKILYTSLCHTDVYFWEAKGQTPLFPRIFGHEAGGIVESVGEGVTHLKPGDHALPVFTGECGECPHCKSEESNMCDLLRINTDRGVMIHDQESRFSIKGKPIYHFVGTSTFSEYTVVHAGCVAKINPEAPLDKVCVLSCGICTGLGATINVAKPKPGSSVAVLDSELLVLLLLKGQGFLVHQESLGLI

SEQ ID NO: 5867 - protein, 380 aa, Capsicum annuum
MSSTIGQVIRCKAAVAWEAGKPLVIEEVEVAPPQKMEVRLKILYTSLCHTDVYFWEAKGQNPVFPRILGHEAAGIVESVGEGVIELAPGDHVLPVFTGECKDCSHCKSEESNMCSLLRINTDRGVMIHDGQSRFSINGKPIYHFVGTSTFSEYTVVHVGCVAKINPLAPLDKVCVLSCGISTGLGATLNVAKPTKGSSVAIFGLGAVGLAAAEGARIAGVSRIIGVDLNASRFEQAKKFGVTEFVNPKDHSKPVQEIIAEMTDGGVDRSVECTGHIDAMISAFECVHDGWGVAVLVGVPHKEAVFKTHPMNLLNERTLKGTFFGNYKPRSDLPSVVEKYMNRELELEKFITHTLPFAQINKAFDLMLKGEGLRCIITMED

SEQ ID NO: 5868 - protein, 380 aa, Petunia hybrida
MSSTAGQVIRCKAAVAWEAGKPLVIEEVEVSLLQKMEVRLKILYTSLCHTDIYFWEAKGQNPVFPRILGHEAAGIVESVGEGVTELVPGDHVLPVFTGECKNCAHCKSEESNMCSLLRINTDRGVMIHDDQSRFSINGKPIYHFVGTSTFSEYTVVHVGCVAKINPLAPLDKVCVLSCGISTGLGATLNVAKPTKGSSVAVFGLGAVGLAAAEGARIAGASRIIGVDLNASRFELAKKFGVTEFVNPKDYNKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHQLPFSDINKAFDLMLKGEGLRCIIHMEH

SEQ ID NO: 5869 - protein, 380 aa, Juglans hindsii x Juglans regia
  misc_feature (223)..(223): Xaa can be any naturally occurring amino acid
  misc_feature (304)..(304): Xaa can be any naturally occurring amino acid
MSSTVGQVIKCKAAVAWEAGKPLVIEEVEVAPPQANEVRVKILFTSLCHTDVYFWEAKGQTPLFPRIFGHEAGGIVESVGEGVTDLKPGDHVLPIFTGECKECRHCKSEESNMCDLLRINTDRGVMLSDGKTRFSKNGQPIYHFVGTSTFSEYTVIHVGCLAKINPAAPLDKVCVLSCGISTGLGATLNVAKPKKGQSVAVFGLGAVGLAAAEGARIAGASRXIGIDLNSSRFEEAKKFGVTEFVNPKDHDKPVQEVIAEMTDGGVDRAVECTGSIQAMISAFECVHDGWGVAVLVGVPNKDDXFKTHPMNLLNERTLKGTFFGNYKPRTDIPGVVGKYMNKELEVEKFITHSVTFSEINKAFDYMLHGKSIRCIISMDA

SEQ ID NO: 5870 - protein, 382 aa, Prunus persica
MSKSSAVGQVIRCRAAVAWEAGKPLVIEEVEVAPPQTNEVRLKILYTSLCHTDVYFWEAKGQKPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPLAPLDKVCVLSCGISTGLGATLNVAKPKKGSTVAVFGLGAVGLAAAEGARISGASRIIGVDLNSSRFEEAKKFGVTEFVNPKDHKKPVQEVIAELTNGGVDRSVECTGNVEAMISAFECVHDGWGVAVLVGVPHKEAVFKTHPVNFLNERTLKGTFFGNYKPRTDIPSVVEKYMNNELELEKFITHKVPFSEINKAFDYMLKGEGLRCIIHMEE

SEQ ID NO: 5871 - protein, 380 aa, Thalictrum flavum
MSSAVGQVIRCRAAVAWEAGKPLVIEQVEVAPPQAMEVRLKILFTSLCHTDVYFWEAKGQTPVFPRILGHEAGGIVESVGEGVTDLKPGDHVLPVFTGECKECAHCKSEESNMCDLLRINTDRGVMIGDGQSRFSINGKPIYHFVGTSTFSEYTVCHVGSVAKINPLAPLDKVCVLSCGITTGLGAALNVAQPKKGSTVAIFGLGAVGLGAAEGARIAGASRIIGIDMNPKRFIEAKKFGITEFVNPKDHDKPVQEVLAEMTDGGVDRSIECTGHVSAMISAFECVHDGWGVAVLVGVPNKDDVFKTHPMNLLNERTLKGTFFGNYKPKSDLPSVVEMYMNKELEVEKFITHEVSLSEINKAFDYMLAGDGLRCIIRMDA

SEQ ID NO: 5872 - protein, 380 aa, Taraxacum officinale
MPSTNNQVIRCKAAVAWEAGKPLVMEEVEVAPPQKMEVRIKILFTSLCHTDVYFWEAKGQNPVFPRILGHEAGGVVESVGEGVTDLQPGDHVLPVFTGECKECAHCKSEESNMCDLLRINTDRGVMINDQTSRFSINGKPIFHFVGTSTFSEYTVVHVGCLAKINPLAPLDKVCILSCGISTGLGATLNVAKPKKGSSVAIFGLGAVGLAAAEGARMAGASRIIGVDLNANRFELAKNFGVTEFVNPKDHKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHEVPFSEINKAFDLMLKGEGLRCIIRMGA

SEQ ID NO: 5873 - protein, 187 aa, Arnica chamissonis
MLSTVGHVIRCKAAVAWEAGKPLVIEQVEVAPPQKMEVRVKILFTSLCHTDVYFWEAKGQNPLFPRILGHEAGGVVESVGEGVTDVEPGDHVLPVFTGECKECAHCKSEESNMCDLLRINTDRGVMIHDQKSRFSITENPSSILSGLLLSASTPLFMLEVLRKSTLLPLSIKFVSSVVGSPQGLELL

SEQ ID NO: 5874 - protein, 379 aa, Cucumis sativus
MSTAGQVIKCKAAVAWEAGKPLVIEEVEVAPPQANEVRVKILFTALCHTDVYFWEAKGQTPLFPRIFGHEAGGIVESVGEGVKDLQPGDHVLPVFTGECGDCRHCQSEESNMCDLLRINTDRGVMISDGKTRFSKNGQPIHHFVGTSTFSEYTVVHIGCLAKINPAAPLDKVCVLSCGISTGLGATLNVAKPKKGQSVAIFGLGAVGLAAAEGARISGASRIIGVDLNPARFEEAKKFGCNEFVNPKDHSKPVQEVIAEMTNGGVDRSVECTGSIQAMIAAFECVHDGWGVAVLVGVPNKDDAFKTHPMNLLNERTLKGTFFGNYKPRSDIPGVVEKYLNKELELEKFITHTVSFSEINKAFEYMLKGESIRCIIKMDN
